United States Patent 11,001,841 (CCCTC-BINDING FACTOR (CTCF) RNA INTERACTOME) - sequence listing, part 17

SEQ ID NO: 42663 - DNA, 1029 bp, Homo sapiens
gggaatgtgatgctgaagtgatcccaagtcacattgtctttctgcctctgtgcactgtactctgcacaattgcatccatttttagaccatttccttctcatgagaatcatgtgcatggagggccaaaggagagacaagtgctcacaaggatatcatgagcacttatgaatgtacaaatgagtgctctccagtcagtgccatctttatattgttccggtttataggcaatgccttcatctttacctacagacacatgttgcctttctgtttcattttaatcctgttcatctatacatatttaatcacacaaatatctaaataagtttatgtcttgtagggaaggcactttgtcatgcttctttgtacctaagcatatgctttgcaaatcataaacaatagtgttgattttatttgatataaaaacttggattctcaaaagaaatctatgtgttcacacgataaacagagaccatctgaattgccaaagtatgactgaatcataagcagtattgttttagtcatctttacagaccaggaagatttgaaatacaggtgtaaaaagatgtgtgaggcatcaaaagaaatattcacctttctttgtgttcattttttttatttttgcttggccgagaaagaaggggtgttttccaagggaataggaggcttcagggcttattcctgtgcctacaagtcagagaggtcactggcttgccccttcctgaaggctgtaattacaggcagaggactatttattttcccgtaaggcgaccagaatcttgagtgtaaaaaactgtttacaagagtacactgtgtataggggttacacacaacctcaggaaaaataataggaaagtgagactatttttcttcatgtattcaataatatgagaaggtccaagactctggaaatgttctaaagtacaataatagagatgaatatgaggtcaaattaggtgatcctggggcttaaggaactgaattaaatgaataaagaagaggaatttctaatagggcataatctaactgata

SEQ ID NO: 42664 - DNA, 1033 bp, Homo sapiens
taactaatcacatatcaaagagcctatttccaaataaggtcacgatctgactttccaggtggacatgaattttgggaagacattattcggcctactgtaggtcttctaaatgaagtgaccatttaatatgtttctggcactggattcatttcatttaagcctcaaaacaaatctgttatgtagatatgtgttttcccactttacaagtgaagaactgaggtttagagatctaggaatcctaaagctgcacagccaggaagggcagggccacccctgacccaagttctctgctaggttagcatggttgtcacaggacaagctgagaaggtatttagggagcattacactaaaaagttgtagaagtcggcttaaggaagaagattctaaaatcaaaggaatcagattgtaggaggccatgtaggcaatttcctttaattcaatagaagagagtataagaatcagccaggcatggtggctcatgcctgtaatcctaacactttgggaggtcgaggtggaaggattgctagagcctgtgaattcaagaccagcctgggcaacatggcaaaatcccatctctacaaagaaatacaaaaattagccaggtattgtggcacatgcctgtagtcccagctactctggatgctgaggagggaggatctcttgagcccagaagggaagaggttgcagtgagccaagattgtgccactgcactgccgcctgggtgacagagccagagcctttcaagcaagcaagcaagagggaaggagggagagagggagagagagagagagagagagagagagagagagagagagagagagagagagagaaaagaaacggagagagagggagggagggaaggaaggagggaaaaagagagaaagaaagagaaatatgaaagaaagaaagagtaaggaaggaaagaaagaaggaaagaaagaaaaagaaaagaaagaaagagaaagaaagaaagaaagaaagaaagaaagaaagaaagaaagaaagaaagaaagaaagaaagaaagaaagaaga

SEQ ID NO: 42665 - DNA, 1784 bp, Homo sapiens
aataagagctgtgagaatatacacttacattctgaagccgttttatgcacggtccccaatgacctgctgaaattgaacagcgagctaaatatagaggtgggattcctgcattcctctcatgatgtaaataaggaagccagtgtaattatgttattctcaggcttaaaataaatcattaaagctcatttatgtgtgggttttggctcatcaactcagcctgcattcctagttgttattttagaaatagtgagctttttgccacattgtctccttccccaagcctgggaggtagatctcaaaagttctttctacccacactgcttctccatcacgccacactcttcccaaaatttgctgtaattctcagaagaaataaggatgcatccaagagtgtccttctactgcctcccaccaccccaggaggccagagccagtgttccactgccaaccactgtgatcactaatgcatagagtcccataaataaaggaagatgcatgcatcaaacaaagtaaaataaagattaaactactttacagtaacttttttcgtgtagacaactgaatcaaacaagctagaaccaaagcgagtgatctttttcattctttttttagcagctttattgtgatgtaattcacataccatgcaattcacccattgaaagtgcacagttcaatgggtttcagtatattatattgtcaatttctttgaattgaggtaaaatatacataatgtaatgtttgccattttgaccatttttaaatgtacaattaagttgcattaatttcattcacagtgttgtataaccatcagcattacctaattccagaactttttcgtcaccccaaacagatactctataaccaataagcagcagctccacatacccttctctcccccggctcctgataacttccaatctactctttctctctagaatttgcctattctagatatttcatgtgagtggaatcatacaatatttgtctttttatgtgtggcctattttacttaacataatgtttatccacgtggatgaacataagattcatccacgttgtagcctgtgtcggtacttcattcctttttgtggatgaataatattccattgtatatatcccacatttatccaagagtaagtgatttttaaagggttcctgaagtcttctgaagttataaaatggaaaaacacacaaaaattagaaaatcaaaggctgaatcatgagatcagagttggaatttcagaaggaccataaatcctaaaaatcataaaatgttagagccagaagggacttcaaagatttctgctgtgtatcaaaactgaagtaaaaatattctgagactttattgttccatcataacagtacaattatttacctcttatgggaagtcttctctgccctccaccccaccgtccaggacagaattaatgtcccattgtctctgttgattactgtttagtcatacttctatggtacataccacactgtactggaatcatttatttatatgtctgtctccccttctatacttcagttcctgttttttgtacatctttttatccctaatacctagttacaaatacaaacagctaagtaccacataagtacttaagggatcagtgtcccctaattatttgaacactggagcataattgaggaatctcttattatcctgaaggcagttatgccatttgtagaatggtaataaccagttggtatttgggacccaaagtgctacaacctgtgtagtacaaatatctatcatggctaaatgctgacttttc

SEQ ID NO: 42666 - DNA, 1038 bp, Homo sapiens
acgatgcaagagtacacactcctcatttggataggcttgtaagtgcccgaagtgtaagcccaactacagaaatggtttcaaatgaatctgtagactaccgagctacttttccagaaggtatatttcagtttattgttctgagaaatacctatacatatacctcagtgggttgtgacattgttgtttatttttggttttgcatttatatttttataaaaacctaaaggaagtatttacctctgccaagtaagtatttgacacaaaattacatggctcttaattttaaaagaacccatgtatatattacattatgattttagagtccataagctctcatttcacaaaaaggttaatttgagcaaaagtaatttgtttatcatctaagtgcaatagtaagaaattgcgaagctctcttttacaatccaggaagagttaagttacaaaatatacttatttaaatgtaagttggaactgctacattttttacctgttgaagcccaaacattgaaattatactgttagtaattcttcgaagtgttttcaatgaactgttagtacacagcctttttcccaccatattctaggacttgaatgtattttgagacttagccaaggaaaaccttcaattatgccatgaaaaaaaggaggggtcaatatcatcagctttgtaaaacactatgcctagtaatgttcaggttaatcagagttttcatgttgttttatttaaatctcctggtaaaagcaaaaggtctgtattgtatcagctccattatctttagaagttacaggatgtgagtcaagtacaagcatttccttggttgaatatttaccattggacaaataaaatgagtcacagatcattgaggatactggaaaagttagaagttgctcatccaaacaagttcaagagcaatgaagcacttaacattttaacattttcaacacttactacctcttatgttttgaagtttatgttatttctatggagatacacatagtaaacattgtctttgccctgattccattcacctttaaaaa

SEQ ID NO: 42667 - DNA, 1054 bp, Homo sapiens
tatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtatactgatagtggttattgccagtcatgcttgattacctgcatttgcataatgatagaggaagcctaagatggatttcacctggctgcatagagctcatccatgtaggagagccttagtcaagtgaatgctgaggaagtagtaaaacagcatgcatccccgaatctcaggaagtctctgtctttccaagggtttggtctaagttgctgattacctggatttttctgacgatctttcaactgctagagcatctggttcctgttttagcatggtgctcttctccagcaa

SEQ ID NO: 42668 - DNA, 1050 bp, Homo sapiens
tgagaacttgtaaaatttggaaaagaaaacttatttgtgacatgatttatatatttaggaataccaagagattctaataatataactcccaaccaaaaaaaaaaaagctattagaattaataaaagaatttggggagatgtctgaatttaaggtaaggatacaaaactcatgagttgtcctttattacagcaagtaaggacctgaaactagaaatggtgggggtcagagtgggccagggaattcaatttaaaatgatggtaaaagttacagattaggaataagcttcatcaaaaaaaggcatacgattatgaagaaaatagtgacggtcttctcaagcaacaaaagcaaaaactgacacatgggatataattaaagagcttctgcacagcaaaggatactatcaacagagtaaacagacaacctacagaatgggagacaaattttgcaaattatgcctctgacaaaggtttaaatccagcatctataaagaacttaaatttaaaagataaaaacaagcgcattaaaaagtgggcaaaggatatgaacagacacttttccaaagcagacatacttgaggccaaacaagcatatgagaaaaaagatcaccatcactgataattagaaaaatgcaaatcagaaccacaatgagataccatttcaaaccaatcagaatggctattattagaaagtcaaaaaataacagatgctggtgaggttacggagcaaaaggaatgcttatacactgttggtgggagtgtatattcaactattatagaagacagtgtggcgattcctcagagatctaaaaacggaattaccatttgacccagcaatcccattactggttatatacccaaaggaacagaaatcattctattataaagaaacatgctcacatatgttcattacagcactattcacaatagcaaagacgtggaatcaatctaaatatcagtgatgatagactaggtgaagaaaatgtggcatatatacaccatagaatactatgcagccgtgaaaaagaacaagctttatgtcctttgcaagaa

SEQ ID NO: 42669 - DNA, 1049 bp, Homo sapiens
agtttgaccagtagtgctagctattgcagaatacgcaaaatattcacaggttaagattaaaatagccgattaaatttttaaggtctagttagcattagaaattaatgtcaggtcattcacatttaagcagatgtattgagagagctgttctaggcgttgtggagtttggaaaatagaaaaccgtttcttaaagcaatctacaaactactcatggaacaacagtgttttcctacccttgtcacatcacaacatatgtagaaaatgatatttgtggctgggcacagtagctcacacttctaatcccagcacttcgggaggctgaggcaggtggatcctttcagtctaggagttcaagaccagcctaggcaacatggcaaaactctgtctctactaaaaatacaaaaattagccaggtgtggcgtacgcctgtagtcccagctactcaggagctgagctgggaggatcacctgagcctggacaggttgaggctgcagtcagctgtgatcgtgccactgcactctaacctgggtgatagagtgagaacctgtctgaaaatatacaaataaataaggcacactgcaggaaatggacaaggctgcatgctaattgttgtaagggttaagaagatcagtatcttggcacaccttaaacctgtttaggaagatgtgccatggacaacacagattgtttgtaagataaacttcaagccttacctaagatagcttttaaagagatgtcaagccaagggaggttttctggaaaggatgagttttaaactgctttggcaagtatgcatgccagtggtaggaaggaaatcctcttgtatctcagtgaagcattaatatgtagataataggtttctggtaaagaaatgtcatgggtcagaatgtcatccagttcaaaactaaatctgactttaaaacagcacagtacaaaatgaaattataacagtaacgttaagaatcagtgttcttataaactatagtatggctaataagatattttctctctggttttggtataatctaacaaaagagtattagttaacg

SEQ ID NO: 42670 - DNA, 1089 bp, Homo sapiens
gatcacttgaggtcaggagttggaaaccaccctgtccaacatggtgaaaccccgtctctactaaaagtacaaaaattagccgggtgtggtgatgggttcctgtaatcccagctacggaggttgcagtgagctgagattgcgccactgcactctagcctgggtgacagagcgagattccatctcaaaaaaaaaaaaaaaaagatatcataaatgttcttgaagaaatggtattttttaagtaatagcaatatcagaataattttagaaaaaacccttagaatccattcaataaaaataaaaatgtatttggctgggtgcagtgtctcatgcctgtaatcccagcactttgggaagccaaggtgggcagatcacttgagttcaggagtccgagaccagcctggccaacatggtgaaaccccgtctctactaaaaaataccaaaattatccaggcatggtggtgggtgcctgtaatccgagctacttgggagactgaggcagaagaatcgtgtgaactcgggaggcggaggttgcagtgagccaagatcgtgccactgcattccagcgtggacaacagagtgagactccatctcaagaaaaaaaaatatatatatacttcataaaaattaagattttctacatggcttaaaatgctctaaacaaagtcagaagacatcattcacaagggaaaacatttgcaacttacctaacaggtggttactttttcaaaaatctaatgagtacctacagcacaataacataagagtcctatagaaaattgaaaagcatgggccaggcgtggtagcttacacctctaatcccagcactttgggagactgaggtgggaggatcacttgagcccaggagttcacagtcagcctgggcaacactgtgaaactctcttgtgtctataaaaaaaaaaaaaaaaaaaaaagaaagaaagaaaattgaaaagcagtgcctatggcacctgagctcctgacattatggagagccttaccaaacttgaacttcctcactggacatttattgagaaataaacatatttaagccactgctctttggaatgtattttatttcttatcacccct

SEQ ID NO: 42671 - DNA, 1049 bp, Homo sapiens
acccttttcttagaggcactggagaacaagtaactattgcttcttgcagcacaatgttgtatgcctgtgattctctgtcctagtttacttaccacaggatgtaacaaattatccaaaataggatgtaaaattttcaaatcaataaaaaattaatgtatcacttgttactttcagaaataaaatggaggttaggaaatcaaaccccttgatgtatgtgataaagtgttacaaaatatcaaatgattcactttgctatttgtgagtttctatcactctttttttttttttttgccactaattgcaaaataactcatataaacctgggtttctcaagcaatgttctcctagatgtgtaggacgaaggctatattggtatgaataggtagtaattctgagcctgttctggaagaccccattcccctgcagagtttggtagggctcacatacccgcagtggtggtggccattaatgaccaattctgcctttgagtgctccacttgcgctactctcacttctggctcctggtgcttaggactgctgtcccctctccctgccttaccagttcctattgtggacattaaggagtgaatttggtcaggcagcttgtgcaggtcagtgtcccagaggcaggtctacagctctagcgggtccagtcccagtggacctttctgctaattgtgtccagcctttccattcttgaattactgacctgcgataaaaaatgatggcgcccttaccacattctagcaaaaaggtcaacagtcatttaccagttctgtgatcttaacactagttaccttgtttataactgagcatgataatgatgagtacctcataggactgttaggaggattaaatgagatactatgaaaaaagccttaaccagtgccagcacttgctagtgctcaatacattttagatatttacttgtagttactgttgtggctcctactataatattgactttgttttgtacttcttggtgtctaactcaatcagctttttctcttaagtcagtttctagactgatagttctttttaaatgcatc

SEQ ID NO: 42672 - DNA, 1044 bp, Homo sapiens
ctctgtaggttttctgtttccattcagttttggggtgaaatatgatagcagcatgaggagctccactcctggtctaaatgaataagcttatattatctctttcttaactttgctccttaactctttgtattctgttacctgctttcataattttcctggaacttcttaaacctcattggtaatttcaaagctaaatttcattaatcatttctcagattttgttcatactgattcgttgcactataaaaaaggatttaaattttttttctaatattcactttttttgttttgttttacaaattctcctccctatcccctcccctacttccctctctccctccctccctccctccctccctccctccctccctccttccttccttccttccttccttccttccttcctttcctccctccctccctccctccctccttcttccttcttcttccttctttttgcttcttcttgagacagtgtcttactatgttgaccgtgctggactcgaattcctgggctcaagcaatccttctgcctcaaccttctgattatttcgactacgggtgtgcgccaccatgcctggcttagaaaaggactttatgttgaacctcttttctcttacaatcaaataataaattcattgagtcatactattagcgagtcgcagtgcttggtgcgggtgtagaggaatggaatgatgaccaagacatggtccctgtcttcagtatcttgagatattgagcactcagggaaagaaaaatgggcacaaaactataatgcaaagtaaaatgtgtagagcacaaaggagaaataaataccaaaacaaggggatgagagaaagctttcaaatcatagtggtagttactggaataactttaggaattcccaggctgcttggagaatatgagaatgtgcatctgcttggtcccttcagaaaactgtcagtgtgacagatgggagggtgaaaaagagggaaaagctagaatctgttggggttaaattggagttcattttgaagcattaaaaataattgaaattctgatata

SEQ ID NO: 42673 - DNA, 1022 bp, Homo sapiens
actttctgcaataatggaaatgtcctgtaatacagtgtctgttgagctcatgtggctagtgtgactgaggaagtgaatatttaattttaattaatttaaatttagccatttatagctagtggctaccatattgaatagcacaggctttgagataactttaatacctttatgaggtatttaatacctttatgaggggagaaacaagtgaccaaaaagcaaagtgatctttgagactttgaagcagcttgttcgagagcctgtttagaggttaggcctatatcccacatcatctttatttgcatctccagttacttctgtagtctatcaaagtaattgcattattaggagaagctttttcagagctttgtgtgacttaagatcgcagggaaatacatatgaaggttgcgtggcagtactgccatgtggaaatgtgggtgtgggctttgccttgttgcaatgacttgttagtgctactggccataatacctgggaggccagggatattgactgtaatattatcctgcctaaaataccaataacaccctcattgagaagtattgctggatctttttgatggtaagagttattaaaatttagaaattccagaactcaaagaattatttcttctctgaaaaacccagacatctggtagacattctctgaagcttctggatgtttttctgtattgtagcctatggcattgtgaatctaagatgctttttgagcaccagacaattagtagaacattttaatgttgtggttggataacactgaaaaagccattgacatttgttttgagcagcagcagtgaaaccggcaccttatctcatgtgcacaaaaatccatgtagatgatttaaaaactgctgtgctgccgatgaagggaagaaagcaggaggtctaatcatcgtcaactgaaacctcacctaagtagtattcgcctgcctccactttaaaagacaaattaaactacttgtagtattatgtagaagaatgtatgtatttgtatatttccaaatttaa

SEQ ID NO: 42674 - DNA, 1046 bp, Homo sapiens
tagtggtccctagaacaggtgacccgagaagaacttctgacttaggtgaacgttatacgttttggagaggactatgatgtgattgtttgggaagggggcatctaggcatatcagcaagtctcacttgctgagagtgagatggagatagagaaaattctttgagaggtgggtggagggatctagttgaaggctctcctgttgagctttgaatttatagtcagtgtttatagagtctaggcaagtagtatctactgtgacatttggagaactgaaaagtagagtgggatttagtggttactgagtgtgccttgggtaggacaggtccttttatggttgtagctttctgcacttgagtacttatttctgctttactggctaatgccactctcattttaagctatcacaatgactaaacattatccctttcattctgattctctgttcaattttttcatatgttggaattgatcatagaatatagaaagaatttttatgaattcggaactgaactgtttggcccactgtagatttggttttattggaaagaacctagttttttgaaattttttttttttttttggcttccgtatgatcacctactctacacaggcagtattgtgtactggttaagcacaaggattctgagctagaggctactccagttgaatcctggctctgatcttagataagttgtttatcctccatgcctcagttcttcatctctaaaatggggataatacctcctagggtcgttttaagggttaaataggttaatacatgaattagaacaatgcctggtacacacaaagtgctatttacatattagctgttaatacattccaagcattgatctaggccttttgtcaatttataagtaaaccaaggctcagagaggtttaaaaacttgcttaatgaagataatctatctagtaagtaagtaaaccaaggctcagagaggtttaaaaacttgcttaattaagataatctatctagtatgtaagtaaaccaaggctcagagaggtttaaaaacttgcttaattaggata

SEQ ID NO: 42675 - DNA, 1045 bp, Homo sapiens
ttttggctatatttgatcctttcatatccctatgcatttttaaatttgcttgtcaatttctaaaaaaagacctgggattttgattgagagtatatttaatctataaagtaacttggggaggtttgacattttaacaatattaagttttgcaattcatgaacatggtatatttgtcatttaatttaggtctttaatttctctcacaatggtgaaaccagttataaaattaaaagaataggttatttttcattgatagaagaatacttatttggagtggaatgacttatattacccactgaatatatgtttctagggaacatatagtaaatgtaaaagtggtggtattagtaaagcatcattaatttgaatttggaggaattatttgcacttgtaaaaatcttaaataacctggaaagtgagatttcactaaacagatgttgtcatgaagaagtcttttgagggtatgtcttaacaaatagattagaattgtttatacatacaggcaaaaaacaaccccattgagaagtgggcaaaggacatgaacagacacttttcaaaagaagacatacatgcagccaacaagcatatgaaaaaatggtcaatatcactaatcattagagaaatgccaatcaaagccacaatgacataccatctcataccagtcagaatggccattattaaaaagtcaaaaataacagatgctggtgaggttgcagagaaaagggaacgcttatacactgctggtggaagtgtaaattagttcagccattgtggaaagcagtgtggcaactcctcgaagaaccaaaaacaggattaacattcaacccagcaaccccactactggatatatactcaaaggaatacaagtaattctaccataaagacacatgcatgcatatgttcactgcagtactattcataatatcaaagacatggaatcaacctaaatgtgcatcagaggtagactggataaagaaaatgtggtacatatacaccatggaatactatacagccataaaaaagaacaagatcatgtccttttcag

SEQ ID NO: 42676 - DNA, 1065 bp, Homo sapiens
aatacttttcataatactgaatttaacagccacagaatactttgttgtagtttgaaacatatttttttagctaatcctttatgagtggttacttaggttttctttttttgcatttttttctctataaatagatgtggcagacattcttcaggttaaatctttgcacgtaaccatgcttttttccttaggatacattcctggaactagaattggaggccaaaaggcttgccaaactttaagatacctgcttcctattaccaggttatgttggaaatttgtacttctttgctatatatttaaaaatattggctgggtatgatggctcatgtaatgtcagcactttgaaaggccaaggcaggaagattgcttgaggccaggagttcaagaccagcctgggcaacatagggaaaccctgtctctaccaaaaaataaaaaattagctgagcatggtctcatgtacctgtggtcccagccactcaggaggctgaggtgggaggatcacttgagcctgaaaggtcgaggctgcagtgagccctgatggcatcactgaactccagcctgggcgacagagtgagaccctgtctgtaaaagcaaaaaaaaaaaaaaaattttatccaaactctgaatttgtaaagacatggaagaatgcactaatatcatttgctttctgccttttatgtaggaaaaatacatctttttattttatttttaaaaatttatgttttttatgttaaggtggctgaaaacaaatccctcctctctacactgcacttcagtacttcccagtagggtgtgtagcacccttgcttaggctgagatcttggtaagtctgacttgaactcattctgggccagttatcccacatcttctgtagtcgcaaatcagactctcttgcctggccaagcatcttgcaaatcttggacaggtgtcccaagggaaataatctgtcatggaagctagaagagcccaagaagagccatcatgcttgcacatgaaaacagttcattgtaagaaattcagtcaggtaggatttggatgttattaatcatcataaaatcttacatt

SEQ ID NO: 42677 - DNA, 1072 bp, Homo sapiens
aatgagacctgtaaaaaaggcagaataaaatcagtaataacaactgaataataacaactgaagaaatcaatagactatttaaccacatctgtaggcctctacacaatctagtactgtggagtattaaatgaatgagatagatttagaaataaaaaaccattcatggtatattaaggaaaattcaaatcatagtatattacataatatgttagtgaaaggaactttgggacatggtagtgtagaactctgttcagatgaatgacacaaacaccttaggcatactttatagggacagatatactttgtttgccttttgttttcatccatctatcctgaggaaggtccacaattattgaataataactgcctaaagtggtaacatgtctctggtactcctgaaaagaggcagcttgttgtggagggcagtgtgagtggttagggccacaaactttggatcccaactacccgggtttaactctttcttctactgccactactcgtatgactcaagtccttaacttctctatacctgttaccccatctgtaaaagggggacagtagtagtacatacctcagagggtagttatgagaattaataataatattttagaaatctgtggaaaagtatctggcctataattagccctataaatgtttgttaagcaaatacacaaataaaatacatactttcccagcttccaggaatcaggaactaacttagacttttcttttcatctcacgtggatattgttctcgtggaatgttgaacatttcttgaagtattgttttaagcactgtggaaaaaataatagttaaaattgttagcagatcatggaattggatttttgacctcaatccttttgaaattaagaaaaaaattacactagtcactttaaactggttgttctatatgtttgtgctctaacaatatagaaactagatattgttatatgatttcctagatacagttaatctaggctgggcatggtagctcacacctgtaatcccagcacgttgggaggccaaggcgggtggatcacttgaggccaggagttcgagaccagcctggcca

SEQ ID NO: 42678 - DNA, 1025 bp, Homo sapiens
cttggagaaaaagggtatgatgacttcccaggatgctttaaatttctttcttgtttttagctgacctcactctaggaagagaaaataaattatattagttattttatttccaaataaaagcaaaaattataacttgaaaatataaaagggtattacctcaaatgttgattaaaacaatagttatatgactagaataaaatttggactttaacatgtagaaactgtaatagctactgtttagtgtgctcatagtaggtacctaacatggccctaagaacttcttctcattcttattaatctttattaaggccaggataataatatatgcatggcaggtctgaatgcttcaattttaaatgcttctcaaattattcatctttttgatgttttagatccaggaaacctttggatgcctccccacaatttattaaattttttcaatgtgttaatcatttcctttattatttttatagaaattattttaagtgtgatttggcacgacctgtagcagaaattttaatcatttcattcatctttttactatcatagtttatctgagacataatgatttttatgacttcaatgacacctgaaatgaaaccagtactctaaagtagtttttgtttaacatgatttgattcttttagaatttatgttttgccagagtgaatgaggaattcagatataatagtgactgtacagtaatgagtttcatttctagctagctatttttatccaaggaattggtattctctaaaatgacaattgtaaaagatgactaaaattatttttgaaacatttttagacttgatataccagggttccactagagaaacagaatcagtaggctacacacacatacactgagacagacagagagaaatagagattgagagagagagagagagagaggcaatgagttgggttccaggattttgggggctggctaggcaagtctgaaatgggtagggtgggccattaatcaggaagggcaggctggaactcttgtgtctaagctgaagcgg

SEQ ID NO: 42679 - DNA, 1003 bp, Homo sapiens
tgtatttttagtagagacggggtttcaccatattggccaggctggtcttgaactcctgaccttgtgatcctcccgcctcggcctcccaaagtgctgggattacaggcatgagccaccgcacccggcctcaacagttttttaaaaaactttcttgcatgctaacacagtactgtagtttacattcattttgatgacttagagttaccagtcaaagattgaaatatgttctggccattctttttaagggtgaagtcaagtatgtaatgcattttggaaagattccgttgtgaaattgtttttaaaagtgtctggtttaataggataaaaccttaactatcccacatgactaatttctgagggttctacatagccatagtcttgctatatgaggataatataagtatatctgggaccatcttgatttattaatgtgtagtagtcattgagtcttcctaatatggacttcagactgtacaggtagtctaaggatagaaacacacacacacacacagacacacacacacacacacacacacggcaaagtcccagccatcaaagacttgtagttttgtcagatttatattttcttatgaaggttattatcagaagtcctgggaaatggttgttataactttcctacctagaactctgccccttgtagtcatttagcgtttatcaaacattgagtactgtgtggaccaggctctgtgctgggtgctctgtgttggctgatggaggattgagacacagtgtgtgtgcttgtagggaagaggttcccagagcctggagcaccttgtcttagcaaagtttctatttctcttcaatgtaactatgtggaaggtttgctttgtgtacaaatagacatttattttttcttcctggtattaaatagtttatgagaaacagacaaacttgtaaaatagtcttcaatcataaatgaaagcatattttaaataattaaaaatataataagacttacttaggtctttcctctgttcttgac

SEQ ID NO: 42680 - DNA, 1049 bp, Homo sapiens
ttttccaattaatgccctcactttaacagtagatacctggtgagcctgagcatgtacctatcattgcaggtcagccactcacataagagcttgtgtctgattttccacaatttccagctctttctctacaagagatgagactctcactaagggcactcttagaagattcgaagctcagtatgtgcttctggagccaggagttagaatccctgagttcgttgttttcatcaccttgtccagtgaacttaggagcaaccaaccaacttcattatattccttggttctccacatatggtcaaaggtattatgtgtagagttgctaaactctttgcctctcaagagtggtgaatcaggagtatcaaatgcatttattttgcataactctctaaacagttcacgccaaggactgtcagtgttctccatactattagaagtagagtccttagcatttttgggtctaattatattaagcagccaactccagaaaccccaaaaccaactaaagaaatctatcctcaaaattctgtttctctagaactacttctggtactaaaaatctgttttggataaatgaaaatccaactagaaagcccaatgctggctgcaaagaccaacccaagttgaggtgaagcatattaaacttcctccttaaaatgggttgaaataaggtatatgcgataatttataccatgtcgcctcttaaatactaatctgttcacctgtatgtgtctctgaagttttccctgttctttagagatatgagaaaaataaagaccctgtagaaagtggctccataaagctataaagctggtcactaatttattccatgtaaggactgtattttattctgagattgtgtccttcttactttttaacgttaaaattttcttctgaaatgatggtgatagtgtatggtagtgttattttactattattactttgcaaagaagaatatagcagcagccccacattggtcttcacatttgtcggggcgggggcaggaactcttggcttcagagaacaatcacctcaaaaatttacttctactt

SEQ ID NO: 42681 - DNA, 1034 bp, Homo sapiens
aggaagttctgggaaggatcagcatgggaggtgatttagatagtgagtgaagatgagattatggaggaaaaagtgagtagagtaaaaaagaagaggagggagaagtgcaggatcaatcagtcaaaggatacttaaaagaagtggccagagaagtaggaaaaaagtttaggacactgttgtgtcatgaaatccatagcaacagaacatcttagagggaggaaatggtcaacagtattaaatgctacagagaaaaatgtatatatgatctgagcaattcttagtccagtacttgtcacacaattactcagtaaatatttgttgtggagaaaactatttgttaccttttacttcaaagaggtggttggcaatttggcaaaagcaagatcagtagaatgtaaagtgtataaaatagattcaattgtgttatctcccgaatgtgaggtaagatgtctactggagtagtagaactcttgcaataagcttagatggaaaaggaaaagagaggtgatgatacctagaagggaacctgtaagcagtagaagacctgagcatgtgccagtgtggatgggaaaatactgaaaagcaagggagaaattaaacatgcatatgaaagagaggggatcactgatagaatgaagtcctgaggagtgcagcgtgatgaattacagagcataggaggggaggattaactaaaggagtactacggaatgaatgtttgtattctccccaaattcatatgccaaagctcctctccccactgtgatggcatctaaagacggtgccgtttgggagctaattaggtcatgagggtagagcccttacagataagaccagtgcccttataagaaaagacaggagaggatctgtttgtgccatgtaaggatacagcaagaaggtgctcctctgcaaaccaggaagagggccctcaccggaagccaaatctgccaggacctggatcttggacctcccagcctccagaactgtgagaaatagatttctgttgtttaagatgcacagtctgtgacattctgtga

SEQ ID NO: 42682 - DNA, 1035 bp, Homo sapiens
gaactctcgtgggcctctgaggactctggtaaacaattcattcttctgttcatggcccttagtgtcagtaaaaattactggcaaaataataaccatgcattatacagtgtcttttctattttctatttatgcctttatttgaaactataattaaataatgtcaaacttgcaactataacaaaatagtatctgctctttgaatatgatacaggccaaattctataaactttaattagcccaagcttgtattgacctcagtaggaatctggctggctgaggatctcttttagttacctctgccttaaagtatgtaagaattttcccattgcctttctcactcaaggaacaatacatgcatagctgaactaataaaatgcttaaatagatacaaatcaaacttgaaaggtttaaactgttgttttcatcctgtaagtcagctgagaaaaagcatacagaccgtagttctaaattatgtccatagagtatttcaaatccagtgaattaactctgcctttttttcccatttgagctcataaatgttaacctcagaagtgcctcagattcttccattgaaataaacttgaactgacaatagccagatgatgtaaaattgaaactgaaattctatccttggcccatcccatgttcttccccataggtattagaggactcacaggagagttagcgttttcactctatttgagctgtaatatttgggcaaaacagggcatataaatttcttgctgccaggagaaagcaattaccagtgtggagaagatagcgggcaataaataaacagaactatgctagatagtgagcatgtttaaagatttatttagaatgacttagctgatagaaaacaggcctttatcatatgctttcattcaaagcttgatatggggactgtggtctttttgtaatagaaaggctaattatgttaccaagtatttatttggtacattattttaaaataaataaatcgagttatgttctattgtgcaactaaaaaatgaaaactattcacatatagcatag

SEQ ID NO: 42683 - DNA, 1029 bp, Homo sapiens
tgtgataaccatttttattattggtttcttttgaatgttaatgtgccaagcacagtgctagctgaagtatataagccctctcacttatttttcataacaactctgtgaggtgtattatattattatccctattacatagatgagggcactgacggtttggagaggttaaataatctgctcatggtcatacagcaaataaatgacagagccagaaccaattctgggttatctactcttaaatgttgccctctactgcctaccacaccccaccaggaaacagaccagcctaggcttggactcttcaaatgctggcaggcacactgcttcctaagacattcaatcccttaaggacaattcaggtttcttcaggatatcttaaatgatgtgacttccatggcttctttttctctatcacaggaatttgtcagtggcccaccacaggaatttttagtatctacatgctgtattgcataattgtcatcttctctgagggagaaaaaaataccaaatataataactgagaactgacttccttgcatttccagcttcgcttcatctggtatcccattaagcaaagatagataggtagtatttcaccatccaatgataaatactagtcatttaccttcggagggctactcttaggaactctcttcacttgcagacataaggagtagggaggaagtgttgctccttactacatcacaggactgggaaataaataagaacagtaaaaaccccttgtctctgttctgaagcagagccacttaagtggtcagatggatgcgaaacactagaatttctgaagtattagattgcagcaaactagtaaagaggaagcaaacacataggctcatcattaccaacagaattgtcactccctcctgagaaactgtagctgtgccgccagctcccataggaaaaggcataaactccttgtgagattcttcagtacccttcataatctgacccaacttgtttttcattttttccacttcataactatttgttcatcattccagaaacatt

SEQ ID NO: 42684 - DNA, 1024 bp, Homo sapiens
tttagtcaggattatttccttagggtagatttaaagaatgggaattactaagtcatgtgtagaagcacttaaggctcttgatattgcggaactacttgccaaaaaagattatagcagtttaaatcagcagacaactccttcttcactattttatcatatcctcactgtcattgagcagtttgtttaaaaaagaaagaaggggagcaataaatatttatgaacctattaagtacaaatggaattttgttcttttagtctgcatttctttgccactactagtttggtagaacattgttagccatttgtatttattcctttctgaattgtgaggcaaaacattataacaacagagcaaggaataatgacctaaaggtaaggagagctatgaagtatcattgaaagggttcatcacgcctgtaattccagcattttgggaggctgaggcaggaagatcgcttgagtctaggagtttgagaccagcctggcaacgtagtgagacctaatctccacaaacaaacaaaaaaattagctgggtgtggtggcatactctacttgggaggctgagccagaaggtcaagactgcagtgagccatgattgtgctgctgcaccacagcctgggtgacagaaagagactttgtctctaaaaaagagaaaagctcaaaagtgttcagaacaatgactcccgttacttcctgtccacaggactggaataaagtatgggaggagggagttaattagtttcctgcccattcttgttttgataaaatgaggataaaagtaatggcttcacaggactgatgacaggtaaatgaaattacatcgtgtaattcattcagtacctgctcagtacatgttggccccttcgttatctcttcctttttacctcccgttctatttctgtgcttgcaggctaggtggaaatagaggctgcctagaaacatgcattaacaggtgcttcttgggccaccctagcctgaagaaggacaaccagagagtataacagtggcacctcaatgccttggc

SEQ ID NO: 42685 - DNA, 1040 bp, Homo sapiens
acagatgaagagacagggacacagattaacgacccacgcaaagtcatacgctagtgagcctaggcaggtcctgctcatcctttagatgccactttggccgcttctccattatgtacacacagcaccatgactcccttggaggtattcatcaccgtgggaacctttgctcttactttcatgattggatcctgcttctggcacttggtggtgagctccatgagggcaggggcagtgtgtgctgggctcacctttgtgtgcttgtcacataagaagccactcaccttttgtcaagcaactgattataagaagtagagctgggattcaaactcggttccctctgttacaaataatctgtataaaattatctaagatactctaagattgattacattctatccttgcctatctagtaggtagagtaagaagaggtcattagaagtcattgggaaaatcaggaattaacttgttcatgtatccatccttttgtcatttctttggttctgtttatttttccccccagtatcaattgagaatctctgacgggaacagcactgatagacttggaacctagaaaatgtgtctggtcagggatagaagaagacagcattgtgccacagacttgattgtgaaggcatgatctgttctttcactaattctcagtttcattttgacccttcagcaaattcacaaccaaaatcaaggtaggggaagggatggcacacagaggaaagtgcagaaatatcatttatataccatgtattcactctgagtggcctaacttttttgttttgtttttaacccaatacatgtgtatttttaattcctctgaaatttgtgttttcttaaggatttttaggtctgtattcattcataaaatagatctgttcaaatgacctttttctattcttattagcaccaccaaatcagtgtgtttttaatacttagattcgcaaaatttctggacatttggcaaaaggcacaaggctgtcatggagcagttgcatgtcttagcagtgaaagggaccaggaggtgggaggtg

SEQ ID NO: 42686 - DNA, 1025 bp, Homo sapiens
acctctaatctctaatgcctagacagcacattacacccgtagtgcaattttattataattcagctctttatcactttgctgtcaatccatgttttcctcactaataaacattgtgtgttacctacaaggtttctcggagctagaataatagattctgccctcagagagctcctagtctgtagacctttattaaacttacttttcttcttccatttttatttccttccccattcagcaccacatgaatcagaatttttttgaaattttgcatatgcttagtaactttttaatgatttagatactattaatatctagataacatttaaggcttgtatacaatcttaatattctttgtttttaggttgtgtgacatgtcttctgtaggacacattatgatgattgactctctatatatacacatatatatgtaaaattggcttgttccttgaagttgtttctcccttgctaatttatgtcatataactaagataaaacgttcctatagtgatacttgtatttggaatttgatctgaggaattcatctcaagatttttgggtacttggttatttcttcacttacaattcatactttgaatgctttcaaaagaattttaaggctactgaactttctctattttctaaccttacctagtttctttaaataatttgatcccttatttttccattcttcagttttgcttttgttcattttctttttaagccttgtgattttttttcactgggtccttagtgactattattagtcaaagttctagctttgtcctttactaaatttatatcatgtgccaggtgcatatatgttacattatttaatgtacagtaaaaacttatgaagaataagtacccctgtattctagattaggaaacaagttcagagaaggtgactcactttctcagagtcacaagggtagcaagtgacagaaccaaactgggatttaaatttggtttgacatcaaagccaaggccagttgcctggcttctttcttaaggaagcaatgatgttt

SEQ ID NO: 42687 - DNA, 2758 bp, Homo sapiens
aaaaatgatttgttagataccaaagtacttgttcctactattatttttgtatatgaagaactggctttggatttaactgaaaacttaggaaaacaatctaatcgctgttgtctatatcattgatttaattcatcaaagttactcaaatgattgatatttttacttgctaattattttaggagtgattttgtgaaatttatttttaatacagtcctagaattgaattgaaatatggtttggaagtttgagggttttttactgtgtctatccttgtgtgtctgtttcctttaaagattcatgatacaatcactgtgtacaatgtgtcctttaatattggttcctgtaataatgtgccttcaaattatttcttgagttttgtgacttaaatatgcagttcactgactcacgccaatgttgtttgctttttaccttaattctttttactgtgctctctcagttttattttttggaagaatggtactcagtgctttgatttgattagtaagatttttgaaacacatgtaatttatttcagaaatgtgattgttttaactctgacttttttagtgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgagtgtgtcactggattttgactccttattgattcattgtaatatgtaaattaaaatatttctacattttattgaaaaaaaaacctttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagtttgtattgaagtagtgctagctattattgtcagcaattttccatgattcattatccataaacctgatttcagaagacgtcaactcagttttttaaataattgaaagaaacaatgtaagtagtgtttagatattcaggctagtccataaaatttctgatcaactcatgtataggcccaagtgtgtgtctttgtgatgagaagaacatagaaaaatatttacatccttgtaattgaaacaaatttaaatagtttatttgttttgtttttatgaaagtgcttaaaaatagtagttggcaagctttttctatgaagatccagatagtcttttaggctttgaaggccatgtggtctgtcacagctactcacctctgctattgtggcctacaaataaccatagataatacataaatgaatagtggctgtcttccagtaaaacttcatttataaaaatggaggtgggggttggattgggcttgaaggcatagttgctgacccttggcttaatacaagttcaataagaaaaaatgaacaatttgtataaattctggaatagatccttatagagagtttagaggtgggtttcattcatattttaaaatattttaaacttcatacttattaaacataatagctttttgggggaggaaaatatcttcactcaaatcagccttataaggggagaagcactattctctagaattatttggttgatgttaagggctgtctctgggagaattagagaagttagctagtattggctattcataagtacttgacttgtagtataatgttttataatcaatttattaataaaatgatggaaagtgggtaaggcaaacaggcaaatttagggactgtgaatgaaatattgtagtatatggcattttgaattggtaaagtaattccaaaaattaaataagaatacacattgttcagttgctaagaaaaatgcattctaacagtacaaatgaagtccagagtcagatcttttctcaaaatacttggcatatcaacacattacacataaacaaataaaaaccagtcctgtccctcatgataatgggtttctaatgtgatgtattcttgcaatctgaaacaccttataaagctgtattttcctgattgatgttggaaaaagcattcccaaaatgtgaattattgtttttatgaatagttacagaggatgtgatgacaatatgccagataatctatgtaattctttattcctggatacaagcacatggtggactgttttctcacaaccgattaaaattggatttattttt

SEQ ID NO: 42688 - DNA, 1024 bp, Homo sapiens
ctcatctctatgctattggctcgtagttatacatatctgtcccagaccattcttatgaatttcaaacaataatttccagctatatgtcatcaggaaatattatacccttggcttttctggacaatcagtggaagcaatagccatatggagaatatttccaaatctaatggaacccctaccattagacatagaatattgtctagctggcatattattcaatatcctgtacattaagagctacacatatatggaaatatatatatatgcttttttttcttgcatgccaactttattaaaatttggatgcttcctgatgtggctaatgagaagaattctcaggcatatacagggtcaccagtaatgggtgccatgaccaattagtgctgttatccgtaggttggggatagaagaaaattttcttacctgacataagcaaaatctcagtggcagaaaaatgaagagtgtattctgggcacagtaagtagatttatttggcactcatatcttttgaatattgactgaacaaaaatctgaaatcagttgtcactttttgaatcttaataaattctgctatgaatggatttgaaagtaatcattgtggcacaagtaatccatttataaattatatttgctcatgtatttgtattttatctatgtgatttgcccatcataagtgctcaataaatactggtgtaaatgaaataaaaatgaaaaaattatctttatgcatagaaatttgattcatttatgaagatggaaatataattttagcaggaagatggaacagattgtcttagatggtatttgaactttattttatggtcttaacacttgagctccccaaaaatctgtgatatttgacatggcattactttatgtctgtagtactgtactctgtaactatcttttgccatcattaagattattatttattaataatctgaaaaattggtgtatattaggtgttgaatagaatttaacaacttgaacacaattgtttagcagaaacaaacaaatatgatgt

SEQ ID NO: 42689 - DNA, 1029 bp, Homo sapiens
cctttcaacctgtacctatcttaggaccaaagccagattttcagaatgaatcactaattcagtgaacttgagtagattttagagattacctgtctaatgctctcattttatatatggacaaaatgaaatatataaatgtgaaatgatctctacaaggtcacacaacatttagagacagagatggaactaaaagcaaaatattagaacctcagtttcatccctatcctttacacttcactttgttacctgtactacattatacaattcaaagttctattgctaataaattttactttgtttggcagacagttgttataaaaaaaaaggtgagagatggatattacaagtcaaaatgactagaaaaactgtcttgtcagtaacatttccatagattacagaaaagaaaggtgaaataattactttatgaagagagacactgcagaatttgagaaagagtagattatgagttttgtttctagagatacacaaccaaagttacctataattgtgaaagtggtctgtgtctacatattatgaaacaacaaattggctatctttggccatagaagtacagaaatgtattttcagacagagctattatttctcttttttgaaagaagagatctaagaagttaaagataaaatcattaaatacctgtctttgaaaaactgtatagcatatatgctttctcctaaagtatcatcttaaatcatgtttagcctccaaagtaatatttagaaaataagttagtttatcctcaatattctgccaaagacaaaatttttacttcagcaggatttggggaagtgcatttcccaacttcatgctctctttggacattccaacatttaaaactattctcaagaatgttcatccagagcagcagaagacaaattaaatctttgctctcctaatcatccttatgtgggtgaaagagagaatgtatctctctactctcattctgaatgtgtatacatatctttcttctgtttgtcaatgtatcctttaaaataatgacagcacaagtg

SEQ ID NO: 42690 - DNA, 1028 bp, Homo sapiens
aattatttttaacagtaagtgaagaaaaactcaaatagagataaaatcacagagttaaggtttcaagtggcctaggcattgtacttgtttctttattatcacaaacaattgccttgaattatattggtccatacaatttgttgactcaaatgttgttttcagttgttactgattagagatacatgccctggatataatcattttggttttctcattaaaaagtcatattggtcttgttcaaataagtgtgggacaggagaaaactgccttgtaggtgggtatatctaaaataaattttgtccatggccaattatcagctgtgtaaatgataagttgtttaacttctctgagacttagtttcttcacctgaataaagcaaataaaggattcttgtttaacaaattaacttgaacacatctctaccccctttctgagtttcttattaaactaaaagcaaatgaattttgaactgtacaaacctacaaggaaaaagagacttagggacagaagataacagcaaatgaatgtttattataagatttttaagaaatggcctgggaaatatatgggcagtggcaaatgactcagtggattagaaaagccaagaagacctaagtgctttttacaaggaacacaaaacaggacaccaaaggctcaataagtggagatatttggtattttggaagacatgagtgggtaatgacttaaaggtcgttatagggaagagctagaccttgcgatcccactgactcacctctgcatccacgcaatcgctcttcgcagattctggcaaaagttaagatgtttattctttgggaaaatccaagaaaacctttgaaggaagagaacagaggtgacgcaccatactgaaaataagagtatttacagaaggcatacttaatattttgtgtgtgactggatgtatctctagaataaaagaaagcaatgtgcatgagaatgagtttctctggtaaatagtttaaatataatagaaaacatatatatatatatatatatatacacacaca

SEQ ID NO: 42691 - DNA, 1085 bp, Homo sapiens
gttgcttttcctagttgaaaattgaggaattttgttcaataaaatgagggctaatatatctttttctggtcattttgtcttttctgaactgacacttgcttcctcaagatttttttgacaatgagggaactattcttagctccagaatttgcggtgatttgataaaattctttcaaactacccttaaattggatattttaggtaccaaatagttgagttagtctaggcagtgaaggaagtactttctgctattatccatatgattaagagttttaaagagtgcagtgaatttcttaatttagacaaatgtggagaatgcttgctgattgtgctgcaaatttgtccaggactcatgttgtttaattattcatgactttaaaagtagcatacattacaattttgcatctgtagattattaatagaatgctcttttaataggatgttcaccactgagaagtgtttgtcatttgttagtttgctttgttttgctgtaaataaaaaaaaggtctatagaggatgtatagaataatcaatccaatgtctagattgacactacctgggttgaaaactcagctccccattcactagatatgtgaaccttaggtaagcttcttaaactttttttctgtcagtttcttcctctctaaaatgaaggtagtaaaatacctactgtaggtgaacgtagtgaggaaaaaaaatgaactaatctatcttaaatactcaagtgcctggcgcataataaaaaaagtaggctgggcgtggtggctcacgcctgtaatcccagcactttgggaggctgaagcaggtgaatcacctgaggtcaggagtttaagaccagcctgcccaacatggcaaaaccctgtctctactaaaaatacaaaaaattagatgggcatggtggcaggcacctgtaatcccagctacttgggaggctgaggtaggagaatcgcttgaacctgggaggtggaggtttcagtgagctgagattgtgccactgcactccagcctgggtgacaagagcaaaactctgtctcaaaaaaaaaaaaaaaaaaaaaaaaaagttagctaacattactcttctcaat

SEQ ID NO: 42692 - DNA, 1742 bp, Homo sapiens
gctgttgaaaacacagagcagagggaagggaaggggatcaggttgcatttttaaattaggtggtcaaaattggcctcagtgagaaagtggcatctgagcaaagacttgaagtttaggggaatatctaagcagatatctggaggacaacactcttaaggactagtggcagtgcaagccttcaaagcatgtgtatatctggtatgttcactgtataataaagaggacaggtggctaaaggtaagtgaatgagggagccattaggtcagaaagggagtggagcctaatcatattcactgtagtgtttcacaggtgcttgtaatcacttgacttttacactgagatgaagaactagtaggggatttagagcagaagagagacttacattacacaaggatcactgtacctactgggttcaaaaacagtttgcacatagaagaaagaaaaccagtttagaaaggaatatagtaatccacgtaagtgataactgtgacttggtatcagggtggtatcaatagaaattttgagaaataactgggaattctgcatatatgtaaagatattacaataggatttccaacaaattggatgtgtatatgagagaagggaaagatctgaaatgaagccagcatgtttgtttcatcaactgagcggatgctattgccatccacctatgtgagaaatgagaaagaatcttagtggagtaagtttgtagggggcaaaggaaacgaaaacttcagttttgggcatgctagttttgaaatatctatttgacatctcaatgaaatgtcaggtaggcagggataataacgtggttagaagagaacaattagtgtggcgtcatggaagccaataaagaaagtatatcaaggacaatggacttgatgttgataagccaagtatggtaagaattgaaaagatggccatttgatttggcaatccagagttcattggtgatcttgacaaggatgcttttgttgtaattatcagaggaaacacctgattggaaaggattacaaattgtaagaggatggaactagtgttactagcaatggtcaacactctctagctattttgttgtaaaagggagaagacaactggaattaaaactaatgggcaaaatgtggtttaaagcaggattatgtttcagattggagaagaataacatttttgttttgctggtggtgattactatgactacataaggaaaaaatagtgacgcaaagaaaaagaagtaattccaatgtgtagttttaaataggtgaaatgaattgtatttgtgcataagggaaggttttactgaggagagaatatttttatctcaagaaacttgatagagaacagagtatatgagtttggttgtgggtacatatatgaggctgtgagactttctgaagcttctccctggttacttcaattttatcagtggaaaaagaagcaaagtcatgaactgagagcattagggtggaggtgttcagaagaaaggaaaaactgtgaaatagttctccaagatagtggagagtacatggactggttaaatatattatattgtgggcagctgtaggagtcctctaacaatttgtcaaattgaatttaaagtgagatcattaagacctgtgtgtttctctgtgcatctttaattgcacaggtgcaggtgttgaagaaacagtgagttagatttatgtagggctgtaattttgcctaatgaaagatgttaaggggccttgaaaaatatgcgggatcaa

SEQ ID NO: 42693 - DNA, 1043 bp, Homo sapiens
atcgaatccatctttgttttctctaatcttgtatagtaaggagcatttaaagtgttatagtttagaggcaagagctcctggaatatcaaataacacatttagatgagaaaaagttattagaaaggacaaaccagtctcgatgggagtatgaattgtgtgattcctatgtgttaaccttgaattgagggagggcacctaattttttatgccaaccccatatgactaatgctctaatggaaaactactgagatgtaatatactccctgagcataaggaatgctatccctggtgattatataattacaacattttttacaaagtcatgaaataatgtgtgctcccctaggtatgcctttaacatcatgtaaactatagttacactgctgagagtgtagctactataaggataatagcaaatgttaggttctttataaacataaaatctggagacattgtaacaggaatgctaaatcataaataaatactttgaatgatcatatgtccggcagtagtatatcatgttaggtgagaaatgatgtgatcataaaattgaaatcctgtaaccatgatttaattgaaacgtgattaatcagggtaaaggggcccagtctggcccactgttggggtataatcacatgtagaatttggggaagccataatattagataagtcaagaaataacatagtaaaatgggagcatgaaaacaaccacaatttccatttcctcatcatttcttgctattggcaacttcttggatttttttatccaggatgaactaaggatctatttcacagaaattcttagtagcactctcattctctctatatcgttattatttttcttttaccatactctccagactaatcgcaagctccatgtgaatccagtctttctctctcttgtcttattatttccaggctggttagcgttactggggttgcgggagtgacaagctatgtgaccatgtgcataggtattattaaaaagttagacttccaggctgagctgtgcttttcagtactgctttgcaatccttttgttt

SEQ ID NO: 42694 - DNA, 1041 bp, Homo sapiens
tgagatgtctcctgagccgaagtgtcatttgtaggtatggacagcaagaatgcaaggttaggcagaaagttaagaccaaggatcatgtcagacagtagcaatctagcaggttttttactgggtcaggacctgaggaactaagaaggctgtaaggccatgtatacataggtcagtgtatcagcaagagctccgttttctcttttcagtccctattcagggaggacagaagaggcagaaatgtatttatgtttattacagccaatggtttagtcaatgccctgaacaagcctgcgtgcccctgattaaggtaagggcagaggtgctggacctatggggaatgaatgcagaaataagaaaatattgagatgtcaatcgtacaattactaaatactttttgacgtgcatggttaaggttataggaaagaaggaaactgaaagatgcacctacaggaaaagataaatgagattttcgagcaaaatgtacatgttctaaatagaagctctatggatagtgttaatgtaaagttctataagtaagtgaaatggatgttcaggtaagtaattaaaacaacataaatataactgaaaaatgttgaaactgtacaatttacataagaataaaatgagatatttaatagacatttaaaaatattattacaaactttagttaaaatgttcagattgagaaaaaactttgagggggtggataactgtgccctttatcagcaattttagacaattgttaattatagtagagatgattccagttagtaaacagcattgtggtgaatcacagagtcccatgaaaagtaagctttatcttgatagaagagagtcattgagttatgataactaaatacaagcagggtagtgtgtataggaaacattaagctaagagttaaagaaattttggctgggcacagtggcttacacctgtaacaccagcactttgggagtccaaggcagacatatcacttgaggtgaggagttcgagaccagcttggccaacatggtgaaaccctgtctctattgaaaatacaa

SEQ ID NO: 42695 - DNA, 1079 bp, Homo sapiens
tacatatatcacattacatactatgttaaacggtaagtactgtgacaaaaatgaaaaagcaaatgtagatgtgagtcataggggccagagtatatatggtggatggggaagagacttgcaatgaaaacaaaacaacacaaaaggatggtctgtttgccttcctatgaagatgacatgtggataaagatgtgaagaaggtgaggaacttggcagtggggattcctgaaagaagatcattccaggcagaggactgagctagagcaatggtcctaaagtaaaagcatttcctggagtgtttaaggacaaactgagcagggagaatagctccctggagtataaagtaagcagaggaggaatagcaagagaggaaatcagaaagggacaggggaggcgtggccagatgcagatcctggagggcacaattggctgatgttcttacactgagataaatgggaagctactgcaaagttttgggcataagtgatgtcttctgacttatttgcaatcaggacgcattttgaatgtagagtcaacagaattttctaatggattagtattgaattcagacagacacaaaagtacatgtgttacctacagaagccatggacaccttggcaaataacattcatagcaaataataatagtgatattaatggtaaataatgacatccatattattgccattgccagatactctctattttacatgagagagtaaacactcaaaacatcctgtaaaggattagttattattattctcattttacaaaagaagctgcaaagcacagaaaaatcagttccttgtccaagataacagcggaaaagggacagagttggatttaaatcttggtgttagagaatatgtgctcataatctgtactgttcatattttgaaacaaagattataccagagctccaaacagggaaaggtaacaaatacctcttatttagaatcaattttcttttgcttctttacaaggaaaaaaataacagagctggtaagtgttgacagtgctgaaggtgagtgattttattactccagataggttagcttatgctgtgggaacaaccagtctgtc

SEQ ID NO: 42696 - DNA, 1050 bp, Homo sapiens
gttttgctagagattctccagtgtgcaaggcattcactcgaatttctctttaaactccattcctcgacactgctccacttctcttatagatctagaagtggtataaatcaagttgatctgaaaatgaaaaaaaaatgcagaattctctcataaacggtttcaaaatttaatattacagctgttagttcactgggcaatgagcaaagtttgcttttttaaaaatctgaattcattttatttactctgcaaataatttacttcaatacatttaaaaactcaagttttgttttgtttttgattttaaagacaaaaacattctcatagttttcagacctagaaaaacaaactttgtattgtattgtaatgattttcagttttttataaagaactacctgttttattaaattgtaggccctttatgtaacaaatctcctttcttttcctttatttgaaatgataactctagaactttcacacaaataatcaaaactgtgaatagaaattcgtctttttgtttaactatgaacttctttcttacctgataggtttctttttccaaagaggaacaggactgctaaatttagtactgtcaaatactccaggatcaaagctctctgctaagtccccagaatggaatagctgccaccagcctttcaactacaagtctttatgaatctggactttttggactgaagttagtctgtgaattgaatttcctttataaagttttacttcggatttgtgcccttagcttcatttcccctcagggatcctttaacttcacgagaatattctctggaaaatgatacctttcagtgacttgtgcctgagtcctctcagaatgttcctattcattgccaatgctccaagacttcctagtgtaattcattattaaattcaggatataacttatttaatttttatagggattatttatatcctggcatttcctcatcttgttgctttcctctgatctaaggctagatttttgaatatagtattgatttacttcatttttcttccataaataaggtagtagaatacaataat

SEQ ID NO: 42697 - DNA, 1065 bp, Homo sapiens
tcatactatttttaactcttaaaaaattctaatgcttatgacaatttttacctcatagtagatattcaagtccgaaagttatggatttgtaaccactcagttaaaacttttgtattttaaagaaacattttacaattcttagtcggcttactttttttgtacaatctagtttggtgcctcccactcccccaacccccgaaaaagtggattcgaactagggttaattacgttttctgtgataattttaagatatttcttagttgaattacttcaagtacctccatataggtatctctctcagacttgctgtacatgggtttcatctttgaagttgccaaccaggtaagcgtcttaatatatactttgatcttaattaagagacttgctttaacgatttcccgttgattttcagataaaatttagactgtttaatgggcaattcaagtccttcttcatgtggctttgcctttcctttcagcctcatagcctgtagggcatattctaaattactaaagcacttttcttgtcacaaacacactttgtcctttgacatttctggatcattgcgtttcttctgcctgagtgtgcatctttcccttcacccacgctgctagattttagtaatcttttaaggtgtatatctgatatttttttctgatgagcttcaccaattgtcttgtatttaggccaaaccactggctcttttcagtgtttacactgtcgctggcccttcctggaaaaggagctagtcaaatctctgctttacagtcttctctccatgagaacttgggcttctttaacagagatgtctcttgcctcatgcccagctcttggaataatgccaggaacatattaggtacacaatacatggttttgtttttgctatttattgatttattttgttgttgtcatttgataaataatccacaaccagtaaattaaaatccctgaagtatcttaaactatggaatttatgatttgtgtagatattgcttgtttctagaagaacaaacatttttgcaggaataagtgaaatagctaccttttcccccacaaaatactatt

SEQ ID NO: 42698 - DNA, 1050 bp, Homo sapiens
gctttcctagataggacagaatttttaagtttactgattttgtaaataattgtcatttctcatttccctcaccccaagaaaaaaaaaagagtatatagtgttaaggtaacagtttaaggagtcagacagacaaaaattcatattcaagcctgacatttagattcttgaactctcagcttatttttatttgtaagaatgggagtcagtgtattattttatattatcattttaaatggcaaatattctgggaacttgctgaattgtttcgtatttccataggttggcacatgctctcccttcctggaatgctctttcccagtctatccacccagaaagcctctgtgtgtcccttcagcttaatctcagaagctacattgtcctcagcaatgccttctgtgacgcatcagccagcttatatgtccctttttgtatgctcatgttgcatatgtaatgtgacccccactaaagcaattaaattattggttcataactttttatttgattgttcttgtccaattagactgtatacttttagaggagagagaatgatgcatagaaggtagtatatgaataatgaatgaatgaacacaggaaacacttaagcctagaacatttaaggcaaacaaatgttactctcttttctgtatgtatatacgtgtgtatttgtgtgtgtgtgtaatcttaaatattaaaatttatattttaaaagtaattctatatgcaatggtttaaaattcatcttctgattgtcacatgccatgattaatattttgagggctgaaaagatgacttatactagcggcagaatcatgaaaaaccaagtatgatattgctttcttttaggaagtgcagattttgataagaacatttgaaatgtaaattttacaccaggaatcacaaagtttatagattttccatgattaaactcacccaaactcaggtggaagttttttttccatgaaatatttggtgggagttaggaataagctgcagaatttctttagtggccgctgtattttccccagtgacacctactgtatcggattttaa

SEQ ID NO: 42699 - DNA, 1026 bp, Homo sapiens
tttaattggatacattaattattatttgtgagtttctactaacgttggaaaacagagggacttagagccatttcagttagagaggataagatttcagtactcctaggtttaaatgtgtgtgtgtgtgtgcacatgtgagtcctaatgttataaactgaatgatttctgtgtgtttaagaaatgtgagccattggtcctaggtaaagacaatggtaaaagcaagaactctccaagttattgccttacataccacagacattatggccatatatttccacagaacagacaccagtgggtttttgttgttgttattttattgaatgacttgaagcttgctaaatgactttactgtcttattttatcagtatttaagctgataaaatgtccctctaggctttgggaagtcaagctatctatttttaattatttacaatttgctttaagttaatcttcccaagttgttcctgcattgcttatctgattttctttcttagtttatctacacgatcctaggaaagaaggccctatatctatgaacagacacctgcactgtagaataaatactaaagtattaccttgaccctgcactaggatgaaagagactatggaccagccaatatgattgtccatttaaacaactaatattagcacaaatcaagttcagtttggtgtcttccattaaactcattcatcaaaatagaaaatgtcatttcagtaagaagcaaaatatacccaagaatatttctacagtccctggtaggtatgattacaaatatcaacaaattctccacttatctggtcggtagttgatgctactttcacttactccactgatatagttaaggtcttttggccacaactacaaggtatggattaaaaagttagaaatcataaggattgtttctttattctgcatgtatgatgagcctcccaaagttattgactttaaagttctcaattgtagtattataagtcacttctacattttgctaagtttaataatattcttcaatttctttaaaatgt

SEQ ID NO: 42700 - DNA, 1060 bp, Homo sapiens
taggacagatagcacggtagcatctcaagatacagaccatgcagctgtactgacatcaaaaaacggcctgagtgtgacatctaatctcaagacaaacctgtcttttttcagttcctattttaagctgcctttttcatgttagtaaatgggaactagggaagtatgtgctgttcccagagttagatatgcttttgaggtactgcccattgtggaaagttacatctaaaacatttatactttctaattcaccataaaaccttttaaaaatactgtacaaatttatggactctgagccagttctactaaatcagtatttctagggagcacacagtgggaatccatatatatgagctatttaggtgattttgatgattgaccaggtatgggagctgtggctttcaaaagctttgatagatatttcattattagaaatattactgtgtttataaggcgtcagtcctcttccccccatctttagccacacatttctgcctctgacacaactcttctcctcatctgttgtcttagtagccttctgtccaaaattatcttgttgtagatttgctttgttattctatccctttcctatagtagcactttcctgtattcagttttccatcaattttgagtctaagacttatttttctatcctttctttctctctgaataacttatatcctaaagcacattgaaattgcatgtcatactgttatacataccccaccactctttttaagtatatcctcattggtagtacatcagctgggcttaatttctaaaaacaaaattagggcccgatggctcaatatttctgaataagtaaccaaaattgttattgttataagaatgtaagaaaagggtgacaaaatggtgaattgctttaacaaacggaaaatgagttcagaatgaagcagaatgcctaagacattttacatcttgacttgttttaacaagattctaatgctttgtatttcatttatagaatagttatagcttcccattggctctgtgctcccatttactcagctactgtaaataatagccatcagcaaagcttttg

SEQ ID NO: 42701 - DNA, 1054 bp, Homo sapiens
tatctgcaaaatttataactatagatatcacatcaaaatcaaaattaagagaacagatatttttaaaaaccttcttgtttgtcaggtggttactgaactacttgtcatcataggactaatttgtctttctaaaggtaaaatcatgacagatattaagtgtagaatgaaggtaggagtattcaatacattttgtggtattggtttagacaccaggaaagctcctgggaaaattccatatgctagtgaaactataaattgcattgagtgtttattggtttctgtcatggtatagtaggtattggttagtgatttttttaaaaaggaaaattcatttgtttgtagctttcatttctcagttatgtgttttcaggaaggtgcatttgtcttatgaaggtggtataaaggaactactttagaattcagttctcatcacaaacaaatatcttaatgtaatatatttattttttcccagggaagccagagaggcatatgatatctggtgaataactatggcctaccaatcgttaaataaaatggacacaatttacttttacttcttgaaaaaaattttccccatcaaaaggatcattaattcaaataaaattcaaagtggtgtatttaaaatacacacttttcttctagtaatctcaaaatcaacctggtttgtacaacataaaagatgtaaactctcaatcatatgaaattttctttcactgcattaatattcagtgaagcttgtgattttagcaaatctcttctgctggtttagagggaacaacaaaatatcaggcttttagggtgtgcttccaatactgccctgggtagacatggggagaattcaggtcatagaatttaatgactttttttcaaaagcaaaacacatgcacactaataatttaaataacctttcttgtcaacaatagaaatatgtaacacagcaatagctgattaatagcaaaattaatggtgtaggcaataattgctaaaggagttcacaagaaaagattgctttactggagaggtgagatacacattaatgcaaagttaggaattg

SEQ ID NO: 42702 - DNA, 1088 bp, Homo sapiens
cagttaaacagtaatcaattgttgtagtcattgtattcatcacttacaataaataaataaacaaaaaacagttcacttaacaatgcccttgataaagaagtaaattactaattgtattaaatgtcaacccttgagtacctgtctttttaatcttatgaccaaacggaagttacacaaaaatagcttttgctgcatgcaaaccatctccaggaaggaggaagaggtggaggaggagtggggcagggagagggggttggagaggggggaaggggaagaggaagaagaagaacacctgtgttattgtctcggttgtgagttgaactcgtcagtttttccatggagtgccattattgtgtgaaagaactagtgagtgacaaactatggtgatttagatttgggtatttgacagacatgtcaatattgaataagatgaacctctcacttcacagaaaaccactgatagtatttgttgccaatgataaaatttaaatgttcaagtaaaaatcagaaagttggaaaattagtgtctgccaccataagcttgacatctaatagagactttcttgatgagattggaatgacgttttaaaaaaatatattattttgatttagtataatcaaataagtcaatatttggaagatgcacataacatagtgaactaatatgttcaaaatgatctatgcatgatcatgcatggataaaaaatccattcaaagagaatgctataccagcagattttaatattacacagttctgtgttctgtgttactgacttaagagttctttgtattagtttcttagagtctgcataaaaagtacaacagcctgggagggttaaacaacagaaatttgttttttcacagttctgaaggctagagatttgagatcaaggtgctagcatgcttggtttcttcttaggcccctctccttggcttgcagtcttcttaggacttctccctgtgtcctcacatggccttttctcttcgtgtgcctccctggtgtctctccttcttcttataaggacaccagttctactctagagcgcaactattatgacctcatttaaccgtaattcccttagaagccc

SEQ ID NO: 42703 - DNA, 1025 bp, Homo sapiens
gcttgagtggagtgcagtggcttcatctctactcattgcaaccaccacctcccgggttcaagtgattctcatgcctcagcctcccgagtaactgggattgtaggcgtgcaccaccatgcctggctttttttttttttttttaatttttagtagagacagggtttcaacaagttggccaggctggtcttgaactcctgacctcaagtgatccactcaccttggcctcctaaaatgctgacattacaggtgtgagcaactgagcctggccataagcaataaattttagacaagctacctccattctttccagtttacattatgttttagaaagccatttttttttaacatttaaaagtaaccaggtacagaataagaaaatcatctcattttctaagggaaacagtataaagcaaactgtaatgatgattaaaacaaacgaataaccctattacaaaattaattgtgcatttatacaattcagaatcaatcaagacttagattttacattaacagtaagaaaaaaaatcaaaagagatctgaaccaccgaacagaaccataatatcttctggcatgtctaaccagtggatatatatatatatatagccagtctcaatgaagctcatcttctctgccttttctcactctcccattccaatggagtatgtttgtttgtttgagtgtttgggcaattgatgtgtttttccagttcccctagtagagcttattgcactgttaagccactatgcagtatattaaggagaattagatcccagaatttagaatttgcagccatgtggtaccttttctaatcagatgaaaatgtcaagaaattggtctaagagtagagtatgagagccgaaatgctgaatatcctcaatttcaatataaataaagatttgagaattatagtgtttgaaactaaagatacaaatagtaacaaaagggaagattttaaagctttatttttgcatttgaggtttataagctattattgctactgtatattttaaaaatatattctttc

SEQ ID NO: 42704 - DNA, 1049 bp, Homo sapiens
cctcacttatataactaataatggtgccaaagtggtattactatgtctcttaaaataattctttagttcaaaacatgcaataaatagaatgatttttgagttatcagagagtcccttattaggctaacaaaattacttcaacacagtgaagcgtggaacatgctagctttcttttgtttcattattattttacataaaccttaaaattataaactcaagtatgtggatctatttttatcattcattgaaaaaaagcctttatactgcttcttattgtaaatacctaaatttacaatgcttgtccttcatcttatatttgatggcagttaattgttagttggttttaattatacatcatagtctttgttctggagacaatccaaagagtagatcatcttggtgtgtaatttactgaaagtttctaggcagcctgccatactaaagaccatgtggtacaattgtcattaaaattagaaaaatattggtatacatgtttgaattaaggattagagggtggctctataaattatggaaagctctgcaaagtattaataaggtttgagttcagccaaagcctaatttccaaagatctttacaatacacagatgcattttttttgtacctgtggtaagtttttggtgaatgttgcttctgcttgtagaattccagatcactcatgaatatcggtatactcttttttagcacgtgagtaggtgggtaaatattgttagtgtttggatattggataagacacttagaaatattgttgcacttacaaaatataaagcacttttgcttttaaaaataaagggcccaaactctggttaatattttctttagttacaggtaacagtttttcaaatttaaaaagtgctcagacagtatttaaagacatatatgtattctcatgaaatataaaagaactgctctgctagctaccattgaataatgtaattaaacactattttatttttattattttattttcaaaactcagtaaaagtatgtcaggtgaagactggcgtgaggtggccaaagataacaacatt

SEQ ID NO: 42705 - DNA, 1035 bp, Homo sapiens
taaacccagagagatattagaataagctatgaatagctgtacagtggtaagaattctggactcagagtcagtgcaacacataaataagaaaaaagtactattagagaagagtagggtcataaggcctgacctgctcacttctgtctaattttacataccattatgtggctgggtgcaagttgttcttataacatacaatcccctgtctaacctttttgaaaacaacacatttgacattcaaatatattttattttcaagaaaattaaatacatttattatttaatttaatgtttttattattttgtattaataaaacaattttaaaagtatttattgtattttcttccaatactttaaactgtttgttaattttaaaccatttaaggaaaaaacacaatcttaccttccttttcaaagccagagggaggtgcaagctgtgatttttgaaatttttttttcttctagtttaaagaggaaatacatagagagtaggtatattaaaaagtgagtagtatggaactctaacttcatgtaataaatattgagttcgatccaagtgccaaaaatatgctagatggtgggtacacaaagataaatatgaatcatatccttaagcagcatatagccaaagacagtggctggttaattagattagagcaccatacgaaatgatgctgagatcacagattccacttatggaccaattagctcctctttgttctatggccatagattgcatacagatgagatactttcatggttttgtgcatttttactctatctcttgccaaaaagaatttgaaagagcacacagcaaagacaaacatagtactaaaactctgtaaggtaacagaaaaagcttttgagaccctattcattagaccaaacttacaaaacatttattttcatttcagtctatggaagtcatggaaacaaacgtactgatgaacttagtaatctggaaaatatttaaagctgtcaaatggttgtagtaaagaaagtgaacaattccctaattcatttgttaggaagcg

SEQ ID NO: 42706 - DNA, 1055 bp, Homo sapiens
cagcacttctaaaagattgaaaacaccaagaagatagatagaatattcactatttctcatattgatgcaattgtggtgctctttttcatttgaaacatcttctcctaaaatatacactttaagaaatagtcatttctgtttttgcattaaagtaaattaaagcagaaaacacatgctcacttttggctaacttcagtgtatagatttcatacttatgttgtctttcctgggtacagatttattactgaacaagtacgtgtaagtaaaatgtcattggtgagcaggacacaagataaaaggtgaacaccacatatggtgtgaattgtaaatgcttataccacaaacttgaaaatgtgtcatgtagagccatggaaaatgtctagttgtttttatgtagtacacacattttaatggtgctaacaacctgggctcttttgttcatagagttattctgaaaaaaatttcataaaagacactgcctaaagataggtagaataggctgtagcttgatttactgtggaataaaaaccaaaaaaaaaaaggtcttaattgtttcagtctttaattatgtctataaacttagaaaaaggcatttacatttgaatctagactaatttgtttagtaacattcttcctcatattcaatgactgtatgtatcagtccttatttagagactgcctgctttttaattcatatagctctttggttctattctttgttttgtttattattttgttgttttattgcttgttagacctttactaaagatattttgtgtatttagaaaaaatataacataaatatatgctttttaaatatgtgtgtgtgtgtattcatctcttatttaaaaaccacactgttcatccactctgtgcctgaaaaaagggagctgtacctgggtctaatggaggaataaaaagtaaatactaggccgggcgcagtggctcacgcctgtaatcccagcactttgggaggccgaggagagtagatcacgagatcaggagatcgcgaccatcctggctaacatggtgaaaccccatctctactaaaaata

SEQ ID NO: 42707 - DNA, 1035 bp, Homo sapiens
tttttagagttattaaccctttaggttctagtgccttttctgagctatctagtattgaaagtcttgtcattatttttaacattttcatatgtagtgaactttatcaataatatatttaataaaatgaaacaatccttaaatgcagaggtgaagtgagttagggcaaggtgtatggtatgaaaaagaaaggtctttatctcaccctaacactaccccctcaacctaacattcttgctcactgtgctttatatacatattacacgctacatcatactttgtttttctctaagcatactgtttgtctttctgtctctacattttttattgtgattccttttttccttctatttgaatacaatccatcttcaccgtcttaattcgtacctccttcgtgtctaccagtgttacttttttatgtacaacttctgactctttttgaactgttgcttatttgtgacatctagactatatttttatcccttattatattaaaaatcatatataaatcttgatttgtcagctaaattctaattcctatgaaggcaatgattctcttccattcttcatatatcctccatttaatccagcaccaagcacgtaatagctcaatatttattattagtataattgtaggtacaaaaagcaatggagtgttttcgttgcattagtggtcttggaacttaaatatgaatattttttctgatttcccttgagattaaattttgacaatgaaagaggtatgctcaaataacagacgtctgtgttcacactattattggaaaggaagttccattaaaggatgctcaattacctgcagattctttgaataggagcaagtatccataatatgtgatgttataggtttttaaatattctagaactctgaaaagtaatgtgtgtgtaaaggtagaaggaaaactggctttcagtttttgaaaaaatcacaaaccaacaccctaatgattgttgttaatatataaaatacaaataataggacaatattactagtttttatacttgagttatattattctg

SEQ ID NO: 42708 - DNA, 1028 bp, Homo sapiens
gcacacacacacacacattcacactcacaacaccactgagctcagtcaggctgagcatatttcagtttctcaagcacaccatgctctcagtcacctccagacctttgaaataaatccctgctgcttctacttggagttaactcctccaccactccctcctctgggtaacttccagttactcttcaaatgttagcttacatgctagttcctcagagaaaacctcttgacacactagactgggttggctgctcctaccatgagctcctgtaacagtgtcttatgtccttactcatgtcagtcatatactccttggctgtctgtctcctctgctggatggtaattgtgagagcaccaagggaattgtgggttaagggagtttatatggcttacactgacagcccaaatgccaaatacaattctcagcacatagaagaccctcaaaaaatacctggtatacaagtaagtgtagcaagcgtagtatctaataggtaattctccaaccctttgtcctctcccttcctcccgcttcttgtagaccccagtgtccattgtttctatctttatgcatattcaatattcagctcccactcataagtgaggagatgcagtatttgattttctgttcctgcattatttagctaacggaaggctccaggtgcatccatgtttctgcaaaaaacatgattttgttctttaggctgcatagtattctgtggtaaatatgtaccatgttttctttatctcatccacttttgatgagtacctaggttggttctatgtcttttctattgtgaatagtgctgtgatgaacatagaaatgcatgtctttttggtaggatgatttattttcttttggatacatattgagtaatgggattgctgggtcaaatggtagttccatttttagttctttgagaagccttcaaactgctttccacagtggttgaattaatttatgtttccaccaacagtttataagcattcctgttttgcatggcctcacaaacatctgttaattttttactttt

SEQ ID NO: 42709 - DNA, 1030 bp, Homo sapiens
aattatatttgcccattaaaagtatgaagttaggtggagttagaccattttttaaaaattttgaacaccttcttaggcatgttgaaacaaatggaaaatacttgatatttttgtatagcctcttggcagaggaaaagcctacagtatgtgtaccactaataagtatttgattatgatttgccattatgagcattaaatatttcaacagtctatgaaaaagagtggctacacttcaaattattttcaataaaactaggtattgtctaatgggcttaatttgaagattttttatatgcatgaacttctttagtcatagcttttagaaaatcataaggaaggtcatttgtctgtcacagtttagttgcatctcatttttaaattcaaatgtattaatttgcatggcgattacaaagacacaagtgtttgagatgattgaaatcactttagtttggaaacgtaaagaataaagagcatgaagaacagacagtgaggaaaggatttcataggaagagaaatagaactgggagaccactaatgatcaaaataaaatttccaaagtccttcatggttagttttaacgagaaaaaaagtgagaattaaaagtaagattgtgattgtttctagtgagtactttcctttttaaattacaggagttgtttagggtaagtaattttgaaacagctaagttgtcaagagtatgaactttatctgaatcttcttggaagctaggcatgcttaatagattttacataaattctcattttatggttttcaatatattaatacccagcagtcttggtaaaaaataaacgcaagaaactttgtattggaaaacagacctgggtatgatcaacatttaatgttggttcagttataccttgaaatttctatagagtatgcatttcctttgaggacataaaacatagaacataagcagcattaggatagtgcagagcataaattttggcgatagcctgagattccataaaggcatgggagtttgaagaacatcattataataatgctcaaa

SEQ ID NO: 42710 - DNA, 1033 bp, Homo sapiens
acgggcaccatcaccaccagtagcctcctcctcctcctcctccccagcatcaccagccgaacctgcctgcccagcccaatggactcctgccagcccatcgcagagttcttggcgcaccaatgactcggggacaatcactacttatttctatcaatagaaagtgttgtgtcaataacgcagccaagatctcgccaatcgttaacttccaagaggagaaggtaaactagataattgctcaattcgcttccaacagtcaacaggaaaacttttttttttttcatctgcagtcagtaactacttttcattggtgagtgaggttccccgcccagaaaaggcgggggcgctttcacccgcttggcgcgccctcccctctgcgcacacactctgccgcgcacacttcactaccctccgcacccccccatccccaccccccttttgcttcctctgcctttctaattctcaatctgcttaaccaggctttagaggccaagcaaatctgagatcaattttctcgtttagctctaagtgacatcatctaaaatcattgtgcaagggctaaataaggaaacggagtctaattcaggggcaaacgccaggctatatttatcaaacgccaagctccagaaagcctcggctaggaagcctcggcagtgaaatccgaggtttcgctgcttggttccactgggcctgggtgggccgggctgggccgggctgggccgggtcagatctgtgccacctccgcagacctatttcttcctccagggctcggggttgcccgctcccggaatcccggagtctccgcggcccgaaccgagtctggaccatttagaagacgccggcaggtaactggcctccccaaacgccccgaaaattaaaagccttaggaggcttgttctgtgtttgtggttttgtaaaggcaatgcccgcggcaataggcctgggaaagtcgcactttcatccacaaagttgaggagttgcaaggaataattgggtgtcacaccacaagcaaccttgactcgatcggaccccaccc

SEQ ID NO: 42711 - DNA, 1034 bp, Homo sapiens
gggaaaatggaagcccacagatcaaacagctagataggagcaaggtggaaaatgaacggagatcctcgaccccatatcaagtctgtgcagtacagaggtgggtaagaaccaccttttggggattttgaaatgagaaatctttagcaagtatcataaagatgagagaatatttgagagaattcctaatgaagataagagaaagattagccatctcctttatcttaggacaaaccaccaagatcaggcatcagtacgattaagccaatgaagagagacagtttcttcttccttcctcattgttttggtcttttcttggccacagtaatctttatcgtatcctccaagtctcttcagctgtttcaccttagtgtctagcatagagttggtatgcagcgtgtgtgataatgttaataagaccattttaaatagggattttaaaaatcaacatacatccttaaaccccaaaatgtcctgtttaactagaatgacaatagaataaaattccagaatcagagttggaaagaacctttaatgtcatcttgtcctatttcccacataatgcagaaatcttcagtaccacacctggcaaacagtggtgcagcttttactatgtcacctttgtaaataacttttttttaaagttttgtcttacactgatttcagttctgctcccacttgtttttagtcattgttcctagtcctatcttcttgactgatacaggctcaggctgttcctttttccaaacaggagccctttacatattgatcagggctaccttatctcttagattttttttccctctttctaggaacagtcagatttctttttttttccttcataagccactatttccagatcccattaactagcctggctgctttctataggaggaagtaaagtaaaaagaaaatgttgccttgaaagaattcagatgtgacttgttcacaatcatacagatgcgatcaatatggtataagtgaaatgattatttcctacaatgtagatactagattttattgtaatcaataataat

SEQ ID NO: 42712 - DNA, 1026 bp, Homo sapiens
aaaaatctgctaaggaaataaagataatctacattctattcacgtgggtcatttgtaatcctccccttaaagctaacagactcacatgaatgtgagaacatttgagagttactagcttcttttccatattttctcccatactctgttaaagatttgcaaatgacccatacatgaattactctcttgtgataaaaataaacttgctttctaagcagttaagccctagctatttggttgttacaacctttttttttccatttttttcttgtatggtatttatctgagactgtcgaaagttttttatcacttttctttcttgttggttaaatgttgagaattttttcctttgccactgaagaaaaatcaatctgtaaatgaaaatagatatgtaagccaagttattaatgaactttggctaatttttatagacccactctagtaaaaccttttacctatttcaactttaaggtgtggttgagttagagtgattctgttatataatgatggaatttgacctgatgtatttcagttcagagttactctatttgcacttccaatctcttgattttatgtgtcacataaagcctatataagtaaacatatatctttgttgactaaaagaaaaaatgtttcccaatctatagtcttataagccactaacaggtatatattttttatgcataaaagaaatgaaggaatttatcatttctatgcatatttattaaaatgtactatgaaatttaagatattaagataaatttattgaaaatggaatacattttcagatgcctggaccaccttctttctctagtccctactgtattttagattattcttttgcaaaattttttgggaggatgaactcttcctattgtaatcacatggtagtagaactaacattttattagtttcctctagaacacagtcttacttgattcttagaattatgcataagaattatatttttttccttaaacaagtttgcttgcctttcttgcatagtatgtagaagggagaatttgatta

SEQ ID NO: 42713 - DNA, 1029 bp, Homo sapiens
gcacaatactttttttttccaatcaagatgctaggaggtagaaagggaattccccaacacagtagaggagacgcagcctgggtcccaccttctcttctcctctctcagctgcaggaggacgagctgcgggatgcagtgctgctggtatttgccaacaagcaggacatgcccaacgccatgcccgtgagcgagctgactgacaagctggggctacagcacttacgcagccgcacggtaggggtcctgcccacctggtgctgaatcctgcctcttgagggaagctgcaggctgggacagagatataaaggcattccttttgttcctggttgctgacctctttctttccttttccccacagtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgtacacggtgttgtctgtagcctgcaaaggagaggctaggttactgggtaccaagagacaacgtgggagaggatcaaagcagctaaggctgcagggcaaccccacccacacataccctcagctcagcttctccctccttattcttgggctggaaatactgtagggtttacagtggtgcaaatctca

SEQ ID NO: 42714 - DNA, 1033 bp, Homo sapiens
tgttactccttgtcttgtctgggagctgctattatggtaaatgacttcatttggtgcttatggtcttcacataggagtatggtgtggaagatgattgagtctgggtagtggcatatacaattcagtgatttgagccatctgtactgagtatagattgcactgccttctctgaccacactacaggggttgggtgagttacaggcagggattaggggaggaaagctgagtgaactgcagagtgacaggcagatttgtgccaggtttagaagccttgtctggaatgaaaaattgaccactggcaaattgctgtgtgtgaagctcttctgctaagcaaagttgtattttcctgtagagtaatagtttccattggtactaggaactgctttgcaagaactctacaaaggaagatggagctctgtgacagatgaaagtgagaaagaaatagtttgatgaataggaaaacaggagacactacttttctgccttttgggagagaggtagaaattggaacactgacctacgcttttcattgttaactctttggatttatctggactcaggctgagctgaaggtctgaaatcgtctagggttgaagtttgctgctgtaaagaggaatagtccttcctcttttttggcaaaagaaagtgttgcagggccgtgaaagacacaagtttcttctggtctctgctttgctatcctgttaagtcctacattattttgtttaaggttgaagaacttgggaatccagttgtaaaacactttgaccaatttttaaaaaacgagggtgatgttgacacctgtgtctgctattgagagttggggtgaagggacagagttggttctggaatatttaaggaggaagtggacagtaagttgatacagatattttggagttgttctgttacagaaaaaatcagcaaggatgatggaaaaacttaagatggatttgtattttctgagttgggatgagactagcaagtatgtgggtggacaaaatataacccagataaatacatgtcttctatcaaatca

SEQ ID NO: 42715 - DNA, 1052 bp, Homo sapiens
gcttgcattaagcattaatgtaaaacattcattttggtttttaaaaaatcagagattaaaagctgagcactggcaagtctttttttggtaaggggccactttttactgtaattaaaattattgtcctcacgataatgtgagttttattgtctacctttgccaagaagtctgagatgatgatatttccagtccctttttaccagtgtgttttaaattagaaggactgatttaagaccttcctgagtttagcttcgtggcatgtgtgttttttggaaggcttagtgtggggcgagagtgcctagcactcacatttaggctgcattactcacctaccttgcctttgctttagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccagtgagtgtgtctgtgcagactgggtggtgatgggctagggatgcatttggggtttgaagaataggggtttgcttctctttctctgtatttaacatccattaagatattggccagttgtggtggctcacgcctgtaatcccaccactttgggaggccaaggcgggtggatcacgaagttaggagattgagaccatcctggccaacatggtgaaaccctgtttctactaaaaatacaaaaattagcctgtcgtggtggcgtgcacctatagtcccagctactcaggaggctgaggcaggagaactgcttgaacccgggaggcggaggttgcagtgagccgagattgcaccactgcactccagtctgggcaacagagcaagactctgtctcaaaaaaaaattatggcaggattattattaatatctgctgatttttgaggcattttctagggagttatcatttgtcttacagaattggacaattttctcacctttaggaaattaatctcaagtgttattgggttcataagaagaggaacttgatcac

SEQ ID NO: 42716 - DNA, 1016 bp, Homo sapiens
gcttatgtatagatacgttttacagatcccttttatctagaggtgtttagagagggacccaaaataaagagcttacttctttaattgatgtgtaatatttcattgtaggctgcaacataatatttttgaccagtctctaataggtttatattcatgtagttgagaatttttttcgttatttagaaagtggaataaatctccaagtaattggcagttatttccttagaaattatttggctcacatttgccaaacatgtctttagaaatgttaaccagtatataccactaagtgtgttcattttctaatatgttgtaaaacagggattggacagctttttcttaaaggaccacattgtaaatattttaggcttggtggccatgtggtctctgttgcaactactgaaccctgccatggtagcaggagaacagacatggacagtgtgtaaatgaatggttgtggcaatattccaggaaaactttataacaatatgaagtgggctggatggcccttgggccatagtttgccagcctttcttgtagaacactggatagcaacattaagttaaaaatggaaaaaaatacatgcattacttttcataacctggaactcaacagcagttctgtatcattttacctgatttaaaatatctgttagtggcaaacagcttttttcagggaatcctaaaaaagttctaagatacctgggaccttcacatagtctgaaagtcctgcaagtcttccctgagtgattctgctttcaagatcatgtgattgtgaagccttaacaaatagtgattctctcttcaacaatcaccctgttttttaggaattaattgtacagggccccgctaaaagcctcaaaagcctgcaaagggtaacctatggcctctaactggatgcctctggggctctacagttgatttctggaactgaggcaaagctgtaggtcagagtgccaagaggcttattaagcctgagaaatgtgaaacttgacaaagtattctctgatacatgtg

SEQ ID NO: 42717 - DNA, 1039 bp, Homo sapiens
ttttgtagtcatgacagttatgtagccataagagttatgagaattgggaatagggattaaggttgaaaatttttggggatttggttatgtcatatttttacagacgtctttcccgcttctgtttttgtcgtctgataactaaactgtgtgattatgttaactagttatagaactagttcctcagtgagagccagcgccaaaggcaaacatttggacagttttcagtaattaactattgtggattgaagttactgctgtgtgtactatctactgcctgcttttttttttttttttaagaaacagggtcttgttatgttgcccacactggagtgcagtggctattcacaggtgtgatcattgcgccctgcaacttcaaactcctgggctcaaacagtccttctgtctcagcctcctgagtagctaggactataggtgtgagccactgcacccaacttatctaccttttttttatttatgcctttatacaaaaaggatgggataaaaaaaatcccttttgtataaagggataactaaaaaaaggtagataagttgggtgcagtggttctaaaggtgtgaaatttgctattctgatgttttgcacatatacatatcttggtgcattcacaagttgaaattcagcattgttttcatttgtgtgagagtttatagacagcccgtaagagtaaaataaaaatatgattgtcttttgaatcagatcatacataaaaaccacgtacaggatgggtgatttgaatgtctggccaatcagttctttctctctctttttttcccttagaggaggcagtttaatgcagcaaacagtattatggtaaggttgagaatttaaatgtatgaaagcctagaaatgccaaaataaggttctctcagtaactgtagctctgcctcattgcacagagtaaatacacatctccaattttatcagtattgggagtagtccacaattctgcatctgtgccgtacagttggaattaaggttcccacagcaaccacaactttgaaattcttgaacgttaatttt

SEQ ID NO: 42718 - DNA, 1056 bp, Homo sapiens
ctctactctgattcaggcttttctgaatatcttcctttcatagtagttcaggtatcttgattcattgaagtttatagttgcagtttttactgaggggtatatatatatattttactgttgtcgaccttgttggttgtcagattatttctttgcttggaactaattttaaaatcaattagagatctctcccttcatctttctcttttatttatgagatactgattgcagagctacctacactgtgtttagataaattactttttttttttttttttttttttacataacatttatattcaaggcaagtttagtgcagtcatccagtgcttcgcatttttgcaggctgggctgtaggtttcattccttggtgggctaattagctttgtactgggaaaattttgtgcaattcagaaaccaaacatttaagttccttgtgtactttaggcactgtaggtctgggaaattatttttatgaataaggtgtttataattttaggatccatatctctaatcctgacaagtatgtgtgtgtgttgtggtcggtcaccaggtagactttagactggatgatggattatggatgaagcagcatcatttctgtcactgttctagaaaaaagcttttcataaccgagactggaatgggaagctgaaggacacaaatgatttccctaccagatgacaggccaattgcttaggcatatttttgatgtcacttttcattttagccttcctctgaaaatctacggtcaatttatgggctgttcacattggacagctctttatttatttatttatttgagacgaagtctcgctcttgttgcccaggctgtagtgcaatgtggcgatctcgggtcaccacagcctctgcctctgcctctgccttcaagcgattctcctgtctcagcctcccgagtagctgggattacaggcatgagccaccacatccagctaattttgtatttttagtagagatggtgtttctccatgttggttaggctggtctcaaactccgacctcaggtgatccacccgccccggcttcccaaagtgctggg

SEQ ID NO: 42719 - DNA, 2430 bp, Homo sapiens
gtggccaccaaggagtattgctgtttcacagtagggtctctattcagtttagctgtgaagacattctggagactttgtcttccttgccttttcatttctctgctagaagccacttgatgtaatagccttcatccttgtttcactttattgggcaattagtgtggataagcagaaatatcccctttatgtgtgttcagacattggtctcagaatctgcttacctctgctgtcctgctggttctggatagcccacatgatggacgcctgtagttctgctgtaaaatactttttcattgttttctgcatttttttctccttctctactcagtttgatttttctgggtcatgtagatttgtcatttcttcagatctgttgctaactaaatgtctagcacatagttgatactcaggtgttagatagtgtctcattgcatcctcactgggggcctttactcattattcatagtttggggatatagggatgggcagaatatgctgacacttggctttctgattctaccactctgcctttcctaggacatgttcctcatcactactgggaacgcgggacttttttcacatgctgttgtcttttgtaaggtgggccacaattaggagaaagccacattcatattcgtatggagctgcctttagcagcatctgcttctccagctggagaggcttgttttagaacgactggcatgcggaagcggtaggtggaggtctgggaggagctgcgtagccagggctccccttccagcctcccgtctcccttaggctctttctggcctgaggcatggtcgccatgggtgggggcactgcccgcccgattctggttggaccccctttcctctacttcataccgcagctgctgtgagcgagtgcactgtgctctgcacaggagaattggcagacagttccatatgctggttttggccattgggacattcaggattattaggccagtttgtactttaagaggagggagacttgacatcgctcaaagcagcttattttatttatttctatttcttataaaggggaaagaagctagcccagcccttagctgttcctttcaacgtagccggctcaacgttttcctcaggaaaacatgcagggttcctcacagctgcttgagccaggctctgtccttccttcgcagattgccccgtggctgcctgcctcttcactctcctaaagctttttggctttaccttccttccctcactcctcccagtcttccctcagaggactgactggttctttcagcctagacactcctgtttgcctgccaagttacccttcttccggaggtgcatagcctcagcactgtcagagttcaggagaacagaagctcctccagtgagaagccagttaataacagcttttggacccattgttgttattattagatatccataaaatctagcaggtagagaaccgtcactggggctctgctggagagatatgtctcaatcctaaaagatacaaattagtcccagagtacctgataccgtagacggaacctgacaaactggaaactcagtgtgataaaatcctataacctttcatctctcacccccatcacccagtaagaagtgcattctcagggcagaagctaatggtgttgaatgtctctctcttgtctctttatctaggaatacagtggagtgtgctcctgtgggaacacgctgtctctttgcctttgtgcccaccccagagatggtggatctggagacttcggcccttttggccaagcacattgtcttcctccacctgatggttctcaaaagttttgtttgtttctttgtttgcttttgcgttttgacttgccagcatttctggaagtatctgaatggtaagagtataggtatgtgctcctgctactttagttgtcatctggatttctttgaattaccttccccatgccacactgtggttccttccatttctacctgctaccctccctcttggagtgcagagggaatttgtaaacttgggtttgaatgatgaggtcatttctgaccaacacaatttggtcgttctattagttgttcctgcagaccttacaaaggagtatgttgctgttcttatatgcccttgtcttgtgttgttcaaaaatcctctgtgctatgctttggatgctgcatgagcctgcaaatgaatgcttagcattgttgaagttgactgctgccctttagctgtctggctttgggttcagccagaaagagtggcatctttaacctgagtcactttttaaaacatggacaacaacgaaactgtattctagttttcttgagcaaccacatttaagctgcttattaaatacaattttatattctagaaaactacatttgtacagtttaagcaagaccaatattcttctgctcctagaagaagttaagtaaatttatatcttaattggtaaaa

SEQ ID NO: 42720 - DNA, 1742 bp, Homo sapiens
ctctttgttatttctggctgcagtttgactttggtacatctgtcttttacctaggtccccttccctgctagggaaattatgtccatatatatggttctaaggtatcccctgatgcaaagttttacaagggcaaatcatttgattgttaactgttagatagattcactgcaaatatggctgcccaacattattgcttctcatttgctacaaacgagctccaagccttctgggtttgcacaggactgctctgaggacaaagattaagtggatttctgttgatgccatatattttgattgcacagcagagtcgcattgtgtatttggggcctgccactgactgccactgcccttcttttcatggtttctctccctcccctccctctaagccctagctgagaggcacaggtgcatgccctgttgactctcatggtgaaatctagttgagcttttcccctagagtagaggccagatcagtttttcttaagatgtagttcataagctacttgtgttaaaatctctgatcggaatgttcatttttcacaattgccaggtatctctactgcacttcagcttgagaaccaccgttctagattgttgctcttaccaatggaagagtgtgggcttactaaagctctatctccaggattttcgtctctgacaatgcaatttttcttttctgagccagactttagtgcagtaatatctctgcaatttcctgtgtgagattccccgctccaggtctcagagccagatgctaagcagacatgtccctcttagcttagaacatctcctgaggattccagtgaaaggagatataagagttctgcctgaagaaatttatctgcttcagagaacagagttctctagggaatagtagagtttcttagggtttataacatactatttgagctgatgtttaggtggggcctgctatttacagtttcaggttgaattttacgtcatgataaaaagagaaaaggtttatgaagtggtgccttgttagatctggggtcacacctcatgtgcaattatattagctgaactcggtaaggcagagaaaaggatgcaggttaaagaacgtgcttgcctccagcgtgtgcaggcagccctcaaatggttggaagaaaatacaggtgctttatggtacatagagagaacgtaggagcttgatggcggttcaggatacagcacagcaaaatcctcaagcaccttctgaactgtgactggcaccctaacacagtgtgcaggtttagtgttagcggacgatctgtgttaggactgacggaggaaatcttgtccttgttctgaggccttacagtagtcttctgccgagttcttttcaggactcagctctgagcattacaggatgagaaatgctgtctgttagactaattatctgatttatgctaaataaatgcacagatgtgatttaaaagtcagttttgggtttattaatttatgatgcaatttccagctgccagacagaccagaatattttgatgggccaagggcattctttttgtggaggaagtttgcttattatttacagagtctgagtaaaggaggttgctggatactgaggaaaactgaggtgaccctgagtatgtgcctggcccaggtagagcgtgaggtgctgggcatgcactattttgttgactcctctaccccgtccttgggagaataatgacaacttgctcagggttccttctctggtaagtggaggaaccaggattcgaattgcc

SEQ ID NO: 42721 - DNA, 1022 bp, Homo sapiens
gtgctcactagatgaggatccctagtaggaaaatctgaaatctgaaatgttcccatgagtatttcttttgagtattatgttggcattcaaagagtttcagcagttgagcattttgatttttggattagggatactcaacctgtataacctagagtccgcatctcaaatacactttaaggcaagagggcagccattgacaaatgcagacccagggacagtgtactgtctgtgttccatgtcactcaacaattgagctgctcattttttactggcttaatattctggtttgatgcctggaaagcatagagaatgttacagtaatccaacccagaagtgactataactctatatggttagcatgtatatggcattatgagaaaacactctcagatcctctagagtgttcacatgttcagctttgtatcttctctaattatttttcatgtgtcctttctcactgtgggcagcttctcctcccacccccaaggactggtaggtacattgattactcctagtgcattctcttagccactggaagtctcgctctggccttcctaaaaggtgtttcttttttttttttctttttttttttttttgagatggagttttgctcttgttgcccaggctggagtgcaatggcgcgatctcggctcactgcaacctcccaggttcaatcgattctcttgcctcagcctcctaagtaactggtattacaggcacctgccaccacgcttgtctaattttttgcatttttagtagagaggggtttcaccacgttggccaggctggtcttgaactcctgacctcaggtgatccaccggcctcagactcccaaagtgctgggattacaggtgtgggccagtgcttccggccctgaaagttgtttttttaaggctaacgtgtttatctgggagaagtccattggtaggaggggagaagacccaaatgaaagttgcatctgtttgctgctttttccctgaggtctttttcttaactctcttcctctcagagaggatcatctc

SEQ ID NO: 42722 - DNA, 1044 bp, Homo sapiens
gagagtggtctctgatatgtggtctctggaaattcttttggcccaagtcttaaagtcatggtggtaaaaggttgactagaagagagcctctgagtggagagacatcctatgcacaatgcttgttctcttctcccctttcttattgccagcataaacagttgcacttctggctggcagattcgcccttgctaagtctgtgctcaggttgctgtccatgattaaattctcgctgcctgcaagcacagattctaggtgttgttttaaggttcagggcaaaacagttttctgtaacctctcctgctgtaagggtaactggctatatttgtttgtaatggacacatgtctggctgtgtgtgtgtttgtgtggactacctttcttttattcattaggcatctattgaatggataaggtttgtaaaaaagccattttctttagcaagtagcttgggtatttttttaagcgtttatttttcatgtgttgatttggaataaaaagcacacacaacttggaatgaaataaaagactaatgagaaacaaagccatgaactcatcagtgtctcaactccacaaaattagagtccccaaagaatcacagcaactcatctgtgtatcaagcagcagaaccgattattgcctgctttgggtctgactctgtagcaacatggctcaatcagcagaataatgcagaggaaaaatgttaagaatagatgcttttaatgcagctctcaaccccagtctgcacatcagaaatcacccaggtagctcttaattagtgtacatgccccaggtctactgaatcagaatttccaagggggtggggggtggtctagtagcttttcttccctccaccttccaaagctcctcagatgcttctgatgtgcagctaggattgagaaccactttttagtgtgtcctgggtgtctgtggtagaagtggaaatctggtgagattgattctggatgggagtcttaagcttgaaagtgatgacatcaaaaccaaatcaaatcttatagatgcagatgttgtttagcctgctttaagac

SEQ ID NO: 42723 - DNA, 1312 bp, Homo sapiens
cactttggagaatttttacttattccataataaagatgtcatagccactcatttctttaacgatgagtttaaatatttcccatctggaaagctctttccttgaaaaggtttattacttctctgtctcctctggaagtagggagagaaaaccattaacataataatagtgtctgacttctcttctctgtcctatagtttgtgccagtagtttccttaagagccataatgtggcctgatttatgaaacttacctgggaaacttttattctcccgtaagaatacctgtaacataatcaggatacttaggtgggtaaatttcattccaggcttgatttgccttatatataattaactttctcaagaagtaaaatctaaaatgactcttaaatattgaatgtgattttataagatggctccttgaaatgcccttttccccctttgtcctttacctgtttgttttttgtttgtgtacttgttcttttaccttaaaatcgcctgggggaacttgagaacaaaataaaacaaccactgcccaggcctcaactaaaataattaaagcaaatctctgggagtggagtgcaggccttgttgtaccgcaggtgactctaattctgaaagaggcttgcaagcccctgtgttgactgttgcttggtgaggtgcttctctactagccctttctcctccttcctcactctttgctaacattgccttccgttgtgtacctgttatggcccttaggagacctaatcatttcacttctgcaggtgactttaaaaggcccacttgttagaatggaacacagtagattcctctatttgaactttgcttttaataaatgatgacactatatgcttatttagtgttcttttggggtagctcagatctccttaaaagtcttattgttaatcccctcagtgtttcccgagagtgaggtaagggtttccttgttattaaatctaataccctgaaattgctgggctctgttacattgttctcaattgttctcaacttgaatgctgtccctatcaggttggacagtttcccagaatgcctttctggtaaccgagcattaagatttacaatctagcttttcttagccagaaggtaagtcttgcagggacttcagaaaggtgttctttctaatccttagtgaagagatctacttgatgggcagctggtagctgggcctaggtattcttagaagaaggatgttgtaatgttagcattagtgtgaaagtctgcatgaacactgggctgatccaagccagaactgatgagtcgagaggacaacttgtgccaccaagatgtgtctc

SEQ ID NO: 42724 - DNA, 1050 bp, Homo sapiens
ccctcttttccaattttctgtgccttatttcattgggagatattttgattggctttatgtgggcggccttttcttactaattccttcttcctatgaacattcatcttttgagtatggtggtgtcttaggctagaaaactgatgtctggcctttgtaggtataaatacctatttatacctggcttatgtgatgcctagtctctggtccccttcagtccatagcactgactggccactttgagcatatggtagtgagctgcagatatgactaagtaaggctgctagcattcagtcttagccatttaagtagtcagcatatgctagtaatgtttgtattcagtataacttggaggcaaggtgttttttactagcacattttggttttctcgttgttgttattgttattaattttttaaaaagcttacattggggataattgagaataaatgcctttgcattcagcatgcatgagatgttttgcttgtgtatagggaggttgttgcttgggtggaagagttagaatttgtatgtagaaatgaaggaaaaatgtgatttgcagggctactttccaggtcgaccaagttcttcaaagtgacaaacatctctgttcctttgaaaattatagagacgctggtgtgccctatcattaaatgaattgtcaaaggccctggatcctatggtttggatataaatagcacatgtggctgtggaaaggactctgttgagtgtgggattgcctatgcaattcctgcccttgtctctctgaggaatcatggacttgaagtactttctgcttctgctttatattgtttttattcaaggttcagatggtattgcaaggaattggcattgggtattgaaggacctttctgtgaggatgagttctctggataagaatgatttttctagctacagtcttgaaggaaaattggagtcagataatccaaaaacttcatgtccagcctggaagatcctttagaaaaaattgtttttttctactgacaggagttatcagcacctggttgtgacatatttgacaagactgaacatc

SEQ ID NO: 42725 - DNA, 1009 bp, Homo sapiens
ccccttctcatcttttccattttgtcacatcctaggatattgtcttcctaatataactggagagtttattccagtgggaattgtacttgacatgctggtctccatataaatgatgagtgatttttatttcactctctgtggtgtcttgtggtttcaaaaagtgagcaggtggaaatttggagggggtgggtgtgttggtaaaccctgtgtggtgagttttgttttgcagccgtcgtaatgcttatgttcatcagcagttcaacaaaacacatttattaaatacctattgtgtgccagctattggaaatagaaagatgaatatggccacttttcttcggagacccagccagcctttcactgctggacaggctgcccatctggactgctgggttgttccagtggtagtgctggaattttaggtagtgctctgtttcctttggtaagtgaaagaggaatttaaaaagtataatgcaggggccaggatacttgattttctataaagggccaaatgataaatatgtaagcaaatattgagatttgtggaccaggcactctttgtcacaactattcaactctgccattgtagctgaaattaaacgtatacactaactgcctgaatgaatggatgtggctgtgtttcaatgaaactttattttcaaatgctgaaatctgaatttcataaagttttcacatctccaaatattgttcttttgattttctttcaaaccattaaaaaacacaaaaaccattttcagcttataggctgcacagaaaggccaggttatgtttactgacccctggtataatgcttttgttgagcattggcctttatactaattctgcctccttgtcttccatcgttgtctaaggaatatctgcttgaagacagctgatttagcattgatcaggtactgttttcctgaactctggtttgtgtggtttggcagcatggagataaacatggtattggcccagtgatcttaactcactcccagttttttagggacaa

SEQ ID NO: 42726 - DNA, 1915 bp, Homo sapiens
tcgggagacaaaaatgggagcatcgcttgagcccagaaggttgaggctacagtgagctgtgattgtgccactgcactctggcctgggcgacatagcaagatgctgtctcaaaaatagatagatagatagatagatagatagatagatagatagataggcaggcaggcagataggtggtagcagatacatactgcttagtagacaacttgcagacaagtcaaatgaatcgataagaatcgtcagaatgtagtatgtgacttaagatggtgtctgtcaggcttttttactgtaacagaatgttctctaatcaaataataaacatttcatggtgaggtgccttgaaactatataaaatcaaattaatttttatcaatatggactcttggtttgatactttattcagtgagttataatacattaatttttttgtttgttttcatacttaaattgtccctgatttggccagtgagagctcttaaagctagttcctgtgtccttttgatgtgtccccatccttctttgatccatttcttgctttgtgggatgaggcttagtttaaactatctccaggtcagccctagagtcagccattttgccaaggaatcttgttccttttagtagaaaatggtatctaaaagtcaagaccttgccatcagatatgctcattgctactggagtgttgcttgcccccagaccatctcagttgataagctctagagaatacataggggcatatacatccatacgtatatttatgtctgtatgtatttctgtaactccatatttatgttgcaaaccatatatccacaccaacacctccagttccaatccaacaccacagggttcagctagttttctccctttctgtatttgtaactcccttctccaacagtgagaagcctttgcttctgttacctttaatgtatttactgattttatcatttcccctgtgtgtaacaaactgtcgcatttctgctgccagcctctcctctaggaatgtaccctatagtgccccaatcaggaccttccttctctccccaggtgggcaacctgctcgacatacttgggctcttgtctctcccacgtgtctctcttacctggcttggtttcggactcctcatgacaggctgccctccctatggactcccctcagtccacttgggctctggcaccaacatgccagacttgctctggaaatgtcatcttagtcccttcatgatttggatttgcacttctttgacttatttcattcattaatcattaatctgtcttgtttatttattatgtgagagaccggatgaggaatggaaaaggaatggactttaaagggtgggctaattgtgtcggaaaccagccccatcactagttctgagatagtgggaggataactgtatttagttctctgtttgaatgcataaagtgggcaccataatgatgacttttcagttgttgcttggtaaatgaagttgaataagataacacatagaagacatttaacaaacattactgtctttttgtttgctttcaagaggaatctaatcacctgctcatagcctgttaagggcaaagtattttgtttgactttaataacactattaattttgaactttcctagctttgcctaggagaatcattatgtgccttgatgtcagtaagaaagattagttatgaagttaatgtataactttgcaagagtctaaaaaggcacctctctgccatacatttcgcctttctgccttctctttgccaacattaagggaagagcctccacaaacttttttcccttaacctaattatctttatatccagtagccctttggtattagcttttcatctgacttttcctttctttacttaagttgcttactcatgccttcaagcactgaggccctactaagtgctgggccatttggtg

SEQ ID NO: 42727 - DNA, 1034 bp, Homo sapiens
taaaatatatataaatgttacttaaaatcaagcatgtgaggctggacatgttggtgcacacttgtagtcctagctactcgagttctttgcactcagaaattcgagaccagtctgagtaacatagtgagacctgtctcataaaatcaagcatatgtgcacatcatatatatacattcagtcaaattaattttttttgagacagagtcttgctctgttgcccaggctggagtgcagtggcaaaatcacagctcattgcagccttgatgttctgggctcaagagatactcctgcctcagcctttcaagtagttaggactacgggtgcacactaccatgcccagctaatttttttattttttgaagagatagggtctcactttgttgcctaggctggtctcaaactgagcatgatttttgtttccatttatttctattaataataatatgatacttgttaaattgatttattgataattgacagcaggtgatcttttttttaaggaaaaacttacggacaaaaaaacccaggactattctatttactaacttagtttttggtatcattcttattttaagtagttatgaggatactttttctgcattatgtttcagaagcactagtattctagaaaagcgtagggccaggcagacatggtggctaatgcctgtaatctcagtatttggggagactgagggaggaggattgcctcagcatagtgagacactgtctctactcaagattaaaacaaatcagctggatgtgatggtgcatgcttgcagtcccagctactttggaggctgaggtggttgcagtgagctatgactgagccactgcactccagctggggtgacagagcaagaccctgtcgcaaaaaaaaaaaaaacaaaaaaacaaaaaaacaaaaaacccaagagaaagaaaagcataaattgaaacctactgacatacattgctgattcctattaatttcaaataatgatacaattttttatgggatagtatgtaattctaaactgaatattagcgatttcata

SEQ ID NO: 42728 - DNA, 1032 bp, Homo sapiens
tagcttgcaaaacttaatcgtcacttactcatcctacttctcatttttgttcatttgttgatggcattcctttatctttgggacattttatatgtaatgactaggtgtggtgccgttctcctcttctcagtatcccttcccccatccctttccactgtttaatgtagtagacatgaagaggagaagagctggttcacagtgtggtgagatttccaaccagatgcttgcatggtgggggcccagcttcctatcctggtcttcctgttttgtttcagtagatcaccacagctgccttcttatatgtgggagatgtgaagctaggccctcgaatctatttctattagccctgtcaatatagtttgataaaatgcaaatgtctttgaaatggtagacttccaattaaaaggctccagcagggagtctgttttgataatgaaagtgattaagaaggttctattttcttccattggtatgaatgttcagctaaaatagcttggctttttgtctgtaattggactctgctaatgaggttctaataactcttaggttctaataatgattctaacaaatctattaattctcttcattgatcagtgctggggaccagaacacagtctctggatagcagtgtcatataaggttgtaaatgtcattcatttccctttctccttcattctaaagaatcaatggagcaaatgtttatttccttaaattctataatcttatatagatacatcttacctctgagtagagccagacatatatggtatatcagtacgcatgttaggaattgccctcaaaccctgcagtttatattaggccttgaagcattggttttggtgtggaaagaggggctgcagaataaacacattcacagaagaagactaggcaccatctgaagcctaatttttagaacgttcattctgttcaacccctttccatacgtacctgtcagcccctggtaaaactaggcttgataattgaatatgccgcagctctttagccagcataatctgggacatagaataggtt

SEQ ID NO: 42729 - DNA, 1051 bp, Homo sapiens
attacaaagggattagagtggcaaatacctgttttgggtatgctcagtgactcagaatggccaccaaacttgctttgttatgtaagttcataatttccatttataattgtggccttgtcagtatagccgtctgaatcactggggacttttatggaacagagaggttttctatgatcttgatagttgaggaatgttttcaaatgaagggataaaactgactaaaaatttagagacgatgagtctttgtgtgaacatccctgtggttggaagagccatttttctcaggtttccagcttgtatagatggtgctcatattatctatagctaatcaaatagcagagttgtggtttttatttaaatatcagaatgacaaattacaatagaattatattttacccaggggtagaatctaaggtcagagtatgagacgaaaattgtatatagtgaaaattattcttgaaaatccatttagtgtcgttttattcaaactgaagtgcttcaggatggtcagatgcattgtctaggatcaggaacagtttatagtcaagtcctttctcttttaagtacaattgggaggggacagggctggatggataaccatcaatatttaaagttatttcccacctccctgactcctctcctaccttctttatctcagagaatatagttatataccaataagttaaatatgtgtatatggcaaattctttgtcttcatggcatctctggagtttataaatgaattgctcctggataagttaatgctgccatatggtttgtgtatcaggagactgaactggggatagtgaggtcttgatactgctggtaaaaatgttagctgctggcgtagaattaagagtggtcaagagagggcttgggtttgtttctcgaagcccaaaagtattaggtagagtgtttttttttttagaagtgacagtagtaaactccgtttcctcagggtgctaactaatcagaagcctgggctgtctgtccacaggtcagggagacggatgctcatctttgccaaagggcaggatgtaaacatgtttgc

SEQ ID NO: 42730 - DNA, 1082 bp, Homo sapiens
ttgagatggggtcttgctatgttactcagctgccctaaactcctgagctcaagcagtatcacccaccctcagtattctgttatatatagcaatgcaaaatggactaagacaacttagaagcagtgtctggcaccttgggagctatcaacaaatgtctgtcactgccattcaaacctatgttcacacacactttgcatatgtatttataaattaacaaaggaatcaaccttcagcaagactctacccagatctttcacacatcatgaaatacccaccaacgtccatgttaaagccagttttcatttttagagatgattaaacttctgcactaaacaacactgggcaccaagtgttttgtgactgggtagtttttgaagttcagtaggcttcatgaacatgtgactgttcaaaaaagcagtttgttgagtgaaaaaataggctttcatctagcagttttagaaggatggtttgggatgagctaaatgagatggggcaccaatcacaacaatatcaagagtaggtttctaaaaagaatgttgattgttttatggcattatgataaacttccactagttatcacagacttgagcattaaacagataaataaatgaggggcagggtggaaaaagtaagatttaagaaagacattaagtccagctgtgaaaaaacaataaatttatgatgtaaaatggtgtgtaacatcagagacaagattaatattctagaatataaaaatgaaaaagttctgcaaaatgaaatatatctttaaaatagaatatagaaaagtaaataataaaaaacccatacaaaagtcctaagaaagatacaactttatagccaataaaatagttcctcttatttaaaactaatcaaaggaggtacatatttacacatgtgaacatgatagtacctgtatatataggtgtagttaagaaattaaggagaagagagccttttgtgtgtgtgattccagttactgtgtcacttagacatccaagtacaggggtggtataaaacactgggtatttcttataaccaaaggttcaaagcccttatgtaaatggccagcaacaggagtgaag

SEQ ID NO: 42731 - DNA, 1028 bp, Homo sapiens
attctatttgtgctgagctcaagttttgttccccagagtgacattgtataaatgatgaatattgtatccctgagtagtgagtaggatgcaactcagctctgctgggctggaacattcctgatgcaaactgcttttcctgactcaccacctgaaaccacttgcctgtcttctgggcctgtcacttgccacagtgaacacccatgtactctggcgtctgggagcaggcagggcagttgctgcctcaggggagtggctagcacatcattgcacatttctaccaattcccttcagacctctgcagctgttcagcatggcacatggtgattaagaggcaccacgagggagcatgtgtatctatgtgcctgtgtgcacgaaagctgattagggcagcctgtcacagcttaagaaagataatggaggtaaaatcatcttctctgcctagactattatttgaccttctcagggattccataatatgacaattttgaggagttgctagaatgcagagaaataagactgaaggtaaactgctaaggtgttttgttggctttgatgacctccatcctagtttttggaaatggattcacttcctggatttaattctggattaatgcctttaattaaattacccatacttctcttggaggctttgtttcgtaatttgtgaaccgggactattacttgctttccttctctcatgaagttgagttatgagaatataggatgatggtagtatttcatgtttgtccagatgccagtaaagtatatggtttgattttgcttaatactgtttttatatagaatctttcatagccctactttttcagttatgatatattcctggttctgaggttatgagaagtgcatcagcgtgcgactaatctgacatcataaggagtatttttccctttctttgttggttctgctgactttattgccttttcaacccattgcatgaattccagtgttatttaattagatgtgcatgagggctttagctttcagaagatgagtatgtgctggtgcta

SEQ ID NO: 42732 - DNA, 1322 bp, Homo sapiens
atgacatctgttgtataagaagttgaataagaacagatttgaataactggtaagacaacagaaatgtatcacttgatggtatttgataaatattaatgcgaagtgtactgattgtggttatctttcacagataggagaggtctcacctgctgggtgaccttatgtatttaatggtctcagcttccagtcataaccctgactcttaggaataggaatatttcccctcctaacttctttctctgcttatagacttgccctgtttcttctgtctatgccatcttgcagattactatcacaattgctttcaaaatgcgtagacctgaccacgtcaccaactctgctgatacccatttgcctgcagaaaaaaaatctgattccttaaatgattatataataaaaagcaaaggaaaggcagctgtatataaaatattgtaacttcaagtgagcatcttgcttccatttccagtctgacttctggcattgctgtccacataatatgtcacaaagaacttctcaccattccatggacatgccaagccatttcacaacttctttccttcatacttttttttttttttttttttttttttggtcaggaatcttacctctgttctgtattcctggttccccatgtaaagtctggtgttctttgtcctccgataatatttttgtgaccctttctgttgtagtagttcccaggtctgaccttcctccccacccctatagggcaaagagcctctcttgtcttttcatcagctcacagttcctaagactgtgcttgacattgacaatgacgtcgagatcctcaatagatctttacagaaggggtgggatttgtcctctgctttgtcatatggaagatttggatatggagaaggcctgtcatatagctctgagctggggaaatggtttccttgtcacctgctttttaaatttcctcatactgttatataataatatagacttggagccctaattcagggagactttaggtataagtactgtctggttgaaatacaaaccaagaccttaaaaataggttggataaatatgttttcttttgttttgctatgtgtgaattgaaattgttggattattgctccatctgattggcagcatgcttgttgcctagtgtgaagtcttcatgagggaagctgagcagtcactccttagtactgtaggtctgatttggggcttttctgtgtctttttcattattgaaactgtgcatcattaaaaatcacagaaggatttactcaactaataggcaataaatactattttttggcttgaattctctattattattttaaagttctaagt

SEQ ID NO: 42733 - DNA, 1047 bp, Homo sapiens
gtagcatattttgtttaaagtgaccttgatatttaaagtgaaagagagatttgttgtgatttatgttatagagtgatgcattttatttactcatatcatagtcaacacttaagcaatgaaggatttgcgctggtattaaatattgagtatgacgacaacaaaatgaagcagaaatgctgctttattaaaaaatgtaggcaaactttttaaaaaagtaaataactacttttgtaaatgcagtgctatatttttatactatccttttcccatggtggtatctttaagtttccactgattttaaataatacccctttcaaaattaagtgcatattgactgcactaggtgatagaaaaaaatctgattttatatacatccacagcaatagtgttatttgtcatctcagaaaacttatctaccagttcttttaattcttcaaggaaaggcagttggtgctttgttcttgggaaagtattgaggttttattttgtttttataagccatattccgtgatgtagatgaaatctgttttctctccttgttcattggagacataacaagtgttcaaggccacctctgtggttttccttcttgctacctgattcttgataagttgtttattctaaggactgaagcaattaggtttgggatccatttcagctctgtatagcctagaatgaaaattctgatctttatccattttcattgtcccaattactttatcttttcttctcttccgtcacttcagcaagagtagcagtcccagtgctaaaaaaaagatggagtattcctttaatgtttgcacatatatgagactcctcatgcattcttttttttttcagcttgctttaaaaaatacttgatgagcagtggaatgtcatcatttttagtagttctaaccattttgctgttgtttaccatcctgttttcttagttcctgaccttggaaagctttacaaacctctaatcttcatcttctttgtgactaaccccattgtcttccacctcagatggtgtatttgccaaatttttggtctgttttctggaat

SEQ ID NO: 42734 - DNA, 1070 bp, Homo sapiens
ggttacatctaccagttatttgttttctttttaataatatcagcaattaacagaagccttaattattaactacaaaaacagttatttcttaacctgagtttctggccacagccaccatctacccaccatccatccattagaataaacttcaaacactaaggtaaagaattctagaatcatgttgacaaatcaggaattaataaaattcagctattgaattggtagaaggaactgaaaaataccttcaccaaactactgaatagaatatattttacatatatagtacagactaagggatttttccctcagtgtataaatttatcctcacacctgaaattctttttctgaactaaaaatgtatgtggcttatctttgtaatctagtcagataatagatttgaaaaagaaaatgaaggctaaatattttatttttgataccagggtttttatatcatatttttttcatatttggtttaagaatgtttacaaagattcataaaacatacgttcacagggaaaaatacagagagaaatcagaaccacagataggatagaggaatgaggctaagacttgtgccttaactgatactctaggaatgcccactgagttttaagcattgcagtgtggctggtccaaattgagatgtttgtaaagtacacaccagatagtaaagatttaatacaaaaaaagatctcaacacttttataatatttgttatatattgacacgatgttttagaaattttgcattaaataaaaaatcatattaaaattaatttcacttgtttctttttaatgtttcaacatggctactaggaaaatgtgaacatacacatgtgggtctcatttgtcacttattatatttccattacacagtacttgcctagaaggaggtaagtttaacatcctctcttgagagatgagcagttccacaacggctaatgtctgaattagcttggaggtaagctcagagcatgcccagaggcaggaccaacaggctccttagcaatttgttttgaagctcttcctgtacctcgatgaatgggtgattgatgtgtgttttaaaatgtt

SEQ ID NO: 42735 - DNA, 1056 bp, Homo sapiens
gccttcacagcacctagtggctttcctgttattaaagagaacagcagacttctgtaactacagaagagcttctctgaaactagtgattttaggggactgagaagaaagaggcagatgagatggtgtctcttaaagggttatttcaaagccaaagtttagatgcatttcacatgcagggagtgtgaattgtctgtatcttctatagggtttagtctaatccttttttcctctcgatgtatgggaaggagtcgcatcacaggatgctggcagggccttgctggtgtgacataggcttcagcttcctatctgtttcccctggggaatcaatgaaaacaaggttcatcattcctctaatagattaaaatttttttcttgattaacttcactgtggagttggcaagagttgttatctgttaatcaaaactgtttaaataaaaaataaaaagatcaaactttgagtcttttctcattctctggttcctgggttgggaattagctgatcgttttaggcctggtttgtgacatgaggctgtcaagatggcgcttcctgttaattactttttattgtatttaagacacttaaataactcttcttatgatttagtcgtctatgtaattagctgcagtgattaaaatctccttctttcgttcttgccagagccttcttgaagagtgagattttctgaggtgacctttccctgtgctggacttcccaattactttgagctccaatttggcaaacccttagaatctattaactccttgcttatgcctttctgcatatcacgttttcaaagaaaagtgttagaagaaaatgtgttcacatttagaaagggacatctacaaaatataactagggtaagccacacagatacacacactcattctcaccaccacctcacccctcatccatggaaaactgtcacatatacagaagatacagtcactaaggcacttccctattgtttcccattatgtgaagtatttcaggatgataggaaacaatacacatggcccattttgtgaaagttaaagaatggcacagagatggaacct

SEQ ID NO: 42736 - DNA, 1047 bp, Homo sapiens
tttcataatggcacccttgaatcctacaaatcagcaaaatcctttactgaagtatgtgagagcttcttcttttcccctttttgctttttatactgtcagttgagttgagtgccaagctgtggatggatgacttgaatatttactgcactgatccttgggaagctcccccttgtcagtttcccaaagtgtaccatggagagcccaggagagagtaaggcttttccccaaatctgtttatgttgtaacttttgcttcatgtctcattgtaatgtttctctaaatattttaaaacttcctttgctttttttcttctatattcaaggagatgtcttcaacttgatctttcaggttatatgcttagctagacagctggccaatcatgcatattgacttattttcattcatccacactctcttgtttatttattcatatcacttattcatttagccactcactcattagttcatttatcaagtattagtggaatgcttggtatgtactaaggactgtgttaggcatcatgaatatattggtaattctaaaactgaaattatttctatgcttataaaatttacagactattcttttaatctagcccattttattgatttttctttcagcatttatatttaaatttttgttctttaattgttctgtcttaatagcaccctattcttagtttatgaatacaatttgtctctaatatctctgagaacatttaaaactaaaagaaataacacgcttggctgggcacggtggctcacgcctataatcccagcacttaaggaggtggaggtgggtggatcacttcagcccaggagttcgaatccagcctgggcaacatggcgaaacccctgtctcaattaaaaatgcaaaaaaattagctgagtgtagtgatgcatgtctgttatctgagctattcggaaggctgaggcatgagaatcacttgaaccctggagatggaggttgcagtgagctgagattgtgccactgcactccagcctgggtggtagagcaagactcagtctccaaaaaaataaaataaa

SEQ ID NO: 42737 - DNA, 1058 bp, Homo sapiens
aatagaactcactggagcatcaggcttggaaaatagatggagaacagggctcctgcaaagggccaagaagcaggatgcagatttgttgtcttaattaggagcagtctggccaggacaccctcccttatggtgtcacaggggcaggacaccactgtaaatgaaatttgactcttccctctattttgtattactctccacgcagaagcatttaataggcagagactctgtcatgtgtctctgccccacctgccagggacagggacagggtagtcatctgatgattttcatcttctgtggtgtacagcttagcattgcatcctattaagagtacaacagtgtgatatgttaaaagggagataacagttgactgttacatccattgtttaacatgtgaaagttgactttcaaacacatattgaaagaccatattatgcacaaaagtatgtaatgactgttatcattttttgtatcaggaccctttgaggttactgacttgagtccagagtctaggacagtggtggagtagagaaaagtcccctgagtgactacacaaactctcaattcctactcccgccatcaatgacttgagagaagctgagggtgttttttgatacttctattcacactccccatactgatattttttgtgaaattttgtttctcaaaggatagaggagcagaaaaaaaaataaggaatgaaggaaacatacctagatctacaataaacatttctactttacgttggaatatatcctgagaaaaaagaaggggtcatcagacattttcgaatcatttctcccatacccctcaaaaaaatcctctgaatccccagaaggcctgcaaattattgtaattaaatgtttaatatataatttagctaacatattagaactagagtgctcaaatttacaatatgtggatagattatttttaatatgctaatacatttttaatgtattaagggcaacctagataattcatgcacacagtatacttatttctattttacagaattataaaagcacagcagtgtaataaagggaaacaggctaagaatc

SEQ ID NO: 42738 - DNA, 1147 bp, Homo sapiens
acaggagtgtgaggtttatggcttagaacgtaagataccagcctctgtagtggccaaataagccggcctttttgtttgttattacagatgggttttgatgtcaaggtcaactgagttttgagttgtccataagatggacagaacatctgcatataacaccaactgaatgaacccccagtttgtctagggctttgataaaaaatttggccctctagaccgggcgtggtggctcacacctataatcccagcactttgggaggccgaggtgggaggattgcttaaggtcaggaatgcaagaccaacttggtcttgtagtcagtgtagtgagaccccatctctaccaaaaaaaaaataataataaatgtgtgtgtgtgtgtgtgtgtgtgtgtgtgtgtgtgtgtgtgcgtgcgtgttgacccatctgcgtctcttacacctatttttagggtaaccactaaaggaagaaaattacatactcccaagctggtaccttagatcctgaagaagttactggttttttgttatttccaatttttcacagagtaggaactgggctattagaagtaccagccactgctgccatttctatcatagtctagtttcctttcaagccagggtgttccagagtgtgtagaaccagctgagaatttgaccgacttggtactaggtcttacttgatttgaaggatggttctgtggtgactgacttcatacatacatgttttcattattagttggttttgtttttcattgatcctgtctgagctccctccctcaccagcatagaaaaaattggagtatgtgtgtcagtgttctttatctcaggtttctcagctgttctttatcttaggtttattattgtttttgctgtagcctgctccgtaataaatacaatctcctgcagatacagagtgtaaaacaggcaataaaatggggctggtacatggcttactgttgttctggtagatcagacaaatcaattatggttctgagattagagagagctccccactcctcaagttgcagccagccctgcgagtgctgattttaccatttacctttacctccacttctccatcttcctcttatatgggagtaggactcaatgagtcatagtgtatatctgagttttcttctctgtccttttc

SEQ ID NO: 42739 - DNA, 1054 bp, Homo sapiens
cgcgcccggccaggtctttttttcttttttctttttttttttaagagagaaaatctctgtctcccggctcttattaaccctggaaatgtgtctaagagactgaagcacattgctacttgcactctctctttggaaggcaaattacttaactgaattctgtcaattttatattgttataatcagaatttctaaaataaataatttccataactaaattaccagggaggatttatagctacatcgcctgaggaaacgtgccagtcttcctaaccagtgttttcatttgagccactgaaacaaatattaaagatttcaagaatgtttgaaaaggaacatgccaagcaaaaaaatgcttgagatgacaaggaaagacatacacttttgtgtggctgtgactgagatttgaaagtgccgacatctttgggttcttataatcaatttaattgactttataagaacttaatattctgtcagcttggatgaaatatccatctttccacttagtgactggtccacaggcatatcacctcatccaagccttcgaaatacttgcctcaagaatatggggaactccatgttcttaccttataatttttatctggaaataaacatggccagttctgatgaggttttaaaatttgctgtatgcctttgattttctttttctttttttttttttttttttttttgtcggagtctcgctctatcacccaggctggagtgcagtggcacaatcttggctcactgcaagctccgcctctcaggttcataccattctcctgcctcagcttcccaagtagctgggactacaggtgcccaccaccacacccggctattttgttgttgttgttgttgttgttgttgttgttgttgttgttgttgtacttttagtagagacggggtttcaccgtgttagccaggatactctcgatctcctgacctcgtgatttgcctgcctcagcctcccaaagtgctgagattacaggcatgagccaccacgcccagcctgattttcatagttggctttcacttctgatctttgccataatcaatg

SEQ ID NO: 42740 - DNA, 1060 bp, Homo sapiens
aatgagcagagaaagttatttcatgaaatggaatctagtcccggcaaagatgctgtgaacattgtagaaatgacaacaaaggattcagaatattacctaaacttgatgaaacagcatcagggtttgagagaatggactctaattttgaaagaagttctacagtgaatgaaatgctatcccacagcattccatgctacagagaaatactttgtgaaaggaagagccagttgatggaacaaacctcattgttttttttgccacagccaccacctccatcagcaaccaccaccctgatcagtcagcagccacaaacatggaagcaagaccctccagcagcaaaaagattatgacgcactgaaggctcagatgatcattagcattttttaacaataaagtgcttttattaaactacagtatagggtgaacacttttatatgccctgggaaactaaaaatttgtgtgacttgctgtattgcaatattcacttcattgcagtggtctggaactaaacttgcagtatctctgaggtatgcctgtatatattcatctcatcctctgctctgtagcatctcatcttctgctctgagaaagaaaagcatccttttggcaatgtagagctttatcccagaggtgaaaaagagaaacagtattattcttcctgggaaacatggccacaaatgtataggggaaagagaacattgaagttttgtcttttaagctctaaactacctgaatggagccggctcagagcacagaccatcttggctggagttttcctgcagaattcttctagttttacgttgcttagacacaagcagtctgatcactcgactctgcatcagccagttcctgtgtgtatttggcattattttaagcttagcaattcaaaaggcattgcctgagttaacttacattgtgaaagatagattacacagaagcaaatacgtgataaaaatataagccttttacatttttctcctgccatagtgtgtgctgttatattatgcatcttttggtttcttcagaaacctggcaagaatacaggacagggaaaagtctt

SEQ ID NO: 42741 - DNA, 1032 bp, Homo sapiens
gttgggccagagaatttgcatttctagcaagtttccagacgatgtcaatgccagtgatttgcagacccctcttttgagaagaaagggcctagacttccctccccctttttttttcctctaggtttgggaattacgaaatattcattgtatacacaatgcgttaatggctaagagaacaggttctggagccagtccccacctagtctaagtttaggctccctaacttgctagataaatgaaactctcagtttccgcattaaagaagtggagaaaaaatagtgtcattgtgatcagcagatcatccttgtgatgtgcctcttatccggtgacacagcatttgtatgatgcaaagaaagccctaagtggccatttcgatccagtacttgatacatgaattgaatcctgtccacataaatgctattgtctgggaaggcctttgccttatgacattttagggcatatccttgaaccaatactgtacatgactttccctcccatccatgaaatgaaactacagtcctgttacattccctccctcctgcccagattcgcccttgtttggtaagaggtgcagagctcttagtgtgcatactaggctggtctgtcattgtggccacatcttacagagatgtaatggtggctgcagattaaatctcagatgtatataggattacagactcttaaaaaagattctggactgcatactcattaggatggctactatcaaaaaactaaaagatagcaagtatgagcaagaaccaatttattattttttttaatccccaaacatttgatatgcaagcaagcaccatttcagaacaaatctagatttggaacccttgtgcactgtttgtgagattgtaacatggttcagctgctatggaaagtagtatggagattcctcaaaaaaaatttaaatataattaccataggatccagcaattctgcttctgggtatatatccaaaggaaatgaaatcagtatcttgaacagatacttgcagtcccctgttcattgcagcacttattcaca

SEQ ID NO: 42742 - DNA, 1026 bp, Homo sapiens
aagggaatgaatatagtcaaataaattaagccttgaaacccaaatagtgctgtgtaagcaaactgactgcaaatcaaacagaggagtgttagcaaaagaatacacgatcttggttgaggctgaacaaaaccaggttctttgtatatacgtatatatttctctggacgtgtgcagagttgttgcatttctactcccttaatctcagacatctttggcaaaatgtgttatctgtccatgaagaagaaaactgaagagtgtatttcccccaaatggcaaagcgtaggctttatcaaatgtagacatgcctgttggcaacagaaagcaggatgtgtatggcttttctgtctttaggaatgcccatgtttcctatgtttcttaccatttttctggctagcatataaatctgaaaggttaggttatggtgtgggtcataaccatcaggcccagtctattctccatccccactctgcaggcagctctgacactatttctggagcaagcattgaaaactatccgactgtctggttttgtagatgaggaaacagcacaaagaaatggagtggcattgtcatagttacagactgtgtgagtggcaaaacagaggcttcatccactggactttcagctctacaacttgcaatcaggcataacatgttcttaacttgcctttttgaaatgacacctctctgagccaaagcttctctaagcatcagttcaaatgactccatgatctcttagagtctgtaaaaaacttgagagtagaacatattttcttccttcttagaacctcaagtcaaatcaacaattactttatatttattgtgatgatcgcattctgtttgatctatttttctctaagttgttaaacagcctttggctaaaatcattatgttctgacctgaacaaggagattggggcagctctattctaagctgtgtgaaaatgcaaagcatgggcagggtgcagcaagttgttcactttggatggaatgtggatggtggctgagtacccagagataagactaga

SEQ ID NO: 42743 - DNA, 1026 bp, Homo sapiens
tctctataaataaataaataaataaatgttttaaaaaataaaaatcctgataaggccccagtgtggattgccatcacctgatcgtctttacaggaccacaaaagcagtgaattcaaatactcagatttattcattctttcaacaatctttaatgagcttcttcccagccccaagccaccctttgcagactgattgttttgctggagttcagcacagagttatttcgatgtcacttttccctgtggctcagtttctttgctgttggggtggtcaccaaccattttacaaatcttagaaggctataggctttctccctagaaaatgccagatagatgaagaaagaaaaaggtttgtaaccagcaaaggaaggagagagggctgtgaaaaagcatcgttattcagaaggataaatagtttattatggctgtcatgtctgctagaagagggacagtggttaaaggtaagtttggaaagtcagatatcccagtcttagaagggccttgtgtctgtgcaaggttgtttagattgtaccacatagatcagttgttggtgacgctgagtcttagacattctcagtaaataatgaatctgaagagtacaaggtaatcttctcttcagaaaatacatacaaagatgttcatataatttcactgggtttacaaacaccagcctctctcccctaagcccattcttgacccctagtttaggaactcctaaggtaagttatcagaagcaatgaaagataggtgatacattgtcattaaaataaatttaaatgtgacttatatacaataaagtacacaagtcgtaagtatacagcttgctgaattaatttttttttttttttttttgattcggagtctcactctgtcgcccaggctggagtgcagtggtgcgatctcagctcactgcaacctctgcctcctgggttcaagcaattctcctgcctcagcctcccaagtaactgggattacaggtgcatgccaccacgcccagctaacttttttgtttttttagtagagacca

SEQ ID NO: 42744 - DNA, 1043 bp, Homo sapiens
taagctaattctgattggctcttttaaagagagcaggggtacgagctggagtggcagggtgagtagtttggcaggaagggcagttacagaacaggtgactctggatgaataagaacagagcaggtgaccaaggatgactaagatcagagcaggtgatagaggctaggagggggttgtttactgaaactaggggcaaggagacataaagaacgaggaagttaaactttaaaatgaagaacaaagaacaggggagctgaacatactgatatattggttctttggaaaggacctcagaactcattgtacttaacaatttacaggctaaaacctttgaagaggaatttattatatcctataacatgtcacaaatattcttcttctgatttttgtcttaaccattcaaaaatgtaaaaatcattcttagctcatgagctctgtaaaatcagtgggcagacttagtcttcaggaagttgtctgttgttccctgctttagagtatggtaactaaaaaataaatagatgaataaggcaaatgccattcttgacccacagctggcccaggattcaagctactcaggataggatatatgtagcttggcctgtgctcttggagaaccttgacttttcacaattcctttccctttttgcttgctttattttattttattttattctttttctttttttttttttttttttttgagacggagtctcgctctgtcgcccaggctggagtgcagtggcgcaatctcggctcactgcatgctccgcctcccgggttcacgccattctcctgcctcagcctcccaagtagctgggactacaggcgcccgccactacgcccggctaattttttttttttttgtatttttagtagagacggggtttcaccgttttagccgggatggtctcgatctcctgacctcgtgatccgcccgcctcggcctcccaaagtgctgggattacaggcgtgagccaccgcgcccggcctctttttctttaaagtaaagttagtgaggtgaaggactcttgctaagagtttct

SEQ ID NO: 42745 - DNA, 1030 bp, Homo sapiens
tgcagtggcgcgatctcagctcactgcaacctctgccttctgggttcaagcaattctcctgcctcagcctcccaagtagctgggattacaggcctgcaccaccatgctcggctaatttttttttttgtttttgtatttttagtagagacggggtttcaccatattggccaggctggtctcgaactcctgaccttgtgatctgcctacctcagcctcccaaagtgctgggattacaggcatgagccaaccgcgcctggcctggccatgctaattctttcatgtattgtctataactgctttcatactataacagccgagttgtgtagttacgacagaggctatatggcttgcaaagcctaaactatttacgatctgttcctttaccaaaaagtttgctgactactgctgcatatggtatgctgaattgggtttaaatggcttgtaatagccctgaaaatttaagttggctctcctgtcccctgccgttgaggctggactgcatgagattattgtatctgttggctgtagctgtgactatgagctgagtgccatgtcccattggatagcatgtacttggtgacccctgacccacatacagctgactctttaaggcagttccctgccacacagtcaaggacaggaagatctggtgtgatttcccagatggggagttgtgcctattactagcatcccccagaagtagtgagagatagcattagctaatgggtaaataactggcttaaaagtgtaaactcctaggttttcacactccagtttttatgtggtcctggatatgtgattcttttctgccttggcattcctgtctaaaacactgatctagcaatcccaagccaccctttcctttttgcggcccttgttctgaataaaacagtgatttcatgtctcttctcactttcttccagaaggcagctagccagcacatactcactgaccagttgctgcctgcacagcagtgttttcactgctgtgttggagaaacccgaagtcttaaagggccataaggtattat

SEQ ID NO: 42746 - DNA, 1050 bp, Homo sapiens
gtccttccatcagttcccacagcaccctgtgcatgtatctgttgtgcacttaccaatagtatacaagggatctatgacccaagtctctccccactagcttgtaagctcctcacagacaggaaccatgttttgtctttgtactccagtgcctagtatataagagatactcaataaataaatatttgtcaaatcaactaattgattccttgtgacctaattctagagaatgggaagaaggcctgttattttgttgtcctttatggttctttaggaaagctctccaagcttggcatttgtcagggtgggaggaaaactgttgaagtattaagactggacacatggctgctaattcatcagcttatcattgaaaaagtccatagccaaaacctgactgtgcacttactataggaccctgacctgcctgggtctccctgtctctccagccagtatatttaaaggtaatgagataatgatgagtgttttgaaaaatgtttagtgttcaaatagaaaccattcgtgtcccttcactctctgaacatagtctgcaaatctctccctctctggtatgtttctgttttgtggattagactgctaaataagcgaagagttaattttgaagttcaggtcaacaaattcctgtttggagacgggctgttcctgaataccaggttgttatctgtctattacagccccttcacttctgggctcctggccctttgcgaagtacttcagaaagcctagagagaagagagggccctcaaatcccattccagcccctaaatgaaagtggcatcacaaggagaaaagtggaggtagaaatgtaccatgggggacgttgccccattgcctttcttcccctgactactgggcttcctctatcagcttttaacgcctggaagtagctgagtctccagtcactggtggccttccccaagtgagctcagcagcatgtgctaataggtgccaatactgtgctggctccagtgggattcctctctgcaaagctgctggcttagcttgactgtttccctattcctctccttagaactt

SEQ ID NO: 42747 - DNA, 1025 bp, Homo sapiens
aagagatcaatagcaattcaccttttcccttattgattcaagtgatggcaagaaaaaatggcaggcagtaccaattcatttgtcatgagctatccatttcctaccaagccaccagtgacctctcccaatgcctgttaggttgctgatttacagttgggattacttctttttccaacctgctttgataggaatgagagaaccactgtgtttgactcctgtaatcaaagctgggtgaagaaggagactgcaggtactgaacaggaaaactgctgtggagcctggtctccaactccgaggcttgctttatttgaggagctccccacctgtgctgggctctctagcagaggcaatacggcatcagctgatggagctgcagtctcccccagcacttctcaagtccccacccccagcccccgacctttttctaaaggacacagccttcctttgttatctttttccacagaatgtaaaatgagtgtgctgagtgaaaagtccatgacccctgtgaactggctctgcttttgccaaaggtgcaaaggtttgtcattcccttcatgagccttcaagtagtaacttcagctgaccctgggggaatgtgaggtgcccagggtctggccttagcagggctgtgggtgaaggaagtgttcttgttcttagagggttctgtatccaccaggaatgtagagtggagacagttcttctcagcttctttttctgccctagagaaacaagcatgggaagggtgcgtgcgtgcgtgcgtgtgtgtgtgtgttcagcctcactgggaacagtatcttgactttcacttggaaaaggtaatggtggatccttgtgtgtgtgtgcgtgcatgtgtgttttgaccagcctcactgggaacagtctcttgactctcatttggggaaaggtaatggggtatcctccccccacctcccaaataggacagttagctgccacacacttacatgcacattttaaaaactgtgcattgcgaatggcaaatatgtattagttcactcacctggtgg

SEQ ID NO: 42748 - DNA, 1022 bp, Homo sapiens
atcaagtcagacaaccttgtccttatccttgcctccttttctcctgagagcccctagtcaatctaataccaagtgtttcccactcccagagagaaaagaagggaatggctttggatctctggctaaagatcacagactgcggagtcgtcactgttcccactgaacatctgattaagttgctgagtctgacccttgagtttcccagaacttgccaagattcagaattcccagatcatccaggcagcacgctcctgacagtctttggtccttttggcacctgaactgaaaatcccttttcccatagctctttcaacacttgttgaatgcttataatgaatccattcattaggatgacacagtatagtggaacaaagcactacacctgtaatcagaaatcccatgtttaagtcctgactcttccatttactatctctgtgaccttgacaaaatcatttcacctccctgaggcttcatcttccccaataaaaatgagtgttttggactaaatgacctgtgggtactaagaggatgaagaaaagagagccagagaaagaggcccttattgcaaagcctgtcttccacatagcctcccccttctgatgtcagcctgcatttaaagcagccctttcctgaggccacggagaggcttccagtgagtctagttaccactcaccccacccacaggttgttcagcaccagagacaccatgagccagactgcatggcattactgcctctggtggttattgtactcatgtgaacctcagggaagtcaagactggtcccctattactttggcatcctcagagatgccgtaagaaggcaagaggttccttggcttaggcagtgggtccataaagcaagaggggttttgtagttacctgaagtatgcagatctccatgctggctcaagggctgtttgccagccttcctttacccagtagtcactagtcactgctccaaggattggccccagccccccagagcccctgtggagccgccaacactgcacagctcacaaag

SEQ ID NO: 42749 - DNA, 1084 bp, Homo sapiens
atcatgtgtcagagtccaggaacaacaggtggacatggcacaatgctaatttatggcctcctgtgaatacattctctctgctttaccctcccttcccacccccctgctgccgcaccccttcaggggcctcctcctcctgggaaaccctgaatagacacatgccttgcagagtgggttaagcccaactgcaggaatctggtgcaatgtgaaagcattagactgagagctacgccagctcccgtccttctctgctcctttctaagcaattctgtcaggcaaggcacatgtgtgtccagtgcacagacccccaagacttgtgcacatggacaaagactcagcccctttaagggttcgtttgaattttggtggttttcctgcttaaaatacatgtacaggtctatcttccccttagcctctgaagaaaaatattattgccactatcattttggcacagtacaaattcatggtgctttttttttgtatttttttttaataagataattctgcaaagacagctctcggcttaagaaagatgtctgtagaaatggatagtcctgtgtcctatgaagcatcttctaaaaaatgacagattcagtctatccctcttgccccctcagcagcccacaccctacctctttaaggatgtttgttgttttagtttattttatctcagcaatttcaaccttataccagaaatcccttctggcagcatagcaagttaacttgtggcttgtaccccacaacgttcccaagattcccccccaccccctttaaatagaacttacaagttagaaaatatttttgttttgactttttgtctttaaattttaatataatctgttttttttaaccagcccatagacttaatatataagcatatacaagaaaaagtctctccccactctgtacaaaagttgctgtctttgtgtgcattctattgcattttataagttttttgggggaggggagtcatatttgagtttcctgtaccttgtccttggtatgggtctgaattatataaggttcagagatagtggtgactgtggggtgcagagagttccccaggctgttttctgtccagtgg

SEQ ID NO: 42750 - DNA, 1174 bp, Homo sapiens
gtctctctgtagctggtactcttcatcccaccccttcccatctttgagcaaaaggacaagcactttaccttaagagcggagggggccccggtgcaggggctcctgtctataatcctagcactacaggaggtcgaggatgcaggatcgcttaagcccaggagtttgagattagcctgggcaatataatgagaccccccatctctaaaataataataataacaatttaaaaaataagaggtggagggcagcgcagcattgggaacaccgggaaaccagcccagcgcccacaccactggctatcccatgagtcatcaaacaaccaatgggtgaattggctaacatccaggttcctggatgctgcgttccttttttattatgacttgagcttcttcaggagttagatctatcaagcctccaatctgctcttgctccacgtttttagaggcaactctgtctgcaaatgcttccagtggaaaatcacctttatatctagaggaattggggataggtgaacatgatctaaacgtgctagaactctcagctcctctatcagatttagaaaggatgagaatgtccccagtttgttggttggctagttggtctattcatgtacatactctctcacatttacatactgagtttctctgatacagctctgaatttggctagaactcacaggtagatttgtttgcttatttctttttaaccacaggtaacatgaccaccttgaaacttgttctgcctcatcccaacaccactccaagccatgaatccccatctttcaatgtttacctcactaccagccaagaatgctaagcagggtgttctggggaacctttcatcttggtctactttaaactgtttctctgatgaacaccagactgaaatggctctggttctgatggggggtgctaaatccccagcctttgtgcagctaccagctggggatctgaggggtctcctaccatgatgcctagacactggcagcctggctagaagagctctcattctctatcactttcttggtgactagggccagtttgtatggcagcccagtgaggctactcgatttgtattcagtgcacaaaccctgaaaaaaaaccctgccagccagcaactctgaaaggatgctttgtgtgagtgagcagtgtctgagatggacagggactctcct

SEQ ID NO: 42751 - DNA, 1044 bp, Homo sapiens
tttcaacctgcagattttttcactcttctcttcccaactcagcctgaattttataacaccgtggaaggctccacaattgatgaagtcaagtctgggggacttgatccactctgtcaagtgccccagaagattttctgtcttctggttaaaagaaacaagtccctgctccaccatgttgttatctcccagcccctctccttcctgtcctctcctctcttaactgctctttccccgaaactgcccccactccatccctccaaggcctcccgacaaggacagtttcctcttcaggtgccattctgacatgaagcccaccagttccccctcttcctttcctttcctctcaagtccatcatagttctaagagcactcacctccccaagcaccacctgtcattgataagaccagaaggcttgaggagcttcaagtctagtgaagtgtcagtgcagcaggatggcattatggtcagcagcgtggaccttggaatcagagacctgtgtttgaattctggccctgtcacttaccagctgcatggccttagacctaaaccacttaatcctttaaccttcagggtcctcatccataaaatggggatgataatattatgaagaattatgggaagaaattggctagagtgtcccagcaacgtatgcaggagaggatagaatgatgaggtccagggtacagtggatctctggggcagtgtgaaggtaaaagagattctgagctaatgtcttagaatcatcaagtgaaagcttggctggaattggggaggctggggtaaacgcccacaaaggaaagggttctcagagagcactgcattctgaataaaaacagaagtgacctcagtgacattctctgtctaaggcaggtagcctcagagactgcatggttgtttccactgggttttcgtaagaagactgaaccagacatgcaagcactcgcttacatgtatgtgtgtgtaaaggagacgttaacaggacaagatatggagcacttaatttacccagttctccctcttctttctcacctccctctttttag

SEQ ID NO: 42752 - DNA, 1111 bp, Homo sapiens
ggaggaagcattgggacagatgaccttcagttcagttggagtgctctggaactcactagggctttctgagggcaacatcaggcccagaggagctgccaggcaggacggaaggctggggctgccagtggtccatttcttctgcctggacttagggattacaggccatttatgtccagctctagctcagtgccccagctttagcctaatgcccatctcagctgtctggacaagctcccattctggcagcttgtccatcaaggttggatctgtctctcctcccgtttgtgactccacttcattgccacagcttgtcttcccgcccaggaaagggtatttggaagaagctccatcctgtctccttttccccattggtgcaatctcctcctagcagcatctgctgaaaggggtgtagtcatcctggccccagacagagctgtcttccaagtcacggatgttgacgaggcctgtgtgtgtatctgcatgctcacaccgcagcctgatcgatgcctgtcagagctcagcatcagagtgacagctgcataccaggctgtttgctgaacacaactcgtccgtcaagggaaatcagatgaaatccatctccttgtccaaagcctggcccgatgggctgtgtctggaatgccagtcttgtgtcccaccctacttttgtgccctgaaaatcattccctcggatttcagtgttacttcgatgggtcccttggggcagaaaaattatagttaagaaaattatgtgaaaagaccaatagtcagccctacccttcagggacttctagtttagagctggtacctactgtatggatagtgcaagtctagaacacacaagaattggcatatgattatcttaaactggttggtataaaaatagagcataaatcaaatgcattgaataaaaaaatttgcttacatatattgaataggcattagccagattaaatagtgtgttgcagacaattggtggggaagggtctctttagagagtctcattagagacacaattatggggttttaaggctttcagaattgacaaggacaagttttggcagaggttctatgtttgtaaaccatttaggactgcaggaagctctgtcacccc

SEQ ID NO: 42753 - DNA, 1933 bp, Homo sapiens
tttatatactctgtggtgcacaactggggcttcagaaaagatttcctggaggaaggactgccgaggctgaatctataagaattagacatctgcccagccaaggggagaggaaggacatgaattccagtgagagattcaaatgcagcagttaggaatagcatttcgtcgctggtaatatagaccaaaaacagcattcgtttaacaagattaaagtttgcttctttctcataggaagcccagaggtgggcagttcagaaccaatacagtggcacctggtatcagcagggatccaggccccttcattctcctgctcagcatttcttagcacatggcttacattctcagggtccaaggtgtctacagatctctagccatttacctcatccttccagtcaggaagccaaaacacaggaagaaagcacaaagatagcaaatgctttcctagaagtcccaccaagaaatttctgccgaatctcgctagtgtggccagtgagaaacaagacttggggattgtagtctttcagctgaccatactgatgcatgcaataaaaggaacagaaaaaggagagaatggagccagggagatagatctctaccacacacagtgtgtccaaaggcacagagatatgaaacttcagtgtgtgttgagggaacacagagatcagtcgacccagatcaaagagtccctgtagtataaggcaagtaggaggtggtggaaatgagactagagacacaaatccacatttccctgcaggtactaaaagtgaccagtgctcaggctggggctgggcaggcagcatctaccaaaggactagtcccttagcctggctatcaggccaggattcacaacctctagttcaccacaccctgccctctctcagaggaaagctcccatgtagttctagaaatcacagagacctgaccccttgccagtgctaggcaaacaagctgggctatgcatcagccaaaggcctgcagtgttctcttagagaacaacagagctcagtcactctgtgacctaggtacactcaacatacgtttctattctcactacatgtgcttagcacaatgagatgagccaacagttattgagttcttattgttctaagagcttgatatatattaactcatttaaaccttgtgagggagatgttcagctttattactcccatgttacagcttgaagaaactgaagcacaaagtcttaaaataactccctccaggtccctgaatggcagaggctaaatttgaactcagatagtctggctgcagagctctcactgggtacctctgtgcagttctgccaattgatatcaccctgaaatcaagaggaaaatgttggactagaggcaggtaggtgaaggcaggaccaggcacaaagcattttgcttctcttttatgcagagaaggattgaaaattcatgcatctgaccacatctggtaaaggctgggccttcagcctttttctcctctttctgactcctttgatcgctcttgtaaacattctgactctagttcagcgtggtccattcacaagcttccacatgcatcatttcttcccatgtcattctcccagccatcacaggatttttatacatgttgttcaggttcctctcgttccgtccctccttccctcccctccttccttaaaaccagcccctgattcctccatccccgatctgtctcagcaggtgggtgggctctgactgttccccttgcccatccttcaagtcagctctctccagcttttcctctgagctgcttgcaccttctcctggcttctgttctccccgtcatcccgtgtttctctaatgtctacttgcacctccactgacctcagcatggctttctgtcccaaaattctaccctcgttccttcttctaccctgccacttatgcactatttctaaagtgtgaccctagacattccctat

SEQ ID NO: 42754 - DNA, 1037 bp, Homo sapiens
ccatccctttagggcttgggtacagctctaaagccatagaggttctttggctgggcctgggagaacatgggccactgctgctgactccatggcccaaaccagtgttcaagataaagaacggacgcaccgaatggaaggcagccttctctcctggttttttgcctgggactgcccttcacgtcaactgggaacatgaggaggagctgtgccattcaggcatgcctgctctggcttgggagacctttgggaagatgggtccgggacagaatgagggccccctgattctagccacatccctggcaccagcctcagggaagagtgttaaatctccctccagcttccagcacgggtttttcctgggaagatgaacagtctgcttccttattgcctgcaccaaaggaacagattgcgtcagtttgtaaactgtgttagcgctcgcaaaggcctggagtcagcaggtttgcatttcccagcagacccagatgatgctgatggcagtggctgctgcctcactgcctcaggcaggaccgaagctgcccccctacccctaccatcccacccctcatccctgaggtagggaaaaggcattccaggcgggagagaaagccaccctgagcttctagagccagctcacccacagcacaggccttttcttttcaggagcctcttggcccctcttgctggtgtgccagcccaggcctgatttccaggcattcctagcactccaatgccagaaaagaggttttctagaaaagcaatccactctgtgggctgcgcttgaaagagttacctggtctggaggtgatgggggattaggagcagaggcgtcagtggggatcagaaccacattgccacagtagcacatggaaaatccgtgctgctgcctgcctctagccagcccactccccacggttgcagatggtaacgagacccaggaggtattgcataggcacagcctctcgccttccacagcatcgccttattaattgcattgttaatgttcatcatctctgaaagaagtcggtgtggctgtgtgt

SEQ ID NO: 42755 - DNA, 1724 bp, Homo sapiens
gggttccctgccaggggctgtgctgaactcagcatcgttatttactgcacagtgggtttgtctgaaagagcccaagtcaccattttgctggtgccacttgatgacgctgaggagtaattaccagtgattaattacttacacggcctgcgtgtttttattccagtccaattaaaatgcagtgcacaactctcagtgctagggcctgccgcctcctgggtccctctcctgcaaatcccagtctgctcgtcaaggatcctgaggaaccgaggctggctttcttcctcctggaggggctgtttcccaggagcagcactagcagagctttgtagcagctctaagagttggctgaaccctgataagagcatctggtggccggctgggggacagtaacctgagtatctggggtgtacccagccttgtcccacttgatcccacaagggctgccttacctgtcaagagacagtggttacaagatcctgttagcatcaggatgcaggaatgtttgtgcctgtagctaaccaaggaaaggtaatgctgagggattctgtgagaccaggaagtgcagaaggctttagggagtgtgattgtgtgtgcatgcattcgtgagtgtgtctgtctgggggaatctgagaatgctggtttcccagctacgaaggcttaactacctccctgctgagtgtaattcctccctgtgccctgtggatgcctcctcagtgaagaggccgatagggctctccacttccttggcaggaggtaacccccacttcctcctcagcagccctgggcagacctgaggaccaaggagggaaccacagatggcagatgcctgtcccccctccttaaccccatctcacacacgtgctcagcagggccctgcacagggctggattggccatcgattggcttttattgagcttggcttccctgctgcaggcctaaaggcctccgccaccttggcccctcgccagccccacccctggagccttgcaagcagcaatgttaaacaggatttagaaaggaaagactccagccagtggattctctgtccacagtcctcatcacctgccaagagaaggacctgggactccctgaggaggaaatgcagggaagagagagagccagggcagggagaggagaggagagacagcctccattcctgacctgcctggtctgtgcctggcttgatgggctctttccctcagggtggccgcagcaacagaacacaaggagccccaaagtgtagaggggacccgagcaagacaggaacttgcatggcagagcagcctggagcagatgaacaggcaggaggggcctccatccacccttcccagtcttgctctgtagctggggccaccgggggtaccagcagtgccccaccaggggcagagctccaccctggccttggcctggagagacacttcccccacctgaccgcaaaccctggcatcagtcagctgggacagcctctccacaatagcaggcttagtaacagcctctccacatgcttagaggtggtccatgagaagggcagactgtcctgtggttggctctcccagcattcctgggccctgctgcttaggtcaagctcaggacccctgttctctgcccagctctttggccatagaggctcttccccagctcctccatctttcaagaggctggggtagagccatacagcaataattttctgtgtctgggtgtacaactactgtttcttctggagt

SEQ ID NO: 42756 - DNA, 1116 bp, Homo sapiens
atgcagtttattttcaatgcagctgaattattaagcaccctgcatgcattggggattctaccaggctttgtgcaagtaaacagaaagaagtgagctatgctctatgccctgaaggagctcacagtatagtagcagggaacttataaggctgactgtggcaagtgtaacaacagacatatgttgcgccctccttacagcactgccttgggcctgaagataaagagaggagccccacacttagaccacagatccacagtcaccctccttgcttctgagacgcaaggggcaaaaaaggtctgagactgagctagaatcagggccagaagggactgatgcctcccagagtcagggtgggagaattctacaaggagccagggagagaaactgagtaggccctgggtgttgctaaaacaggcaaaagcagcaaataagcagcaggaccactgacccaaggtcagagtgcttagggaaagacaaggcagggaatccctcctcctgtggcgcaggggccctgagtagcagggtgggacagtacagccccagcccagcagcactggaagtcctgttcagcatgtatcttgcagggtgacaagggtcagaggggccaagtttgaataatactgaggctctaggccctgatccaagaattcctcccccaccttccatggcttcaattctggggccttttccacggtggtgtggggcccatccttcatccctacttttgccccctgaaagacagtagacagtggcttctgtcagttaccacctctgtggcccaggccaggagctggccttgcaggaatggggtacgggctggccagctctcaccctggaggaggctgtttggattgtccttgctccctgtctactttctttctccacctccttaatcaaagctcaggcacatcccaagggctcccacaccctgggccagcagactggagagctgagatggcaaggctgtgtgtgcctttaaggcccaacatgtcagcaagtcaccagtcccacttctgaaggcagatggcatgaaacctctggagtggagaccaagagggcttccccgcatgggttggggacagagccagtgctgcagtgccccccagaattttacat

SEQ ID NO: 42757 - DNA, 1134 bp, Homo sapiens
caggtactaacaagcattttctgaaatggaaatttgtttttttattaacctaatacaaataaggttcaagcactgtatttaaatatttaaaagataggagtttcttaaaataccacatatggtgctcttgtgagcttgcttttctccacaatttggcaatttgcttcactctagtagtccaatctgcaacaaaagaacagaatataacactttctcagagccatgctaatgatgtgttgtattaaagaatgttgatgaactgctgacagttaatcttattcaggccgtattctcatgaggtcatagatctatattaagtttttttacaaagaacaaagatcctggcacactgtaggccaaacaaacgttttctaaatgaagtgttgccttattaacaacctagcttgtaggttgggaagtttttagattcaagggacaaagtagcaaaaatgtgccctctccctcaccctcaccttctccctctccctctctctctcccgtctccgtcgtctctgtctcctgctttccacggtctccccctctccctcgtctccgtctcccgctttccacggtctccctctgttgccgaggctggactgtactgctgcgatctcggctcactgcaacctccctgcctgattctcctgcctcagcctgctgagtgcctgggattgcaggcgcgcgccaccacgcctgactggtttttgtattttttggtggagacggggtttcgccgtgttggccgggctggtctccagctcctgaccacgagtgatctgcccgccctggcctcccgaggtgccgggattgcagagggagtcttgctcactcagtgctcaatgttgcccaggctggagtgcagtggcgtgatctctgctcgctacaatctccacctcccagccacctgccttggcctcccaaagtgctgagattgcagcctctgcccggccgccaccccgtctaggaagtgaggagcgtctctgcctggccgcccatcgtctgggatgtgaggagcccctctgcctggccgcccagtctgggaagtgaggagcgcctcttcccggctgccatcctgtctaggaagtgaggagcgtctctgcctggccgcccatcgtctgggatgtggggagcgcc

SEQ ID NO: 42758 - DNA, 1066 bp, Homo sapiens
acacttgatagatagtaagttctctggttgattgttcaaacagaatttagactcctataatgacggatggggcatttgggtataatgccagatggcaggactaaatgacctcagaaatgccttcagttctgggactgtggctctacctgaggataattttagtattaaagtgacatttggtaaagcaggataattgacgttagatataaataaaatatttgagagctggttcttaaaattttttcttaaatatttacagttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggtaaccttttattgtcttggtagtgggatatgtgaagctattatatttgtgcacatgaggtagcatagagaggctgacaataaaagtaacttctattggatgatgctgactagacttgacccttatattagcctggaatcacctccatttttgaactgataaaatgccctcagtgcagaccagatatctggtggtcatcacagacaaagatcacacgggaatagcatgtcacttccaaaaattgtattaatagcatcatgctgtacctgtcacatgacactgtatcatacaggtgaaagagctcaacatgatcatgctataactctggaaaaatgtcccagatcagaagaaattgttgcttctcttctaatacagttacaggaatggagagggtagttaggatggtgcctgtttcttaggcctgggataattctcttcctctgcatttgga

SEQ ID NO: 42759 - DNA, 1063 bp, Homo sapiens
gtacagatgtgttcctggtgtggagaaagtgccaaggtggctcagcgaagaaaaaagaattcttgtggtgctatcaagcaaggcttcatttgagggaaaagtaggatttctgtaggtggaaaaagagaagacattgatttgaaactccctggttgttttataaacttcatattagctatgtccacagagcctccaaaaggatataattcaaaaaggattttaaccaaaatgaaatatgttgtgactaatagatacagtttatttgaatgaatgatagtttttcccatttgatattttaactgtgctacacaagaatgagagtagacatagctcgatttgtagtctcattgttttgtcttttctgcccatttcagtgacccaggactctttgtttattgctgtgatttttcttccacagctatagaactggtccaggtgagtacgatgggaaattacctattggtaatttccactgattaaagggaaaaggttctcctaaaaatcaaggtctctggctgtgttcttatacggtctgtgttcttacggtctaaaagtaaaagatttactgataacgagcataccttgttttattgcagttcactttatcacactgtacagatgtcatatctgttcatatattgaaagtctgtggcaaccctgcatcaagcaagcctaccagtgccgtttctccaccaccatatgctcacttagtgtctgtgtgtcatgctttggtgattctcagaatatttcagacttttttactattatgtatgttatagtgtgtgacgttactgttgtacttggtttggggttccacaaatcacatctgtgtaagacggtcaacttaataaatgcatgtgttgtgactgccccaccaacctgccattccatttctctccctctcctcaggtctccttgttctctaagacacaatattgcaattaggccacttcatactctacagtgtcctctgtgtgctcaagtgaaaggaagagtttcaccacgttgcccaggctggtctcgaatgatagcttacacttgtgttgtaattattaaatttaat

SEQ ID NO: 42760 - DNA, 1033 bp, Homo sapiens
agtggcttcccctacctaaacatgaacttgttgttaccaagccaccactgcatttataaccaaatggccatgtaaaaaacacgacagcaacttcccagagccccatttaacaaggacttagtagataaaaatgccttttcttgaggggaaaatgcataaacatcttttattttccacactagaggaactggacacgcttttcaccactgctggactggaaaaagttcagaatctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagcttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccatttatttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgacaagaaaaaaatgaccctgtagacagcatcaaaatgtggtgttcttgttaagtaattgatcgtggtctttgctttaatctta

SEQ ID NO: 42761 - DNA, 1050 bp, Homo sapiens
gctaattttgtatttttattagagatggggtttcttcatgttggtcaggctgttcttgaacttccgacctcaagtgatccgcctacctcagcctcccaaagtgctgggattacaggtgtgagccactgcgcccggcggcaagtatcttttaagttctcactttttttttttttttttggagagtttcactcttgtcgcccaggctggcgtgcagttgcatgatctctgctcacagcaatctccacctcccaggttcaagcgattctcctgcctcagcctcccgagtagctgggaggtgcccgccaccatgcccagctaatttttgtatttttaatagagacgaggttttaccacgttggccaggctggtctcgaactcctgacctcaggcgttcacccgccttggcctcccaaagtgctgggattacaggcgtgagccaccgtgccggggccaaggaactctttttctatcttttataaatttttaagtctgatacatcacattatgtaatcaaattgacttctgaaaaggtatttaactaactgatacctttcttttcatgtagttcgttgcagcaattagaagctttcagtcatgaatatctagtgtcagctttttcacataccaaagtcactttcattttttaaaaatgtttgtatgtcttagatttaattacatgcctgacaatgctcaataagcatgaatgctgagaaatggcctatacttatactgatgcattttaaggaactgtggattaatttactttagtatttatttgattccctccttatttcacatgtagtcaagtaccaacacgtgcctctttctctgaaatttctgaagtgtttttctgcccccattgctactgccttaatccagactgtttttattcataacttgaaattctagtttggaagtcttgcaccctttctgttcttctattggttaccacagaaattacaacacatatttttaacttataaaggttaatgttaatacctttgtcttcctcttggtcagtacaagggccttgaagattttttttttttt

SEQ ID NO: 42762 - DNA, 1050 bp, Homo sapiens
ggtatatatgtgacttttattacataaactgctgccagagttgttgatcacttagttcctgttctacctgactctagaagactactaaggattgattgtggaattaaaatataatctgaaggtacagctgatctcaggatcctccaattcaggatgtcttctgttactaacttcagcaaccacatttaatgttcaaatttagcagtagttactagcatcaaactaacttatccatcctccattatagtaacaattgaccagctagaacaaaacacagaatactcagttaatttcttttgaaaagccatttgacctgcttgtgtctggataagatgaaggaaaagagacataatagctgtatcaatttttttttttttttgagatggagtctcgctctttcacccaggctggagtctaatggcttgatttcaggtcattgcaacctccgcctcccgggttcaagcaattcacatgcctcagcctcccgagtagctgggactacaggtgcttgccaccactcccggccattttttgtattttagtagagacaggattttgccatgttggctgggctggtctccaacttctgactgcaagtgatctgcctgccttggcctcccaaagtgttgacattacagacataagccactgcacctggcttactttttgtatttttagtagaaacaaggtttcaccatgttggccaggctggtcttgaactcttgacctcaggtgatctgcccgcctcggcctcccaaagcactggaattacaggcatgagccactgtgcctggcctgtgtcaaaagcttagtgtccaaattttgcagcagttgagttcagccaactttgatcacatctatactgtatttagattgttaggggaatttaaaaaaatcaaccagatgtactgtatacttttttttttttttgtgacaaagtctttgttgcctaggctggagtgcagtggcacgatcatggctcactgcagtctcgacctccagggctcaagtgatcctcccacttcagcctcctggtacatgggactacag

SEQ ID NO: 42763 - DNA, 1025 bp, Homo sapiens
tgtgtgtgtaaaataggtttaaatgagggcttacattaaattctgcaagtactattgcaaggaaaatttcattcaccataacagattccttagggctttcaggttttgggatattggaattaatttgtaatatacatattatcaaaagttacaattcctagtttttaggtcttggagagaaaacagtagcaccatgtaattaattagaaagttaaaagatttagttaacttaaacatagttgatagtgttgtataaagcccagtctttttttttttttttgagacaaagtcttgctctatcgcccaggctggagcgcagtggcacaatctcgggtcactgcaacctctgcctcctgggctcaagcgattctcctttctcagcctcccaagtagctgggattacaggtgtgtgccaccacacccagctaattttttgtatttttagtagaggtggggttttgccattttggccaggctggtctcgaactcctgacctcaggttattcacctgccttggcctcccaaagtgctgggattacaggcatgagccaccgggcctagccaagccctgtcttttttactgtattattatttggtagctcattttgaaagagaatttttctagagatgattagaatattttatgtggggaaaagtgagttagacctgtatgtcttgcttgatactggagcaaaagttaaaaggtctcagctcttgaacagctatttctttggtttatttgtttgtttgtttgagacacagtctctgtcacccaggctggagtgcagtggcgcagccatggctctctgcagcctcaacctccagggctcacgagaccctcccacctcagcctccctgagtagctgggaccgtaggcatgcgccactgtccccagctaatttttgtattttttgtaaagacgaggttggtcaggcgcagtgactcatgcctgtaatcccagcactttgggaggctgaggcgggtggatcacctgaggtcaggagttcaagaccagcctggcgacc

SEQ ID NO: 42764 - DNA, 1073 bp, Homo sapiens
taaaaaaaaaaagaaaaaaagaattatttgttgtgaaaaacttattttaacaagttctccaaagttttatttatttctaaaataaaagatcagaacaaaattcttattatgggccattcttacagaactttttagagtgccatttgctataatgggatcctgcttttactagcaaaccttttattacaatgaatttcctagatcaggtctttgttgttattattttattttttaaagagatgagggtctccctatgttgcccaagctggagtgcagtggtatgatcatagttcactgcagccttaaactcctgggctcaagtgatcctcccgcctcagcctgccaagtagggaagactacaagtgtgtactaccacacctggctaattgtatctttatatttaaaagaatggaaaaagatactgtataaacagtatcactaaatataaaaaagctaagtataaacactaagtataaaaaagctagagtgatttttattagacaaaggagacctcagaacaagaaaaatattggtaggagtaatgaagcacgattcgtcacgaaagaaggatcaattttttgagaagacacagcggtcctaaatgtatatgcatccagtaacagagtggaagcaaaaactgacagttgaaaggagaaatagacaaatccacaattacatttggaaattgcaacattcttcctcaataactgatagaacaagcaggcaaaaaatcagtaaggttatagaagatttggacagtactctcaatggactatacttaattgacatttacagaacactctgcccacattcttttcaagtgcacatggaacatttaccaaaatagaccatatgctgggctacaaaacacatttcaacaaatttaaaaggattgaaacgtagtgtctactctgactacaatggaattaaattagaaatgaaaaagatacctggaaagtctccaaatatttgaaagtgaaataacatacttcaaaataacctttgggtcaaagaactcacaaaggaaattagaaaatattcataactaaatgaaaatgaaaacacaatatatc

SEQ ID NO: 42765 - DNA, 1076 bp, Homo sapiens
tgtaagagttgattatagttttagttcttttttttttttttttttttggctgtaagtttattcaatgcaaaagaatcctctccagttttactgaggtggctgaccacgtccacgaccaaatccgcctctaaactagaattcggttgctgacccagccccagcctcggctttcttgtcggcaccaggtagcacagcactcctcacatacagacctttaggccaaggtctgccagtctctggacggctacggggtagggtggcaggcacaatctccgggggcagatgaaggtaatcacggagatactggataccctcattggtaaggtaccagtagaaatgtctccaggcaaagtgttccttcacgtagcctcgggacttgagagactgcatggccttcatgacatgaaggttgggcacattcttgtctgccagctctgggtgcttaggcatgtggacatccttcttggccaccatgaccatcctccttaaaaaggagttcataaatggcaatccggttcttcttaggcgtcaacatctctgcggctgcagggtccggggctggggctggaaagctagttttagttcttatgttgaggtctttgatgtgttttgagttaatttttgcatgtagtaatggtccaactttcatttcatttgcatgtacatatccagtttctccagcaccatgttttgagaccatctcactctgtcgtccaggctggagtgcactggcagtaatctcagctcactgcaacctccaccttgcaggttcaagtgattctcgtgcctcagccacccgagtagctgggattataggcatgtgtcaccatgcccagctaatttttctatttttagtagagattgggttcgccatgttggccagactggtctcaaactcctgacctcaagtgatctgcccacctcaccctcccaaagtgctgggattataggcgtgagccaccgcgccagcctccagcaccaggttttgaaaaaattgactttcaccattgaatagccttggcaccttatcaaaaatcatttgaccatgtatgtgaggatttccttctggctgtcca

SEQ ID NO: 42766 - DNA, 1026 bp, Homo sapiens
agtaatccacccgtgtcagcctcccaaagtgctggaattacaggcgtgagccacggcgcctggcaagctcggaatgatttttagatttttaaaaggttttagaaacgaaggatatatgacagagactgatgtggcctgcaaaacctaaaatatttctatctggtccttcacaaaaaagctcccagaaaatcactataaagttaactctatataattgttacataggaaggtagactatttccagcagctggaaacctacatgctgttccctgatcacaactcccactaccctagaagtgatcacttggctagtttttgtggtaatcattttcgttttcatgtagtttaaactatccatgtatgaatccataaacaaaatagtttagttttgccagtaggtaaactcagtgtttaaatcttaggtatttttatttttggctgttctatcaattattaagagcggtgtgtatattcgtatttcttgctgtgattgtgggagttggctgtttcttcttatatttatattaaattttgttttatgtattatgactcttcatctctttaaagctctttgctttattttttaattttaatttttatttttgagacaggttctcgctctgttgcccaggctggaattcagtgcacgatctcgggtcactacaacctccgcctcctgggttcaagtgattcttgtgcctaagcctcccaaatacctgggattacaagcatgcatcaccatgcctagataatctttttgtatttttagttgggttttctccatgttggccaggctggtctggaactcctggcctcaagtgatctgcctgccttggcctcccaaagtattgggattacaggtgtgagcccccgagcctggctgaagccctttgctttaaatgtggtttatctgatatttaatatatccaaaccattgtgaggtataactatttccattcttaatactgtcaaatttgcattgttatgttttctatctttggcaaataccatataattagatttttt

SEQ ID NO: 42767 - DNA, 1003 bp, Homo sapiens
tgaagtcagttgtttcttcatcctctaccaaataaaatcatgtccccagaacactgtttactctgctactgatttggtggtagtggtgtatgtttttattttgcctttttttggtctcataaaatattattgttcagtgctatcagtgttcgtttaggtttatctgtatatttacctctttgtacttctttcctttttgcatcctacaccttccacctggggtcactttccttctgcctaagtattcctttagtattcttctagaatatatctgctagggattaactctctaggtttttgtttactgaaataactttattttgctcttattcctgaaaggtatttttggctgtgtatatttttaggttcactttctttttttttttcttttaacacaattgagcagtaattcattaccatgttctaaccctccattgttactattaagaaatcagctgtcatttacctgttgtttctttgaaggtatctgctttttttcccctggctgctttaaaagtctttagctatggtgttctgtagttttatgatgatgtgtcatttcatttctcttgcttgtgatttcttggacttctgaaatttgtgggttggtgtctttcatcagttctgaataattagccattgtctctttgaatattatctctgacttgttctttttttccttctcttatgaaattctaattaaccatacattatacttcctaattttattaccatggcttttgacttctttttttgtatttttgttcttcttgtctttatatactccatcatggataatttcttcttgcctttcagttcccagatcctgttttattgtttctaatttgctattagccctaatgaattggttactaccttttgaagaaaaagaattacatttcctgcagatattttcaagcctgtcttttattttttaaaatatggtagacacaattattttataatctgtttgataattctagcatctgaagcttttatgaat

SEQ ID NO: 42768 - DNA, 1159 bp, Homo sapiens
gggtgggggtaatttttgttctggtttaccctttccttgagaatgtaggtagctctggaggcccagcttgaagtgggaagggtttcctattgaaccctctcccttgggtgggctttggtctgtgactatctgcttgataccatgttgccctgaaaatggaaattcaagatctgcaggtgcccttaggccatatgtggctttggtgcttcttttacctgtcttatgttcctaatttcccttagattttgccgtggcagatccctaatactttatcaactcttcagtgcttttaatgttttttttttgttgttgttgttcgcccatattttatcctatctgtatagtcccccccccagggagaggttggttcaaacaggaaaggctatagcctacataggatatttacagaaatgtttttaaaatctttcaatccttggcaggtatttattgaatatatggcagaaggtttaattttactgttgcagctcattctcccatgcagtgagaatgttgtcatcaatgagtatcacaggtgttctggagcctgggtttaaactgttacatttgctggggtaggactctactcatagattcaaaacctaatttctttgtcaggatcattttactttttttttttgacatgaaaacgttaaagaactattcctgattaaggaaaattatttcctttattcatgcggattatgaaagttcaacaattcagaaatggtgaaataaaaaattccctccaaaagaactgttattagggagtatggtgggcaaatatttctagactttttgagatatacatgtatgtttatataataggttttcttatttccattgtattagattatttaaccagtatcttgtaagcatttgtattctataaatagtgctgtaatgaacatccttatacatacttactaacttatgcatttttcccagataaaccccctaattataattcccaggtcagaatatgatcatttaaaaatgtcatcacataaattgctagaaggttattagcagtttgagagtaccaattttttcacaccctgctaatactgaattttatcattgtaacctttggcataaagaaaaataccttgttttaacttgcgtttgttcattagttatatatattaaacatcatatgttt

SEQ ID NO: 42769 - DNA, 1060 bp, Homo sapiens
aggcatgtgccaccatgcccagctaatttttgtatttttagtagagacagggttttgccacgttggccaggctggtctcaaactcctgacctcaagtgatttgcccatcacggcctcccaaagtgctgggattacaggcatgagccactgtgccccgcccatggtttatatttttaatgtcatgtttaaaaagtcctttaccactggaaaattctaaaagcatttgtttattttttcttcttgtaattttttatatgtaataaaaggtaggaatctacttttccctttttttctaatatctgcacaaatgtcctaccatctttttaataagttcccgctaatatgaaatgcacattaatcacaacttatgtatctatattatatagatctgtttctgaattctgtattctgtgccactggtcaatctgtctgcttctgtatctgtatgatactgttttagttaatgtaacattgtagtatgtttcaatatctggtcaagtttccctgatactttttctgaaaaattatgtggctgattatgattatttttttaagtgaaccttagaatttattgtgaaattctccgaaaacaactgcccaagaaagcatgagagagaacctagatgaccactataccaccataagactatcccttggaagagaaaaaggccaaacacaaaattaaaaacattaaacttgggttttagagaaatttgatgtttgtagaatctgaacccaggaacatgatattaccgtttaacttagatcatcttttatattcatctgtgaagctgtatagtttttcttcataggtgttctgcatgtttcttaagtttgctttcaagtattttacagatttttgtttgctactttgaatctgcttttccttctgctacatgctctgattaaaatcagttggggaagctatcaattttagtgtatttattttgtatttggccatcttactgaactccttttaattgttatagtaatttttccattgatttgcttggtttcctttgtgaatggttatatcatccaaaaatgacactaaaaatct

SEQ ID NO: 42770 - DNA, 1094 bp, Homo sapiens
gtgtgcgtatcctttttggtatccaacaggaagaatcttaatttatcccttccctaaggttaatgtaatgaattacattagtagatttgctaatgttgaatcatttttaggtttctggagtaagttatgcgtaattgtggtgtattatccttttactatactgtggaacttgttttgcttgcatttattttagatttttgcatctaaatatagtacagtgagaatagaattgagagtgaaataagcttcacctataaagtcacgtgacaggccaggcacggtggctcatgcctgtaatcccagcactttgggaggctgaggcgggcagatcacctgaggtcaggagttcgagatcagcctggccaacatggtgaaaccccgtctctactaaaaatacaaaaaaattagccaggtgtggtggcaggcacctgtaatcccagctatttgggaggctgagacaggagaatcgcttgaactcaggaggcagaggttgcatgcaatgagagcagagactctccattgcactccagcctgggcaacaagaatgaaacactatctcaaaaaaaaaaaaaaaaaaaagaaaagaaagtcatgggacaatgtcttaattttcatttacctacaggatagaaataatatttcctgtgtagggttgagggcattatgaagttgatttgtagaattctacaaagtaacatgtaaattcagactctcataaatatagaaccattaaaatataatgtcaaagaatttgagtaagatagtcacatttttagataggttataatacaatgataatgttggtatgctctccataattatttttagagaggcctttttaaagaaaccattcatcttatgtttgataactgtttttaacccattgcatgtttgggcagtatcagattatctgtctcatgtcatttgtgtgtttctttactgttttccagtgacgagtagcacagcccctctatggtttagatggcagtgctgcaaaggaggcaacagaggagcagtctgctctgccaatcctcacgtcagtgatgctagcaaaacctcggcttgacacagagcagctggcgtaaaggagagct

SEQ ID NO: 42771 - DNA, 1046 bp, Homo sapiens
tgcaatttgaaccaaatgttacttttcctggtttctgggccctaccgggtcacctgtttgttgccaagggtgccagagtaacagaaagccccatcgccctattcctattccactttcaggggcatctttcagaactaagtcaccactcatccaaattttgtccctcttactggttcattttgtccagttatagtttaagtttcctgtttatttgccctatggtatctataagtcttcaatccacactccaccaactgtgttcaaaaaggtgctgaaaatggtgggtgtcttaaggaaaggaaatagaaataataaaacagttaaccagataggaagctattgtgcatgatatggaatgttttcttatagttatgatagctttaccttaagaaagagatacaacgctccttgaataacatcatttcattcaacatggtttcgtgatagtgctaattagacattgtgagttgacgccactgtctgtgtggagtttgcatgttttctccatgtctgtttgggttttcttagggcactctggtttcctcccatatcccagagatgtgtgcattaggttcattggtgtgtctatggagtcccagtctgagtgagtgtgggtgtgtgtgtgcaacagaatggcttcctgtccaggtttggtttctgcttgcaccctgagctgcctgggataggctctggctattcaccactctgtactggaataaacagataaatcattgtcttatttgtttttatgaatcttacttaaatgtatgtacagcttacttttatttcagtgtttaatgttagaagtgttttgatctttaatcatcaaaggaatggggaaacttcttgtgtgaagacagtatagtcctatccccaggtaacaaaggaaatatacatactttaaaaatgggagaattgacctgtataatattgtgagaggaactgacagcagtatggaatagttcctttgagaatgcagtatgctatagtattgttctaaagaatgtatgtgtgtcattcacacatttcgagattgttaatgttta

SEQ ID NO: 42772 - DNA, 1628 bp, Homo sapiens
cctgacctccacagccttctacatctcaataactgtcaacttttctccttctaatttttacagctaaaatccttggagtcattcttgtctttctcttctttttatattatatgctaaatccaaatctatcagtaaagcttattgattttaccttcaaaatatgttcagaatttttttttttttttttttttttgagatagagtcttgctttgttacccaggctggagtgcagtggtgcaatctgggctcactgcaacttccacctcccaggttcaagccggttctcctgcctcagcctcccaagtaactgggattacaggcacgtaccaccatacccagctgatttttgtatttttagtagagatagggtttcaccatgttggccaggctggtcttgaactcctaacctcaggtgatccacccgccttggcctcccaaagtgctgggattacaggcatgagccactgcatctggcctatgttcagaattttaccacttctaattctcttcactgctgccactccaacttaaaccattgtctcccactgagataactggacccattgctttgacctttgttttcttttaatctgttcttaacaaagcagagtgattgtgttgaagcataagtccagtcatgccactcccctgtcgaaaagtccttaaagtggccctgcatggtttgttttcctccaccctgacatgttttactactatctccctttctcatcagattccatgcacgctagccaccttgttttctcaaatactctctctcagtgatgctctcacctcggggcctttgcgttggctgttgcctttgccctaacattcttcacccatatatcatcatgccccgctctctcagttccctctggtttctgcttatatttactctatgagagaggcctaccttggctacactataaaatagcaacttctccccacccaccccacctgttattgagctcctaggccctgcgttgtttttctccttagtctacaccagctgacgtactatgatggacttttgtctgacttccccccactggaatgtaagctccatcaggtcaaggactttactttgttcacttgtgtatctgcaatgcccagaacgggacctgctctaatagacactcagtgtaattatatgttgcatgagttagtaaaagcattctttatagagggactggttaaatgaattctaatacatttgtacagtggaatgctatacagctgacaaaagaagtgaggtagctgtatatacaccaatgaaaggtttctaaatatgtgttgataaaaataggtggcagaatattaagaatttgatcttttaaatgtttaaaattattacataattgtgtgttttaacataggaaatttgaggttttatttttaagagagaggtctcgctatgttgcccaggctggggtacggtggctattcacaggtgcaatcatagcattatagcatactatagccttggaacttctgggttcaagcaattctcttgcctcagtttccagagtagctgcaactagagattgcaccacagtagctgcaactagagattgcaccactgcactccagcctgggtgacaaagtgagactcagtctcaaagaaaaaa

SEQ ID NO: 42773 - DNA, 1033 bp, Homo sapiens
ggattacaggtgtgagctgccatgcctggccaaatattatttttttaaatgaattgtttctcttagtctactttgttaaatttggaattcatatgggcgcggtggcttacacctgtaatcccagcactttgggaggccaaggcaggcagatatctaggtcgggagttcgagaccagcctgaccaacatggagaaacccgtctctactaaaaatacaaaattagacgggcgtggtggcgcatgtctgtaatcccagctattcgggagggcaaggcaggagaatcacttgaacccaggaggcagaggttgtggtgagccgaggttgcaccattgcactctagcctgggcaaaaagagcaaaactccatctcaaaataaataaataagtaaaatgttcagtactcaccaaggtgcccctattgtctctacttttatcttgatgcatcactgaattgatgttagatttcaaattcatcattgcccttatactattctatcctgtagccacctttatataatgatgaaagaaattagccatttgttattatcctctctctgttggtgtacatcaaatgctcacctaaaaagagcaacaaccagtggaaaacacatgatgtttttatttggatgactatttacttgtaacctactagcaaactataaaattgtatgatatgcagaattttaactgaattgctttaagtgaacatttaaacatgacaaaccatattgatggtatttatgttaatatacttaaaatgaacatttttcttcgttgtgagtaatataacctacttctcaatgaaaacctagcattaaatttgctaatgagttcaataacatttccataatatttttagttacatgcttaagtttctcttagtgtttctcccactttttaatagcttatgcctttttcgcctttggtttttttttggttcattttaaagcaaaaatctcacaacatgtgatacctggaaacactgtaacctagtggtaagaccataggccctggggacacaggctggccatgtc

SEQ ID NO: 42774 - DNA, 1023 bp, Homo sapiens
ccctgactgtgtgcagccattctgccccacagaagctgctccttggtatccgagctctggagtgtttgggctgcaactgacaggagttcagaggacaccccaggggcagtggcagtgcccgtctctgatattctccgctcccacgagcccttgttacactcctgctagcccctggcttgtgggcttggcctctgagctggacttctttcggtccttgttgcaagtgggccaccttcacctggaaggccaggtcgtggtatttctgcgtctcattgggccccagggtgtaccaccgcttgctcagcatctggctgacggtccggttgtcctggttggggtgaccctggtgcgccctgccagggcctggtgccgcttgctgaagatcatgaccgccactcatgggccaccggatgtggtccttgtcccatttgttggggctgcatccatccttctcagaagatgagtcctgttccttgcgcagggcactgagggactgggcctgacatcatctggctggtagaggcaactgggtgtcaggagacatgatggagaggaaagcatcatcatggtcattctctgtctcactgtccagcagggactcccctgaggggcccagggctcctcctccatggtgggaggtgagcttttaccaggttccaccacccccaaagtgtgtggggttgcgggccctgggctttcagggcaggtggctccagggggccacccagggtcagcactccctgtcccacctggtggacactcatgagcaacagctgctgacttggcaggttctttgctctggttggaggccactgagtgactggcaggttgctggacctcacatagctgcagggaggggtcaggaaggggacagagtaccaggagaacacagccacagagcaaggttccacgttcctccacacaaacatgctgacgccactggaggcctcgctggacgcagacatcaggggcctgtgggccaagtacatggtctgggcagggggttcctggcaggggctcaca

SEQ ID NO: 42775 - DNA, 1318 bp, Homo sapiens
tgggagactggccaccacagttgccttttccttttcaggtcacttacaagggtctttgttgctatggaggtggatgtgggcataatcaaagggtacatgttgtacaggcctttattatacaaacctctacaataaaacaataacacatcactgccaagacagttatacagtgttaaattggaatggaaaggaaggaatcagaatttcatgtgatagaacacttaaaagtctgcctgtgcacatgtatgaatatgcattagggagaagtaaaagagtgacctgaaaatcttcctaaagtaatattatctagaaagtttgagaggtttaactgtggctaacaagatttcctgaagataaaatgttcctggggccttaatagttacaagaactttaccaaatcaagaaagcaaatatataggagtctaaaaattatttagttttgcatattcatttcagagtaccaattatgattttatttctttttaatttttaaaagtttagaaaaaaaacgagaaccaattacaatgttaaaaggaaacaggaaggatagatttggggccaattatattactgtttgggtttttgttactataaaaatggaaatattaaagattttaaaaaatgagtggtaatagagtacaaatctgcaaatgatgaatcagcaattatatttttataccaaatggtatgtttgtgatattgatatagtattaatgcactgtgaatttatttatttattttgagatggaatcttgctctgtcgtgcagactggtgtgcagtggtgcgatctcagctcactgcaacctctgatatggtttagctgtgtccccacccaaatctcatcttgaattcctatgtgttgtgggagggacctggtggaaggtccatgaatgatgggggcaatcaattctttcctgtgctgttcttatgatagtaaataagtctcacaagatctgattttttttttttttttttttttttttttttccaagacagagtctcactctgtcacccaggctggtgtgaagtggtacaatctcagctcactgcagcctctgcctcccgggttcaagtgattctcctgtctcagcctcccaagtagttgggattacagttgcctgccaccatgcctggctaatttttgtatttttagtagagaggggatttcaccatgttggccaggctggccttgaagtcctgacttcagataatctgcctgtctcagcttcccaaagtgctgggattacaggcgtgagccactgtgcccagctgagatctgatggttttaaaaagaggagctcccctgcatgagatctc

SEQ ID NO: 42776 - DNA, 1050 bp, Homo sapiens
tggattttggacttgcatggggcctgtagcccctttgttttggccagtttctcccatttggaatggctatatttacccaatgcctatacccccattgtatccaggaagtaactaacctgcttttgattttacaggctcataggtggaagggacttgccttgtctcagatgagactttagactgtggacttttgagttaatgctgaaatgagttaagactttgggggactgttagaaaggcatgattggttttgaaatgcgagatcatgagatttgggaggggccaggggcagaatgatatggtttggctgtgtccccatccgaatctcatcttgaatttctgtgtgttgtgggagggacaggtgggaggtcattgaatgatgggggcaagtcttttctgtactgttcttgtgatagtgaataagtctcatgagatctgatggttttaaaaagaggagtttccctgctcaagctctctctctttgcctgctgccatccctgtaagatgtgacttgctcctccttgccatctgccatgatgtgaggcttccccagccacgtggaactgtaagtccaattaaacctcttttctttgtaaattatccagtcttgggtacgtctttatcagcagcgtgaaaacagactaatgcactctgcctcctggggttcaagcaattctcatgccttaaccttccaggtagctgggactacaggtgtggactaccatgcctggctaatttttgtatttttggtagaaacagggttttaccatgttggccaggctggtcttgaacttctgcctcaagtgatccacctgcctcggcctcccaaagtgctgggattacaggcatgagccaccgcacctggcctgcactgtgaatgtataatcccagtgattagatatggatattaatgttattcatttcctttttaccttattttatgtttgtttttaataataataattttgtaacatttgaagatataaatatccttaaatacttttacagtcatgttaaaaattcttcggatttcaaaaacaatgaaaaaat

SEQ ID NO: 42777 - DNA, 1027 bp, Homo sapiens
tttggggtttgtgtgtgtgttttgtttgtttgttcttggtgcttaaccaaaagttgttcacagtttggaaaatcattacaaagttgctcctaggacagtaaaacctatttaataagtggggttcagatcccctacacaaccttggttttagttgggattcactctgagtggggcttggagggaagggtaaagccagcaggaaaagacaggcggctcctgcagggcagctctcctgggtccagaattctccctacaggtctccccagatcaagccaaggaaatgggcgccaagtaaccagagactgctggagtcattgccagtggtcccgtgaatcacagccagcctcaagacctcaatttcttcacccggccatgtaagcagagcggacaactctgagggcgtggctgggcggggttcttggggcagcccggcgccactgccggcatctacgcaccctgaacgcgcccgatctggtctcatctcggaagctaagcagggtcgggcctggttagtacttggatgggagatcgcctggaaataccgggtgctgtaggtttttggcttcccgctccctctctctttcccccttttgtcgccgcgcttttcaaccgccccctaactctgctcccccttttactccgtcgcagcccgggacctcctggtgggggtccgccactgcagcaccaggcgccactgccataccaccctgaacgcgcccgatctcgtctgatctcggaagctaagatgtggccgcatttaggaccccaccggcttggctgtgcctctcccagccccctggcggagcggactaaccctagcatttcattgattcacaataacgccaccccaccccgactgactattttgagccccatttgccaatctgtagtggatctttactgttttggagtagtaaattcaatacacctttatgggtctatttttgtaactactgcattctgggtacaagcttctgattctatttcatggcttcgaatgaagtcgtgcacaagcatttacatattg

SEQ ID NO: 42778 - DNA, 1062 bp, Homo sapiens
acccaggcttgtcttaaactcccggatgcaagtgatccgcctgcattagcctcccaaagtcttgggattacaggcgtgaaccaccacccccggcctcatgtcattcttttttttttttttttttttttttgagacggagtctcactctgtagcccaggctggagtgtagaggtgctatctcggctcactgcaagctctgcctcctgggttcacgccattctcctgccacagcctcccaagtagctgggactacaggcacccaccaccacgcccggctaattttttgtatttgtagtagagacggggttttaccgtgttagccaggatgatctcgatctcctgaccttgtgatccacccgcctcggcctcccagtgtgctgggattacaagcatgagccactgcgcccggcccattctttttaacctttgtgtatttttccataatcgagatttaatatattttaccaattctctgtttttatttgttttccgattttttaatcattgtgaactgtcatcattgaacatcttaatacaagtatctttgtctgtaaatgtgggtattttgatgggattgaatgaaacaatgttgagaaacatagccaagttctaacattgataggaatagagtaataagtaccatcttctacccatttctctatgggtttcatggtcttgctttcacattgcttcttctgatggattttcctaagtcttaaccttcacgtcatcagtaacagtaccttatttgagactggggcacttgggaatgactgccccccaacccccgcccccattatctccttaggtacttttctgtttgtcttactgtgttgtcgtatttactctagaacactttccactctctactgatatgtcctcctctgccatttcaggacctcccaccctcccccactgagctgccttcccagtgatgaaagaaaaaatgtaaaagcctgaaaacccttcttcttgatttttaatttttttttttccctctaagaccttaaccactctggatagtatcacggggtatcagtagagtgtgctaaacagatgtgt

SEQ ID NO: 42779 - DNA, 1025 bp, Homo sapiens
gaaaaccatgattatttaccaagaattggagtttctcttctgtaagcaataaagaaaaataaagttcagccacatcttcgctagagaaaataaaaatgaaaacaaggaaaaacaaagttttacatgttgtttgatgcaaagagtggagaacttggataggaatggatattcactcctgaattctaaccataggctgaaatctacctccaaagagataggctgagtttgcttttggatccaagtgcaccagccatgactgtgttgaccttattcacgtggcttattacagaccagtaatggaccatttttttcagttgctggcctggcagttttgttttggagacaattttttatttctgtgcattagccctgggcacacacctggctaagtccagagttctgtgtctttttaaccttttgctggatttctctgcattttctacagaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttaggtaggtccctactgtctgggggaaaaagccttgtggagctggcaccttgaaacgtaactgttttgtcttgtagaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctgggtaaggggcaagatgtcagcctggcagggaccgtggtcttgagtcaaagaaacaaatgggtcacacagtaaaggaaaggaagcttatcttaaatagttcaattcagtgctaagctgatt

SEQ ID NO: 42780 - DNA, 1071 bp, Homo sapiens
atattctgacatattttatcttgaagccttagtcactttgacattcttatttgcaagaacattgtgtatgtaaattgaaatatggaaaatggtgttctgtgatatggctcttaagtgtttttagagtcttctgtgttaagttactattacaattattaatacacaattgaacaaaataacatttattacagacgttttatgtttatatatttttaaatgcatttctttgacacatttttattcaaatagtttcatatccatggatgacaattacttatccctagagtgaaatgggattcagcaccaattcctaatttttattttttagaggaagtactaacagaccttgtttacattagtaaataagttgatggaagatttgtcatagcaatattgcttagttcttggaactccttttgagttacatgccagaaatcatgtaatctatcatcaaaaattatgggttttgtttgtttcaaggtggagtctctctctctcacccaggctgtagtacacaggcacggtctcggctcattgcaacctctgcctctggggttcaagcgattctcctgcctcagcctccccagtagctggagattacaggtgtgggccagcacgcccggctaattttattttttatttttagtagagacggggtttcaccatgttggccatgctggtctcaaactcctgacctcaagtgatccacccgcctcagcctcccaaagtgctgggattacaggcatgagccactgcacccagcccaaaaattatgtttaatgatcccttagctaaaactcaattaggccatttttcaaggtttttttttttaaagcaaagaatttaaaaccttttgacatgcaaacgaatttattcattttttttcaggcatttgcattctcaagactgacactagtatttctttttctttttttttttttttttttttgagacggagtcttgctctgtcgcccaggctagagtgcagtgatatgatctcggctcactgcaacctctgcctcctgggttcaagtgattcttttgcctcagcctctcgagtagctgggatta

SEQ ID NO: 42781 - DNA, 3475 bp, Homo sapiens
tcccagcactttgggaggccaaggcaggcggatcacctgagattgggtgttcaagaccagcctgacaaacatggagaaaccccatctctactaaaaatacaaaattacctgggcgtggtggcgcatgcctgtaatcccagctactcgggaggctgaggcagaaaaatcacttaaatcactttaacacgggaggcggaggttgcggtgagctgagatcgcgccattgcactccagcctgggcaacaagagcgaaactccgtctcaaaaaaaaaaaaaaaaaaaaacaaggaatgtgtaattgctgttttcttccctcttcgtatgtatgtagggggaatgagggctgagtagttcacacttaatttagtagaaatgagaatcttaacttctgattaaccccaattcttctataacagtgtttctgaatttttaatgggaaatatgttcttcttcaattcattgctatctctactttcaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcattatggggtatgtatgaccttcattttccaagaaatagaactctagcttagaattatggatgctctaaaatgtcagaatgggaactctcctcgaagttctcccaaactcagagacagcactgccttctcctaaatgattattcttttctccctgttttctggtattttctagcatccttctcaccacagccataacccttttttacttccattaggccgtataactggagagacctgctgctcgttatataattatctgataccaaacacaagcgattctgaatgtacacacacgtttatctatagagcataaggtaaaacaattttgtttaacattttggtattgtttacaaatgttattaaaacatgcaaattcattttgagaacctcgagagaattaaactattaactttagtaaacacacagtttaagacaaatataaaggtttagccaaatgcaacggggaggaagcacctggaataatttgtgcttgctcaggggcttgtggacatggctgttcctgccaaagctgtagcagttatccaaaagttctttcaaactcatatttggggccactgagttttt

SEQ ID NO: 42782 - DNA, 1025 bp, Homo sapiens
aaataaaagggtggggattgaactttttctcttaccaaccactccttactttctcaccactctccccaaaccaaaaagctccatagagccaattagagtttttcttataagggctttaaatcttaaaataccttttatactcaggaatctgtgcagcagtttatatttaggtatttagtccatctggagaaaatgcacctgaagccactttgtaaactacaaaatatatcccaacacaagagaccactgccacttttagcaggtctccatagaagggctcccccgtccccagatgggctctgtgaagtcaaccctgagattcttcagggaattgttcacaacggggatgaggcaccaaggaggcatcagacttcctgtgtgaccaccaccatcccttgcctccttccttctactccgcctcagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaaggtaaccatagcaagaggtagggagacagttctcctgagcacaacagcatggcagagagagtgggcaccgccgaagggtcagagttgggaaggcgtgtttggccaggggtaaggataaggcaaaagccctgcctttcaccagctgtgaccactcacaggctccattaagaggtggcttttagatacggcctgaggacctcacctagatgccattatcctttatcacactgatattcacagtgcccagttgaagcactatgagcactcagggcagagctgggatgaccagaagtctgtcatcagatcattcgactcattcccagtaagatgtataatatcagtttggtgtttgtttggattcctttggactgactc

SEQ ID NO: 42783 - DNA, 1046 bp, Homo sapiens
acaaggccagccagaggaaattagatggactagcaaaagaggaggaaaagaaagaggagatggaggaggaaaaaaagcaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaaggtaaccagagccaaagcctagatcaagtgggaagtggggtcttgggctcagataactccgagttaatgggtggccctgccaaggatggatatctccaggagtggaggcctcgcgctctaaggcacaacccttcggggaggtggagatgcagaagtgggagatgagagcagtctgtctgcacgaaatcatgggctcagccccgtttgctgtggaaccacctcacaatgaccaccttttctgggaaccagcgtggggtctctggagtcctttcatttacgtagtagcctttgttaccttccttatgtcgggagtgttccctcatccctcttttggcactgcaggaaggacattgacagtgtgaagtctacttcaggccatttctgtcggtctgggcaagtcactcagtccagttttcctatggtgccctgttaggtttaacctttgttgttgctgttaggggtgtgtcaggggataatctcttctttgtaggctcatgttgccccctggattctgtatatcacaggacatgaaggtggggcctggaagtgatcaagagtgatagtgaaaatatttcacatctgtacagtaggagcatagactagtccaaggagaccatccctagccttaacccttcagttgctagatcattgagaggttggggtggaggtatcctgggatatatatgccagaatgccagaggtaacttaccaacaatatagaagtacttccatattttaataactggtacgt

SEQ ID NO: 42784 - DNA, 1034 bp, Homo sapiens
tatctggaatttccagcaatttggtcttcagcactggctaaggatccagtgtgcagtgctctgcttaccttgtgccaggggaccattacctaagatgtggaaagtcggaaccactgcagcccctcccactatcatgtttccttgagctcatcatattccaccacgtgctggttcagagcctcacagatgtctttaccttcggtgccacatttctaaagctagacctgatttttctacttcaaatatattctatgtttctatatatggagagatccctttgccccgtgggtcctgcgtcttttgcaggcagctctagggcatgtgtattaccaccttgcaaaatcggtttctctctggaagattgttgcagtgaaagaactagcccttctccattgtcagtttgtttcggtgcatgttgtcttacaatgatatcattagattcctaggggatctaagggaccagagcccaaaatactaagaaacttaatggaaagcaggctagaacaaagggacaggtgacctggtagaagactggctcttcctagagtgacctaggaaaagtcacaagaaaggtctagatgcagatacctcctgcttgacaggatatgagaggtatgtgacgagacagaaagaaaactggactcaccgcctgacttggacctagctgctgcttaacccattcaattttgcaattcctgcagactgccggtggaaagaaccaaggcccaggcagcagaaaagacatgcaactgctctagcttacctgttttttaacctcttgattcctttctcttttccctttgttttctcatcttcattatctgttggatccatgcgtttatgtctcacatctcctggtctctcctcgtgcttctttctcattttggtgtgttgcagtcatcccctacccccaatccccccatcttctccttgcctcttgtaggcctggtggtcatctcggctttgctctggtgctggtgggctgagacgtcgtcctaatgcaggtactggtattgcttcctctccttctgagg

SEQ ID NO: 42785 - DNA, 1030 bp, Homo sapiens
aagatcatagaaaattctgtcaaacaactcaacgtccaaaaacatgattccggtgatttgtcacttaggtcacctagtttaaaaggagagtttgacacgacttcccctttgggacacccacaccagccctttccccatcccatgtagaagcttgcctttgcccagtgtgaggtgcacgggtcacatttaaggatttcagctcctccctcctttaagaacaccagactaacattcttagcaatgcacattaggatagaggcatctgagcatataaatatttttttctagctagctcccttcttagtttttgtttttggttttagagacagggtctcgctctgtcaccgaggctagagtgcagcggcatgatcatggctcactgtaactttgaactcccggtctcaagcgatcctcctccctcagcctccggatctcttggttttcttacatgagttactctgtatatccacctgtaacattgcttggctttccatttcataccttctgttgttcttagtagctatttctataagctcaggagattttctttgctctttagcaggcttaaagtcctctttttagatcaattatcatctgagaaaatgtgttcttagcattaatgggctatattccatttttacttgaaaccatccttctgttacctatgccatagcttatgactcaaaatccaaattctacctttcagttagtagagtaaaaaagtaataaaaataaaacctatttccccaagtatgtattttcttgtctaagattttcatattacctaatggatgctttttggatatcttcgatggtgccacttgtcccatgaatcagcagggttccctagtggccggcagtgtctggaagcctcagcatactctagcacatgcaccaggaagtcagtcaacatacctggtgattaggagtgttctaatgacctaggcccagtgacaggtttccttaaatttccttgaaccaatgtcattctctgtcaaagtttgtctgcctaagaacctcctacttacct

SEQ ID NO: 42786 - DNA, 1031 bp, Homo sapiens
cgttattctccatctgtggtgacggcttcgtgatatatccatagtgtcaaagcttctcaaacttcattctctagcatgtgcagtttgctgtatgtcaatcatagctcagtagaactgttaacaaaacaaaaaggctctgccctgggagccttacaatcccacaaggccagaaagaaaccaggtaattacatagacaggaggcagactcacttgctgtagctgaggtgagggtaccttccagaaccacaggaacacagagaagcagccttctgaccggaagggccccataaagaacttggcatctgagtggggcctcgcaggagggagagggtcaggtaggcagagactagaggcctgaccccagagctctggcccgaggagctgcgcaggtgagggagggtgctctggggcagtggagggtggggcgcccctgagcccgtctgtgccctcccctctgcagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtgagtgggccagtgagcacagcatggagcccttagctcccaaagacagaggggacaagctggggctgccaaggcgtgtggttgtcagaatgcacaccctggggcctgggggccaggatcccctgcagggtttgtcctcctccagctgtggctctccgctggctggtggcaggccctacctgatgagtgtgccagattccgcagaggcaggaagaggtttaaaacccctcattttacagacaaggacactatggcccagagagggctggtgacttatccaagatcacacagcttatctgtggcagaaccacctagagcccag

SEQ ID NO: 42787 - DNA, 1050 bp, Homo sapiens
ggcacagaggagccagtgaaggtgcgggaggctggggatggtgtgttcgagtgcgagtactacccggtggtgcctgggaagtatgtggtgaccatcacgtggggcggctacgccatccctcgcaggtgagtaccttgcgccccccatgctgtcctgtctaggccatcacagggagggacgaggggcactgggctgcgagggagtttgaggggagatggagtttgggctgcgagggactttggggggcacttcctggcatggacaccagctccctctctgcccagcccctttgaggtacaggtgagcccagaggcaggagtgcaaaaggtccgggcctggggtcctggtttggagactggccaggtgggcaagtcagccgattttgtggtggaagccattggcaccgaggtggggacactgggtaagtggctggggggcaggaggagggagtgctgcgggggagggcagcaggggacactgtgggtaatgggtgcagtgcgcatgctggggagcgctggggtgagcagggagataggacatgagggcagctagaggggagctgggggacggaagggtcttgcctgatgctggatccccgaccctcccccaccttgccccaggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgtggtcccagctcacacacacctgccccgggggtggggcaagctggttctcctcccctccccaactcagccttcttccctccgcacaggtgaaggcctttgggcctggcctggagcctaccggctgcatcgtggacaagcccgctgagttcaccattgatgctcgtgcagctggcaagggagacctgaagctctatgcccaggtaggtcattgtccagtctctgctgcccttac

SEQ ID NO: 42788 - DNA, 1026 bp, Homo sapiens
tggcggctcaggccagccttgggccttcttgcacgcatcgtctgcagaactcccctgccctctgcagacccagctgcccgggcaggtcatgtcttcaaatattgtatgacttgggactgctgaaattggaaattttttcccttatctaatttcccatctttttattatttcagccacagtgtcagaaatacatttcatttttgaaaacattttattttcacattttattaatttaggaaggccttctcttccaggcctgggacccacatgagtgaggtttgcccagcctcagtctgcagtcaagttcatttattcttgtgtgtgttttcttagcaagttcctagccattttcccatgttggtctggcttccctgtgggcatttcaaaggcagggaaggcctcctcctccgaggctcctcagcatcagggggacccatcagggctggtgggcagggtctaatgtccttctcctcacagggagcccgttccgcgtgccagtgaaggatgtggtggaccctgggaaggtgaagtgctcagggccagggctgggggctggtgtcagggcccgggttcctcagaccttcacagtggattgcagtcaagctggccgggcgcccctgcaggtggctgtgctgggccccacaggtatagaatggccggggcagggaggagggaggtggggcgggacgcccggaggctctgctgaccctgtgccccttgcccaggtgtggccgagcctgtggaggtgcgggacaatggagatggcacccacactgtccactacaccccagccactgacgggccctacacggtagccgtcaagtatgctgaccaggaggtgccacgcaggtgaggaccagccctgggctcctgtgctgcggctgagctctggggtgctcctgctggggtggcactcaggatcactgctggagtcccctgggagagcctctcccagctctcagcctcgtccagtctcgccaccccatcccgctcttccccggggctctctgctgtgaggctttcctg

SEQ ID NO: 42789 - DNA, 1045 bp, Homo sapiens
ccttgaccacacaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgagcaccgcacactgggccggccgggtcctcacggcgggatgggagggtgctgcggaccaggcttgatgctggcagactggccccgaaggccagggcaggtctgagcagaggaggaggtttaactgatgggggagggaagggccagggctaggaggaatcccagtgttgccctgacatcccccaaaccctgcaggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccaggtaaggggcaggtggccaggagtggggatgaagtcagggcagccagtgtgaggggcgatgatgctgaagtccactaccttgcctgtccccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgggcgtccacactggcagtggggctgggcctgcctgaccttccagactgggtttctgcccactggccaggcaggagatgcttggggccac

SEQ ID NO: 42790 - DNA, 1050 bp, Homo sapiens
agaagccaaccctaatcagcgtgaccctccgctttgggatgaaattgattctaggtagggttgacagagggttgagcgtggcagcctttccccttgtcctctgtgccctctgggtcatgctcattcccctccacagcccagcccaacaactcggagagggctgcctgggtaggagagacggcagcccccagagctgtcctggactcccttctcatctctccccacaggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctccagatgggttgggtgctggaaaggacatgtgtggggtgaggccatggggcagattcggttggcaaggatggaaaaggtgctgccaaagacaggcatagaagaggtggcccaggaggattgtgccgggaggcagaactcaaggactggtccttggatcagagaagaccagctctggtctggggaggaatgggaggaggcttgagcccagctcctgcttcccccaccttgctcggcattgggctgggaagggggccagatccaaaggacagaagcagaaagcacacgaaacctgggagtctgtgatgccagatcccgcgagggccctgcgggagttttggggggagcagggctctt

SEQ ID NO: 42791 - DNA, 1047 bp, Homo sapiens
tctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacagactcagctgtttctttccttttactactaccagttgctcccatgctgctccaccaggccctgtttcggatgccaactggcccactccccaagcacttgcccccagcttgcgaccattggcactgggagggcctggcttctgggctgatgggtcagttgggccttcataaacactcacctggctggctttgccttccaggaggaagctggctgaagcaagggtgtggaattttaaatgtgtgcacagtctggaaaactgtcagaatcagttttcccataaaagggtgggctagcattgcagctgcatttgggaccattcaaatctgtcactctcttgtgtatattcctgtgctattaaatatatcagggcagtgcatgtaaatcatcctgatatatttaatatatttattatattgtcccccgaggtggggacagtgagtgagttctcttagtccccccagagctggttgttaaagagcctggcacctacccgctctcacttcatctgtgtcatctctgcacactccagcccactttctgccttcagccattgagtggaagctgccccaggcccttaccaggtgcagatgcccaatcttgatgcccagccatcagaactgtgagccaaataaacctttttctgtataaattacccagcctcgggtcttcgtttacagcaacgcaaaatagattaaacccccataaatgttcaaggataccttgccccac

SEQ ID NO: 42792 - DNA, 1003 bp, Homo sapiens
tagtaagtggggcaaaaaagcagagaggcctgcagctggcagtggcgataggtccctgagagccagcacgtagcctccttaaccactgctgtgctctgtgtggtacataagtgtgtggccctgtcaccttgcccacttgcaggtaagtaggagagagacaaaggctgggaggaatttcttgtttgcctctcacacattgaattgagggctgagaggaggaatgtttttggtgatggtgggttattttcagggacggatcaggaagaatttccttagagctatttccaaacttggctggtaatcagagtcagttaaaaagatatatatggccgggcgcggtggctcacgcctgcaatcccagcactttgggaggccgaggtgggcggatcacgaggtcaggagatcgagaccatcccggcaaacagggtgaaaccccgtctctactaaaaatacaaaaaaattagttgggcatggtggcgggtgcctgtagtcccagctgcttgggaggctgaggcaggagaatggcgggaacccgggaggcagagcttgcagtaagccgagatcacgccactgcactccagcctgggcgacagaccgagactccatctcaaaaaaaaaaaaaaaaaaaaaaaaaaaatatatatatatatatatatatatatatatatgtataggctgggtgcagtggctcacacctgtaatcttagcactttgggaggttgaggcaggaggatttcttgaagccaggagttcgagaccagcctgggcaacaaagtgagaccccatctctaaaaaaaaaaattagccgggcatgttggcacacacctgtggtcccagctacactggaggctgaggcaaaaggatcgcttgaacccaagaggttgaggctgcagtgagccatcctcacaccactgccctccagactgggcaacagagcaagaccctgtctcaaaaatacatacatacatatagatatgtgtgtatgtatacacacacacacata

SEQ ID NO: 42793 - DNA, 1290 bp, Homo sapiens
tttatccctacactctttatagtacggtattttcttttctttttttttttttttttgagatagagttttgttctgtcacccagactggagtgcaatggcgatctcggctcactgcaacatccgcctcctggattcaagcaattctcctgcctcagcctcccaagaagctgggattacaggcgcccaccaccacacctagctaatgtttgtagttttttagtagagacgggttttcaccatgttggccaggcttgtgtagaactcctgacctcaggtggtccacctgcctcggcctcccaaactgttgggattacaggcgtgagccaccaccatgctcagccttctttatgtttttaaaggccattaaatggccttgagtccaggagttcaagaccagcctgagcaacatggtgaaaccttgtctctacagaaaaatacaaaaattcaccaggtgtggtggtgtgagcctgtagtctttgctactcaggaggttgaggtgggaggattaactgaacctggggagctgaaggctgcagtgagccgtgattatgccactgtactccagcctgggcaacagtgtgagaccctatctcaaaaaataaaaaaataaaaaaaacataaagagatgttcgacctcactcttaataatacaaatgtggaataaactacaacgaaatattctttttttaaacttttatactttttatcacagtgataaagatcaaaacatttgaaaatgtgatctgttatttgtctttcgcctgtgtgtctatagaattatgcaatttttactgatttggaggagctttgtgcatataaggaaattagctcttgtgataagtattgaaaatacattttttcagtatcttacttttcttatgatttttgtatcgatttttctgaagtcttttgtttaaatcttttatttcatgatgtgtaggctttgtgtcatttcagaaggccttctccactccaaggtttaaaaaatcatttcctggccaggcgtggtggctcacgccgtaatcccactttgggagaccgaggcgggtggatcacgaggtcaggagatcgagaccatcctggctaacacggtgaacccccgtctctactaaaaatacaaaaaaaaaattagccgggtgtggtggcgggcgcctgtaatcccagctactcgggaggctgaggcaggagaatggcgtgaacccaggaggcggagctcgcagtgagccgagatcacattactgcactccagcctgggcgacagagcaagactccatctcaaaaaaaaaaatc

SEQ ID NO: 42794 - DNA, 1034 bp, Homo sapiens
gtgggcacctgtattctcagctacttgggaggctgaggcagtagaatcgcttgaacccgggaggtggaggttgcagtgagccaagattgtgccattgcactgcagcctgggcgacagagccagactctgtctctctctttctatatatataatatatgtttattcatttaacccttaaaccataccataaggtaagtactaccatcttagaaatggggaaactggccgggcgcagtggctcacgcctgtaatcccagcactttgggaggccgaggtgggtggatcatgaggtcaggagttcaagaccagcctggccaacctggtgaaaccccgtctaaaatacaaaatttagccgggtgtggtggtgggcgcctgtagtcccagctactcgggagtctgaggcaggagaattgcccgggaggcagaggttgcagtgagctgagatcacgccactgcactccagcctgggcgacagagcgagactgtctaaaaaaagaaagaaaaaaagaaagaaagaagtggggaaactgaggtacagagaggccaaataatttgccaagccagccctgggattcaggtcctggaagtgtatctccagccaccctgccatgctacctagatacctttccctaaacaagaggctcgtccctgagctgccttgacaccgtcttttcccatccctggtgccagaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggtcagccgcgggagggcaggcccggggggccctcagcctggaacgtgggaagagagccagagggaaggggggcaaagaggtcttggtgggggtccccagggaagggtcatgatcagaagggtctggggctcagt

SEQ ID NO: 42795 - DNA, 1033 bp, Homo sapiens
agccacagtgcccagcctcacagcttgttaggtggagttgggtcaggatccagccccagtcagctcctggccggtgcacttgtgtgatgaacaccctgagtaacctactctgcccacttggaccaacctaggtcgtttggttatctgtgtgcacattaattcgatatgtactgtcaatcttctggagcttggttttcatcttctttctgtccccggcacacacagctctcacagcatgcgtggaattagtggtccctaactttcctgtctcatgctgccatcccatagtaagcctcagcatctatttagctcattgttgttgggttttctttgtaaacctcagtttcctcaccctgaactgccagccttctgttcagtcacctctttcccctctttttggcatagtgtctggccctctgatttgtgcttcgttatcatgctgtcctagtatggtaatcactagccacatgtgttgaactagtccagcctgggtgcggcggctcactcctgtaatcccagtactttgggaggctgagacggacggatcacttgagctcagagttcgagaccagcctgaacaacatagtgaaaccccatctctacaaaaaatacaaaagttgcctgggcagggtggcacatgcctgtggtcctagctatgtgagaggctgaggtgggaggcttgcttgagcccaggaggttgaggctgcagtgagccatgatcttgccactgcactccagcctgagtgacagagtgagaccctgtctccaaagaaaacaagacaacaacaaaaagaaacaagtccaaattgagatgtgttgtaaaatgtgaaatacacactgtattaaaaaaaaaacttagtgggaaaaaaatgtaaaatatctcattaataatttgttacatggattacatgttgaaatgattttattttgaatatattaggtttgtaaaatatattgatattagttttgcttgtttcttttaactttttttaagtggccactagaaatttgccatatgtatgtggctcacata

SEQ ID NO: 42796 - DNA, 1073 bp, Homo sapiens
gcccctccgaggcggagtcgcaactaggactgagcacggccgccgtgggcgccatggcccccccggcgggcggtggagaccctgaggctccagctcccgccgcggagcggcccccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaaggtactggggccgggctgcctctctaggagaggaagggaggggaggggaactgcagatcctctcggcacggcggcaccaccctccacgccctcctttctgatcgcaggaccggagataccccttgtccccttaaacccactctctcagagatgccccccagccggcccctcgtgctgggagcggagactccaggaggcacggccgtacttcgctctgaataacatggaggtagcgctctcccctactacttggaataggcagcgggaggagagacacctaatagtacgtcccgcggccccaacacgctcccgggtgtgattttccagcctatcggggaagagacctcgatagtatagaaaaaccttaccgctcacgggagttcacacagcaataaggatgaaaagatctttaatacttggagaacgagtaaggtgtagtcaccttgcatagaaatcgtcagagttgtctggtttccatacagttgatgactttctgcctttctgtggccaaccgtggccatacagcaacacgatgctgtgcccttcatttccagcgactgcgatattctctcttccctgaatatgtaaaagggtaatggagagattctcctcactctttcgtgttaagagctttgtcctccctgctgggtatagttggtcaccaggattattaggctgtgtatgaagagaatgaatgtcttattgattgctttattataatctgaaagtgataggaagaaatgctgctacttttgggaaagacgatctttgtggggtt

SEQ ID NO: 42797 - DNA, 1031 bp, Homo sapiens
ttttctattttcagtagagatgaagtttctccatgttggtcaggctgctttcaaactcccgacctcaggtgacctgcctgcctcggcctcccaaagtgctgggattacagatgtgagccattagccttttatgtgccaggagttgtcataggggttctgtaatcctcacaaccatactatgagatgtaggtggcattatttccattttatagatgcagaaatgagatcctgggaggttaagtgccttgcccaaggttatacatctagaaagtgtcagaggtagaacttaaatccagggctgtccgtctccaaagcccatgtccttttcattatgccacagtgattctaacttcttagatgctgagttcttgctttctcccagaggtcttttagaatactaagtgaactctaaggcgtgtctgtctggctaaggcttaggtcatcccaagaccaaagtaaggcaggtctgagttagagctttaggaagaggatgggagaaaattgtacaaatgtagaacttgaaagaattgtaaatttagaagaggagaataaaagcatcttatacagaaaagcatttcaagatcaatgatgcagcttcacactggtaatttactgataatctgagaaatttatccatattttaaaagttataaataaatttggagtacctgaggaatataccctttcttcctgttcagctaacactttttccctattctttaagcctcaccatctctatgagtcaatctttgataagagcttttgaaaattgcaaagggaagaatattcctactgtataccaggcattgtacttagagctttacatatactgttttatttaattctttttttttttttttttttttttgagaccaagtctcgctctgtcacccaagctggagtgcagtggcgatctcggctcactgaaacctccgcctcctgggttcaagcgattctcctgtcttgccctcctgagtagctgggactacaggtgtgtgccaccacacccggctgatttttttaatttttag

SEQ ID NO: 42798 - DNA, 1091 bp, Homo sapiens
agggaatgtagacacagaaataactaaatacagtgtagtttgatataagcaatactggaaacaggaattgtagtttgaagaggtcagcactgaaattgaggtgaaacccaagaggtttcaccatgtgtcagaacctctgtggccgggcgcggtggctcacgcttgcaatcccagcactttgggaggccgaagcagcagatcacttgagctcaggagtttgaaactagcttgaccaacacagtgaaaccctgtctctactaaaaatacagaagttagtcaggcgtggtggggcgggtgcctgtaatcccagctgcttaggaggctgaggcaggaaaatcgcttgaatccaggggtggaggtggcagtgagctgagatggcaccactgcactccagcctgagcaacagagcaaaactccgtctcaaaaaaaaagaacctttgtgaggtttccttgttccagctttacaagtctagaaattcacatttttgtgcaatcagggatcatttacctgttaggactggctcagactaaccaaaatcatgggagactcatatttaaaacaaaatggtaactcttaatttacagtcatgtataacactcaagctaatctgataaacgtgtaaatcagaggatattctggaaaatctatatgggaggtctaattatagttagagacagtttattaagtttggaatcatttagatccttgctattcaaactgatccttgcttttcaaaccagaagcattggttatcacctgggagcttgtgagatatgaacaatatcaggtaactctggctctgtactagcatatatctgtcagaacctcaattttgtattcgttgttgagtagatgttggcttagcaattagtctcatttcatgtttctcatttttattaattttttttttttttttagagatgggggtcttgctttgatacccaggctggagtgcagtggtgctggagtgcaatggtgtgatcatagttcactgcagcctcaaactgctgggctcaagcagtcctcctgccttagcctcctgagtagcttgggattacaggcccaagccactgtgcccagcttcatgctt

SEQ ID NO: 42799 - DNA, 1029 bp, Homo sapiens
gtgcaaccatcactactactcatcttctgaagttttttcatcttcccaaaccaaaactccatacccattaaacagtaactctccattccttcctcccccagcccctggaaatcaccattctattttgtcttttatgaatttgacttctctaggtaccttatataagtagactcatacagtatttttccttatgtctggcttatttcacttagcataatatcttcaaggttcatccatgttgtatcacatgccagaatttcattcatttttcagggtgaataatattccattttacatatacgtaccacattttgtttattcatttgttaatgaacagttgggttgtttctaccttttggctgttgtgaataatgcttctatgaacattgccatacaaatatctgttgaagtcaatactttgagttctgttggttgtatacccagaaatggaattgctgggttatatggtcattttatttctgacgttttgcaaaactgtcataccgttttccatagcaactgcactgttttacatttctatcatcagtgtacaaggattctaatttttatacatcgacaacacttatttcgttttttgataatagtcatcctaataggtgtgaagtatgttggatttgttttttttttttttgagacggagtttcactcttgttgcccaggatgagtgcaatgatgcgatcttggctcactgcaacctctgcctcccgggttcaagtgattctcttgcctcagcctcccgagtagctgggattacaggcatgtgccaccacgcccatctaattttgtgtttttagtagagacagggtttctccatgttggtcaggctggtcttgaactcccgacctaaggtgatccacccgcctcggcctcccaaagtgctgggattacaggcgtgagccaccacaccctgccaagtatgtagaattttaaaatcacctccacaatccagtttcagaacattttcatttcccccagaagtcacttttgcccatttgtggtcagtccctg

SEQ ID NO: 42800 - DNA, 1028 bp, Homo sapiens
gagttattatagtggcttatacattttatggtttctagaatctttttgagtgagaatcattgagaatatttgtgtttttaatctcttctgtttatctcttctgttgatgtgctttttgttaattatttggctggcttttagtggatcttgcacaatttaatgctggcacatgataagttcataataaatgtttctgattatcgagctgagccccagtcatgaaccattgatttctaacatactctctccctttagcaacctggttacctctgcccttaaatgaacataacccctgatgccatgacatacatggagacttcagtattaatttttcagttcttgtatgtaacactcttaggtagagtctctgtcagatggcactgataattaatcctttggaaagatcccaagggctttcaggctctctggctagatgttaacaacaggaacagtgagtagtatatagcaacatgatacttgacagttttaaagcaacactggttttatttaagatcatcgggttaaaccagctaatactcctttggcttaaaacctacttgtagtttttactgtttggtattctcttctcagaattgttctttatatatgtagcagaggctgcacgtgatggctcacctctgtaatcccagcactttgggagggtgatgcaggaggattgcttgagcacaggagtttgagaccagcctaagcaacatagtgagaccctacctttccaaaaaattaaaatattgtctgggggtggtggcacatgcctgtaatcccagccacttgggaagttgaggtgggaggatcacttgagcaaaggagtttgaggctgcagtgagctatgatcgtgccactgcactccagcctgggtgacaaagcaagaccttgtctctgattgattgatagctaggtaggtaggtaggtagatagatgattgattgattgattgattgatagataaatagatagcagagatcatgacaagtctgtgtcccacttgaagattagaagactcagcaggt

SEQ ID NO: 42801 - DNA, 1047 bp, Homo sapiens
caaggcttgtaagcgagaagcttaaggttcctattcaaggttaactattgttatgatgttggtgctaggaaaataacttccctcaacctcagtttttctctttgtaaaggaagagtgaaaacgacgactcactctgttgtggggaaatacttacaaaaggaaataaaatttaactagtagtatggtcaagaatgtcagctgaggttggccaggcgaggtagctcacatctgtaattccagtgctttgggaggttgaagcaggcagatcatctgaggtcaggagttcgagaccagcctggccaacatggtgaaaccctgtctttgctaaaaatacaaaactagctgggcatggtggcatgtgcctgtaatcccagctacttgggagactgaggcaggagaatcgcttgaacccaggaggcgaaggttgcagtgagccgagatcatgcctttgccctccagcctgggcaacgtgagtgaaactccatctcaaaaaaaaaaaaaaaaagctgatataagacaaattctgatttttaaggtaatgtgccttagttatgcctgcttagcttgtgccagttaaggctttttactttgattttaagtttccttcctcctacttcatccttttgttgagttgtcattcagatcacaacagatactcttgtataactgtctttgttggcttagtcttcaacaggtggattgatcttggacttcaaatatttgagcatttactatatgcaaagcttggaactgggtgcatagggaataaatataaaatgtatacaagtgtgattcctgcccttcaatatacaatcattcaaatacttgtagacagttctgctcttacttttcctaccccagatagtctcttctccatggaaatcattcctgcttctcttaatcattcttcatatgatgtagtcggccaggccattactaccatcctggctatcagcatcacttgtaagaggtcatgtttcaaattataattctcagggtgttgcttgacctgtttcatatttcaaattataattctcagggtgttgc

SEQ ID NO: 42802 - DNA, 1022 bp, Homo sapiens
aatcttagaatcgttgttcaaccaattgtaaatctatcacttaactagcataagaaagttaatcttgatttcagcaatatgtattggacctactttatgttatttctctgatctcttagtctaatacttttgtcaaaagtaaaatgaggttagcatgattgtttttcttggtgaaccccattctgactcactgtgttctctgtaccccttccctaccccaccgtaggctaacataggaaatctttgttaaacccttaatctatgatttcaataatctagtctctttttttcctttgaaattgagaaaattaaaattgcactttattgtttctagtcttctagcttctcttccatttttcatgagagatcatggagatcttaggctgtaatttatctggttctagatatttgcatttactaaaagctactgggtgctcttttattatcttttctcctatttcaggcttcagtttcctcttaaccatttgcattctcttttcagtatggaaagttactctggataaagaaaatgcaagcaaaataagagttgaataggtttgattttctgtattattttttaacatggtagaagggcctgtctcatatttttgcatataacatcactgaaaaaagactatatgtttgcacttttcataagcttatattgatattctattatgtgccaggcactgcattagattcttgggctccaaatataaataagatatggtctctgttctcaaggaggtcacaatataattggagagatacgtatttatataaatatttactgtatagcaagagccgctggccaggatcagaaaacatactttgagggttagaaaaataagacagggatttatgctgaataaggtggcgaaatgtacattttcaataagctataggaggagtcatgaatatttatgaaaggagaaacatgtacatgcacagttgagcttcttacccctttatgggttgcatgtacagagaaaaggcagtattagcatgatccaagggtggag

SEQ ID NO: 42803 - DNA, 1047 bp, Homo sapiens
agtgcacatttaactagttttcaatacattcgctattttgctcagccaacaaatgactgttaacaattacaaagttgtttcagcctttatcggttaggcttctttggttgcaaaacaaaccaaaattgactttgttcaattgacttaagcaaaaaaggtagtggatgagaaggagggaggggaaaggataatagaggtaagtcacagaataaggaaatgctaaagaattacaccttggggctgggcgtggtggctcacgcctgtaatcccagttactctggaggctgagtcaggagaatggcttgaacccaggaggcagagaggttgcagtgagccgagatctcacaattgcactccatcctgggcaacaagagtgaaactccgtcccccgccaaaaaaaaaaaattacaccttgggagaaccctgaactaaagtatctcactgagatctagatagcataatggacataatggtttttatcagggtaacgtcttctggacaaatcactcatataattgagtatctaatttaataatggtactgagctagatactgagggcggggaataggaggggcaatccaaagctgaataaaatatattacatacctttggaggattataatagagtagaattaatgaatcatgtctatcacttattcaaattagaatgtaataaataccataaatgctacaaaagatattaaacaaagatgattagatgattttgtatgactaaccatagcaatattttaacattttagatacaaatagattttaaaggaaagatagacataagaaaatgtcagataaattttttttttttgcccactaaacgcaaaatatttatgttgtggagacatagtaaattatgatacattcatagagcataatactaagcagccatcagaaatgatgttgcacaagtatgcctaatgagaaggggaaatgatcattttgttttaagtgaaaacaaaaaaagattatgaaatcacacaaatagaaaatctgaaatttaacatgagtggggtgtgtggtgtatgtatgag

SEQ ID NO: 42804 - DNA, 1622 bp, Homo sapiens
agacttgcgatagaaaaggtggatgtggcttttgtctgctggagtgaatcccaataagattcataggaaatccacaagattttaaagaaatcataataataaaagaggaacagagacagtagaaagtgaaaataggcctttagatttccaatcatctataggcaggaaacaagcttataaggccactccattgcaaaaattaacccatctcttatgtaaaaagaaggttaattcagaaacttagagggtggagccaagggttgtggagagtcattctcaaggtgtaggacttggctgtaatagaggaactggtgatatgtgtctgattagatttcagaattgttatgggccagtaactgttatgtgtctcctgttccttctccctttttcctcacattttgaatgagagtgtctattgtgcttatcttaagtcagtctcactattgtatgtttgtatgttgggtgtgtgggagcagataatttgtttctttaattcagatcaggaggaactatactgcagtagctgtacctgaggaactgcatctgaggagcctcaaccacatctggacctgatttagatatcgagattctggacatcaagctgatgccataatgaaatgagacttttgaaggtcttagaagagggtgagtgtattttgcatgtgggagggccttgttggggccagagggtggtctgtggtagcttgtatccaaagtggccgccaccaatttcttcccttcttgctattcagtggtggagtctatttcccttgtccccttgaatctgggctggctttagtgacttgcttaaccaatagactgtaactttctgggacttcagaggctaggtcatgaaaagccttgtgtcttctgcctgtgcccgttggaatcctctctcttggactgcttgcacatagaacccggtcaccatgctgtgagaatccccagccagatggagaggacacatgtaggcactggttgatagccccattgagctaccagcaaagagccagtatcaactgtcagccttaggagtgagtgaaggaaccatgttgaataatccagccctagcagacaccatctggagaagagccaaggtttcagacttatggcacatgttaagacatctcagccatcttcatcctttcagggcatcccacctgagtttcccagacatcgtcaatcagagacaagcggtctctgctgtgccctgccagaatttgtggcccacagaatcatgagaataataaaatgattattgtttaacactactaagatttagaatagtttttaaatttagccgtagataactggaacatggccaggcgcagtggctcacacctctaattccagaactttgggaggctgaggcgggtgggtcacctgaggtcaggagtttgagaccagcctggccaacatattgaaacccaatctctactaaaaatacaaaaattagccaggcatggtggtgtgcacctgtaatggttgcaggcgcctgtaatcccagccactcaggaggctgaggcaggagaatctcatgaacccgggaggcagaggttgcagtgagctgagattgtgccactgcactccagcctgggtgacacagcaagaccttgtctcca

SEQ ID NO: 42805 - DNA, 1029 bp, Homo sapiens
atatttgggagttttgcagatattttcctttgttgattcctaatttaattccattatggttagagaacatactttgtatgactctaattcttttatatttattgaggattgatttatggcctcaaatatggcttatcttggtaaattttttatatgcactgaaaaaatatttttctattattggtgcatttttcttgtgttttttgttcttatggttcatttagcatcttagatctatgagtttattgtcaatatcaaatttggaaaaatttggccactatttctttaaatatccctgtttatcctctctttacttctgggaactctagttacatgtatattaaactgcttaaagtgttcccagaattcactcatggtctttttattctttttccactctggtttactttgggtagtttttattatgtgtcttctagttcactcatctcttatgttttgtctgatctgccatcagtcttatccaatgcatttttcatattagacattattctttttatctgtagaagttggatttaggccttattttctttctcccatgtttctacttagctttttgaatatggaataactttgttaattcccttgtctgctaattctaacatatatgtcaattttgttagcttcagttgattgatttttttcttcttcatgggtcatattttctttgcatgtttgataaatttttgtggattataaacattgtgaattttacctgtttaggtactggattttttttttatttgttctgtgtcacagttaatttattaatacagttgaatcctttccttaagatttgtttcaaaaacatagagagaagagggggagaaaaaaaaatatttgttaggtggggccagagcagttttccatctagggtagttactccccaggatccttggaatactctacctcgtgccttgttaattacggggttttccagtttggctggtgggaacaggcattgttcttgttctgtttgagtgccagttagtgttccctctagttttctaa

SEQ ID NO: 42806 - DNA, 1047 bp, Homo sapiens
tcaagtgatcctcctgcctcagcctgcctaatagctaggagcacaggtgtgtgccacaatgcctagctaatttttaaattttttttgtagagatgggatctcactatgttgcctaggctcgtcttgaactcctgggttcaagcagtcctcttgccttggcctctccgagtgttgagattgcgggcgcaagccacctcgtccaacctgtctctttttgtgtgatgttagtaactattgatgatttttacttagatccattaaatcattaagagctatacaatgatgatattctagttctattattctttcatttattagctggaatacttctataaagagaaacctccccttttctaatcttcgatttacccagtggtataatacatattggaaagtcaggatgaatattttgttctttccccttgtttaccaattttcagaatactgtattggttcactagcattctccaattaggcattggttttggtgggggtttttttggtatcataaactcttgggtttaaacatttttgaatatgtttcaattcattgcatttttttccttttctagtgattttactgatatatttcttctttctttctttttttttttgagacggagtcttgctctgttgcccaggctggagtgcagtggtgcaatctcagctaactgcaacctccgcctctagggttcaagtgattctcctgcctcagtctcctgagtagctgggattacagccatgcaccacctcgcccaactaattttgtatttttagtagagatggggtttctccatgttggtcaggctggtctcgaactcttgacctcaggtgatcctcccgcctcggcctcccaaagtactaggattacaggcaccatgcccagtggcatatatatttcttctaataaactcagcttgatgatgaggacgtgtcttagacatctttctgtccatggtgcctagtgcgtggctttcaataaatgtcaaatgaatgagttgatattctgagcagcatttaaaaataagagctagtggctgggcacgg

SEQ ID NO: 42807 - DNA, 1051 bp, Homo sapiens
ccctgtcagaagctccctgcctctcacccccacccgtatgtaaccactattcagacttacatcaccccataaattaggttttctgtttctaaacttgagccctacttatttaatactgttaggtgtaatactatagcctgaccctcttcaccaatccctgcttctgcacttgctactttttaccctgcagtactttttctttcttctgtctctcttaaccactttctaacatataatttaatatgtttgatatttattgtctctctcctagaatctaagctgtacaagggcagggatttttgttctgctacaaccacccaaaacagtccctaatacacagtaagtgttcgataaatattagtgaaatgaatgaatgagaggtctggtgaatggatataaatttgtaggcaatccagatgggaggattcagaaattgaagaaaatctcatgttgtatttttgtttttagagaataagggataaaattgtcttttgggagtacagaggaggtgataggattggggttttgaagacagtgaaggaagtttgaaatgttagaagcatgggagattgaggatttgggcaatgtagatttattgcttattgttggaggctcagtgttctggccgtgagtgtggttcatgtaataccagccaatgtggttgaatgacttacttcagcagaacttagctcaggtgtagaaacagagaaagttgacagtgttttttgctgtgtagtttcagtggacagccagacagacaaaggagttagccagatactgactgaagtgataataccttgagttttggctagcctgagaaagaagcgatagtcaagaaaaacagattgggatagtacaaaaggatcgtttccagaggtatggttgagttcaaactatttccaaatagacacaatgaaaaaaatagaatgggatattgataaaaggattagcagttgtcataaaagttaagataccatagttgattggttttaaggaatactttcttttccattttaacatttctaaagttgagatgccagtttaattggta

SEQ ID NO: 42808 - DNA, 1074 bp, Homo sapiens
ttttattaaaaactgcaaactggtttttaaattggttgtattgttttatattcatgacaatagtatgtgagaattcccatttctccacattttagtcgttctaatgggtgtgtagtggtttttgtgtttaatttgcaattccataatgtctgatgataaatccatgtgcttttatttttatttatctttgtaaaagtgtgggtgtctttttgcctaatttttaattgggttgtttgtctttttgttgtaagtgttctttatatgttctaaatatataaatacattgccacataatatattttgtaaatattttctaccagtctgtttggcacagtgtctttttatcactgtttgtttgtttgtttgagatagagtcttcttctgtcacctaggctgcagtgcaatggcacgtctcggctactgcaacctctgcctcctgggttcaagcgattctcctgtgtcagcctcctaagtagctgggattacaggtgcatgtcaccatgcatagctaatttttgtatttttagtagagatgcggtttcaccatgttagccaggttggtctcgaactcctgacctcaagtgatccaccgcccatcccaaagtcttgggattacaggcgggagccaccacgtctggccttatcacagtttttaaaaaaattgagatataaataatatgccataaaatcttcctttttgaagttcagtggtttttagtatattcacaaggttgtacaaccatcagcatcatctgattccagaacatttttgccatcctctaaataaattcccctacccattagtggtggtattttcctccccccagcccctggcaaccactaacctactttctgtctctcgatttgctgattctggactttcatataaatggaatcatacaatgtatgatcttttgtgtctggcttctttgacttagcacatatcattacttcattcctttttattgccaagtaatgttacattgtatggatatacattttgtttatccagtcatcagttgatgcacatttgtaaaacacaatgtctgtatcttaaccttgaatcctacaacc

SEQ ID NO: 42809 - DNA, 1709 bp, Homo sapiens
agaggttaaataacttgtctaaaatcacatagggagtgggaaagctgggactcacttttatctgcctgacttcaaaattcatacctcaattactatatttaatgattttataaatataaaaatatggcataatacttacataaaaaaagttataagatgatatcattgttttgaagaaggatttattctaaaatgtcagcagtggaaatagttgagtattgggataatggttaatttttgtctcttcttttattattgttttccacagtgaacatgaatgactttcataactacagtttttaagagatactcatttcatagcagaagggtggagtgtattaaaaaaataaatattccttcttcccctctgtttctgggtgtatttctgagatatatttctgagtttgggtgtattcactcctgaagttgcatgtaattgcctcttggcactagtttataaaaactagaaagttgaaacagtgatgttattctgagatctgaagatgtaggcagatgaaatatgtttaaataatgacattttaaccattattcagtttcctagatctgggaccggggccactggtaacaggattcagaagccagaagcacagtaccacacagtgagcaattccccagactcgtctctttgagcttttcactagaaaatccttcttcacctctcctttctcccaattcctttttattaagagtcttttaacctggatgaacataatttgagccgatcataaacaaatagctctcttttttgcctgactttatgcatttctgttgccatgtaaaccaaataaagctagctgtgagcaaaccagctgctgcctgcagcctccttccctagaggaagggaaagggtggtgaaggtaattgggaaggactataagaagggtagaaattgagggaagagagtattctatttacatttctggtcctgattctcactctgtttatttggctatttagaatatgatgactatagttgacttagtcattcttcccagcagctgagagatatgggtgactaataattttttctctatttgtttgcatgttggaaatggttactattgaggggtggaattaatagagtctaagctatatttcagaactggaaaacttggaaaatgaatggttgtagggaatagcatgggatttatgattttttgtttcaaagagttacgctttgggtactggcattaaaaagtagttccaggggccaggcacggtggctcacgcctgtaatcccagcaccttaagaggctgagtccagaggattgcttgaggccaggagttcaacatcagccctggcaacttagcgagatctcatctctacccaaaaaaaaaaaaaaaaaaaaaatttttttttaagttccaaggtgtctaattgaatgtgccctagaggcactgtgcaaagactacatataggtggtcagtgactgtcaagtatttacactcacaattgaaaggacatgacagctgaggcctaaatcacatgacgtagtaactaggtaagtacttggaatcattaatgaaaagacaatgaggtgtttgcttaaattataaatattgattaggggtagtagaggtaatacgttattatgagaagagaaaagtgagtgtggcagttactcatttagttcagatatggggaaaaaaagtcatctcttctctgagctcaggaaactttggaagtc

SEQ ID NO: 42810 - DNA, 1029 bp, Homo sapiens
tcacattatcaagatggacaggaaatctaggctagaaaagaaggaaaatgaaactgggaaagagttcatgaataggaagacaatgataggatcattggctggagaacacagaattatatactggggccatttctgcaaatgaagtggtaggataggatgaagtgatctcagagtgacttccaggtttccgaaatagaggctcaattattgacataggtaatcctagaggaggaagagcaggtttgggggggtaagatgatgagttcagttttggacaggctgtgtttgaggaacctgtgggatgtataagtggagatgtccaatgagcaattaagtatatagatctgagagatctgggctgtctaagtagagatttagcagttatcagcatatagatgataactgaaacatggtaacagaaaagattatcagagaggatttgtgggataagagaaggtaagggtgtgtaatttcctttttctacaaccagagtggttgtggtggtggttggtatttggttttgttccttttccttcagtattgtgtctcctttttcaaataaatcctaggaaatacaacatggaatgatggtaagagcagagttaaagtcctgtctttgctgtttcctactatgtgccttgagtagttaaacttctcagagcctcagttttttcaactgttaaaaacagtggtatcaaaagaatgagaagacaaaccacagacggagagaaaatatttgcataagacctatatgataaaggactgttatccaaactatgaaaagagctcttaataataaggacacaaacaacctgattaaaaagtgggcaaaagacatggatagaaaactcaccaaagaagatatatagatgtcaaataagcatctaaaaagatgctcaacatcatatgtcattagggaagtgcaaattaaaatcatttgaaataccactactcatctattaaaatgccaaaattcagaacactgataacaccaagttatcaacacctaatgaggatgtggagcaaaag

SEQ ID NO: 42811 - DNA, 1031 bp, Homo sapiens
tgaagtaagccaacctgaaaaggctacatactgtatgattccaaatatgtgaccttctggtagaggaaaaatatggagacagtgaaacgatcagtggttgccaggggctgggagaagggaaggataaataggcaaagcacagatttttagggccgtgaaatcatcctgtataatgctacaatgatgggtacacatcattatacatttgtctaaactcatagaatgtataacaccaagagggaacccaaatgtaaactgtggactttgggtgataaagatgcgtcagtgtaggcttattgattaactgtaacagatgtaccactctggtgcaggttgttgacagtgggggaaactatgtctttgacgggcagagggtatatgggaactctctttctcctcaattttgctgtgaacctaaaactgctctttaaacgtctatttttaaaaacagaacagctgtgatatgaaactgcatggagacaggtcaaataactaaggactactggtctaaattcagaatcaccctcagctgtataggtatttatgtgttcacttgtggcttagcttactgctgcttaatgggaaagttttgcttcccttcctcacctctgttttttgtttttttggtttttttctttacagtgatagtgaacaattacagtccttggaaagactgaattatagcttaatgaatgtacagatacaaatgtctggatgtttatattgccaggggtagaaatgacgagggaaaacatgcaacccccacaattaaaaggcgtttatttcactattctaaggaatatttgaatctcctttcagttgtatcccttaccttgtttactttacacccaagtggcatttcatacttgaaagcttttcagatagatattacagtaccaatctactttgggtaccaggacctccttcccctgtggattccaaaacaatttctgaaaatatgggagaaggatcttcagttatacccacgtatacaaaatagcatatgtctggattaaagatacatctggaaa

SEQ ID NO: 42812 - DNA, 2083 bp, Homo sapiens
acttcttttttaatcagaccgttctcagtgatatatttctgaataagctgtctttgcaatgagttacttggttaaggatgaggaaagaagacagaagtcccttcttcacgattggttctttttgttcccaaactctacaattcttataaagtttgagatattttcagatttttccaaacaacaaaattttgtgtttgtatttgggatgctagcatagctttttacacatttccagagtgttactcatcagtgaagtctgctataacccgacacacaggtccctactgttatttccattaccaaatgaataggttaggcccaagaggaattgcctgacataaaatagtctaataggactaattcagtcagggttctgactgctgcttctcctagcagtaactcacagtatcacagctgctgagaggtaaagcttaatcaggcttgaatcataaaatgtgtatacatgttctgtgagatagattgtggattcttgattcatcatgctgtcttttgattttggaaaataatgaaacaagataacatcccatagtaaagttatattgtacttcatactacttttctacgtagaaactgaacccttttggttatcatctcatttattcgtaagatttttccggtggtagttgggggaaagagagagcatgaggaaagagggaatctgttacagtttacagttggataaattgaaaattggtcacttaaccacttagggttgaagctagatctaggatctcaggactactttagtaggttattggttgttcttgtttatttaaattatgactctgggctttagagtatgctgacaattacaaatattttagaaactctgttcaagtgtgtttgtacatacgtgttgggtttctctaaattttcctaggaacagtccttaatactatctcaactgtcatcatgagtttgttactctgtggcagaaatgagtacggattcaaagaataaatgagtaaatttatttattcatttatttataattcattcatttataattcagcaataacctttccactgtgtttgcagaactaataatatattctcttggtctggatctgtcagccatgtcgtatccacatagtagtacaatctagacaactgatatttttggttcttacctgatagcaggtccgtataaagggctctttgaggccgggcatggtggctcaagcctgtaatcccagcactttgggaggtcaaggtgggcggatcacctgaggtcaggagttcaagaccagcctgcccagcatggcgaaaccccgtctctactaaaaaggcaaaaattagccaggcaccgtggtgggctcctgtaatcccagctactaaggaggctgaggcaggataattgcttgaacccaggaggcggaggttgcagtgagctgagatcgtgctactgtgctccagcctaggtgacagagtaagaccctggctcaaaaaaaaaaaaagggatctttgaaaacaaatacattttggctcaaagaaaaacattggttgaattaactgtaactacttgactcctgttaagaaagtaaaacactgttttttccaggttttagaatagagaagtggtgtaaagatttttttctttgagttggtgtggggaaatggtaaagccagaaattggaatgcttctcttaaggggaaattttcaaattttgttttgctttttggttttcttctgactcattcttagaaactaaagaggcataggaagggcaatctcttctgggtagagttaggactccagtctcaacctctcaaatcactgccagccaaccacctgctgtttgggtagattagtaggagatgatggaggtataaaaaaagataaactgctaaatgattatgtatgtatatcattcttttcccattcaaaatcttaaagctgagtaagaacccttaaagatgttatatctggaactgaatttaaaatatgtgctaaagtgggtaatatcaggtatcatttattgagtgcttaattactgtatgccaagcattgcagtaaacactttacatacattatcttacttaatctgcttaacaacttgac

SEQ ID NO: 42813 - DNA, 1035 bp, Homo sapiens
acagtcctaaccaacacaggacaggtattctccatctggcatgttggttgctcctttcaacctgctatttgaaatggctcccttcaacatctttctgttcccacagtggggcttgctatggctaatgctgtacttgctgtatgtgttccaggcgagtctgcggacaccagaactgacctgggagcgagtgagatctcaagttgaccatgtgatatggcctgatggcaagaggatagtactgctggcagaggtaaggctgagactggcaaaaatactcccccacaacaggagagactgcaatacccaggtcccctcctcctcatgttctcgaatactttcaactcctctgttaagcacaagtttgactactttcccaatggattttacttctaattgtgaaagatcttttcattcagcaattaagaaactattttggttccccacttttcaccaattatcctgtctctccacgtcaatccacaggttgagttagataattattactatagaaggaattcacagatagaaccagtgccactttgagtgatgcatacaaagagataatgtcacttgtgggatgttttaatcactaagcacaaagtagatatgcccgactgtaaccaggactatcttaggcaagttctgggaatgtatgtttttactgatagattccctgtttttgaaggtccattcccttgaattgagccagatgagtagtaggtacctacctagatatcaattgctcaattgatatttccccatcctagctcctagctcacattgacactattgactttcattttattggcttccatgtcagtgtttgaccacttttcctttcttaaaagctcctcttccctagtcctggattcctgacagctataatattagatgccttctattcttaccttgaagctttctcttcttcagagaaagataccaaaatatcaaggaggataataatacttttctcaattttgattttcagttggttttttttctttttttatattaaagaacctgaatatgaaaatg

SEQ ID NO: 42814 - DNA, 1029 bp, Homo sapiens
gggcagtgatgagcttcctgcactggaattggtctttgcatccccaaccacatatgcttacatgaactcagaaaaatgaacccacttcccctcactgccaccttcaaaagactcttcaaggccttaaatagtattccccttcctgaatttgccttttggagatagagaggtggagtttgggtaagtggctatttgcctcattaaataaagttccccttcctcaattcctttccccatttcatcttgttgctatgatttttatctctttatggagaaatattggcctttttcaatgatgtgaaaaggaaacacagttatttcctgtcactgtacactccagaaaagtctctgcctccctgttacacctttaggcaggctcttcatgtcccagcatccccattagctgataacatcacagtctcatctttctttttccctccaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtg

SEQ ID NO: 42815 - DNA, 1023 bp, Homo sapiens
actggtgctgatgatgcagaggtgattaagactccttccttgaaagagttcatgtctatgtggggtaacaaacccataagcagaacatttccttgcttttggggaatttaagtaagagactggtacacatgtgaatgaggccctcagcccttgttgatgtcttcttatctttgtcagcacaagtatatctccatcgcagatgtgcagatcaagaatgaagaggagctggagaagtgccctatgtctttggtgagccaaggaagccctacacaggaggagagtagaagaaaacctgtcttcagtgttgtcacagagcatgtgtgcatgcattcattcagcatattaggctgtaactgtgttccaggcaagacaaggtccctactttcatgatatattgaagttggggaagaaagataaaaaataaaaagttaagtaaaccaaactatcagagaatggtaaatacaatgaagaaaatttaaacaggatgacatgaaagaagcatcagtagactacttaagattgggcagttggagtaggtagacctctgagaaggtgacatttaagccaagatctgagggacagggatccagccataggagcatcagaggaaagagcattccaaacagagagaacagccttagcaaggggaaagcaggcttaagagtgtcagaggtagtgaaggaaggctgttgtggctagagcacagggccgagggctgggatcctagagatggagtcagagaggtggcctgaggccactttgccgaggacctgtaagcaaaggtagagagcttgaagttgactcgcagtcaaagggaaggcagcctttggagatttgaagcaggggagtgatatgatctgatttatgtttctaaaaacattagcttctgtgtaaagattggaccagaaaagcatagacgcactctacggagattagttagaaaacccttgaaatagtcaaggtgagagatgatgccgacctggatttggagatgtagctgacaagacttgcagtgcatttgga

SEQ ID NO: 42816 - DNA, 1048 bp, Homo sapiens
ttctcagatcgctctgcttaagattctgctggctgcagctcccacctctaaggctaagacagactctatcaatatcctggcagatgtcctacctgaggagatgccgtgagtgcttcaacgggggcagctgctggatactagctgtcttatctgcaggctctctctagtccccactcaccttgttaacacttacagagattgtctccaaagagatctccccgtctctgcccaccagtaccccctttcccgtacagggctttctgcttggctctttttagctcagaactctggatctggagggtgacaccagtgccagcgactggctgcccaggtatttgggtgaacattgccaagggatgagcttgccaaaagagagacggaaacaaagagatcagtggagcatttcttcagataggctcataagtgggaactctggaggtttccctggcacagaagttcaagtttcccaagttctggctctcttgtgtatattgtatcagacccaaatacctggatccctacagggctccctttaaggccactctctgcactaataccttctctccccattgtagcatcactgttctccagagcatgaagctgggcatcgatgtgaacaggcacaaggagattattgtaaagagtatctctaccctgcttctgctactcctcaaacacttcaaactcaaccatatctaccaggtgagcagctaggagcacttctccacaggtcttgggtgtttgccaggccctatctctcaaaggaaggatgcaaagtcccttttaatcctgatgagcatctttcagccttttctttgtcctctctcagggaatccagccacccattgcatgagcttgaggtagggttatggagtgggaactgtcctagaaaggtgcagatgtctgtgtcccttgtaagttatcccagagttgtgggtaggaatctctagcttctcaggaatatgcccagccagtttttaaacaatgcaagagagaatgtaagcatttcacaaaaatgggggggtggggggagtatgttgaccgtagt

SEQ ID NO: 42817 - DNA, 1051 bp, Homo sapiens
aacctccgcctcccgggttcaagcgattcttctgcctcagcctcccaagcagctgggattacaggcgcctgccaccatgcccagctaattttttatttttagtagagatgggatttcaccatattggacaggctggtcttgaattcctgaccttgtgatccgcccgccttggcctcccaaagtgctgggattacaggcatgagccaccgcactgggcccaaattactattgttttaaagggaaagtgttttgaaagaaaacaaattgatagattgtgcttgttggaaaaaaatttttctaccaagctggctcatctgtcagaaaaaattcatttttaagttaggtgttgcttatgctttggaaaaaattttaaatgcacaaatatttcagtctagtgatatggggcaagacatttattttctccttgcaaattttttctgaccatgaaatgaaaataccgttgatggtttttgtagtgtctttctgaaatatgacgattatggaatactttgagatccaggatgatttaatgctaagaaattgctggcattcacatttctaaagtcgtgaataaaattaagaaattcaagcacattatgtgttcactagatcttacttgatttccaaaatatttctttttgaaattttagataattggtaatttttacttccttctgctaatctttgcatctttgaaattagattaggaggcagttttgtcagctaggccctagtttctggggcagtgatatccatacttttgcttgccaccctcaaaataaattaatgccacttgggattaatttgtgatttttctggggagagggtctacaacttttatttattttaccagtagtcttggtaaatacaagaatgatatgaataaatatgttgggtaatcttaaacttgtgttatgtgatttgtaattagcttgtgtttgtggatgatctttacattcagtaaatctccaaagagggcccagatagaatggagtattttgtcttttcctttgggaactttttttggttctttctttcattaaacaattat

SEQ ID NO: 42818 - DNA, 1032 bp, Homo sapiens
ttgtctgtcagccactctttggagtaaaaattgtattccttgtgaaaaaaagcagctaattcagcttacaacataaaacatagcacacacgctttttttttttttttcctgagatggagtcttgctcttgtcacccaggctggagtacagtggcgcagtctcagctcactgcaacctccgcctcccgggttcaagcgattctctgcctcagcctcctgagtagctggggttacagctgccaccacacgcctggctgaattttgtacttttagtgagacggggttttgccatgttggccaggctgttctcaaactcctgacctcaggtgatctgtcagcctcagcctcccaaagtgctgggattacaggtgtgagccactgcacccggcccgcacacacgctttttgagacagccatttctgaatgcagcagaaagctgaatgcaacacttctgaatgcaacagaagcgctttatgcatactttccatttgttacgcagaatagtagaaagacataactctggggagaagagttaataaaattaataatatttactctcatcaagcacattcttaaataaaatggacttttttctcctttttatcgtgagcacatgaaggtgaaagatataatggctactagtatagttttgtgctgttaccttaaattgtgctaagtgtcagtagttttaccccaccattgcttttgcatcataagtgtaaatataaatgcattgagaaaaggcaaatagcatcttatttattatgaaaataattttgacctcattgatgacttgaagaatctcaaggacccccagggtcccatggtttactttgagaactgctgttaagctatttgagggtcgaactaatcatcctaatatcccctttcagttcctggtccagaactttacacagaaaaggtgctcaaaggatatttgtttaatgaatgtggtatgctgacatttaaacaggacaaaacttggtgagtaaaattaatgtaggcagtctcccatccattcaggcagcttttc

SEQ ID NO: 42819 - DNA, 1067 bp, Homo sapiens
gttttgagcaaaattttttatattatgaaaatattataactttgaagttgatacttaaaatacttgagccaaagtttctgcctttatgtgggacattttcatgagctttcttatatcagtttgcttacttacttttcatagagttgagcgagactatagcaagagacccagggacatcttaacatccttgaatatttctgaatctttctaaggaatttgatttaatttttttttttttttgagacagggtcttgatttgttaccctgatgtgatcactgctcactgtagccttgatctccctgactcaagcagtccttccacctgagcctcctgaatagctgggatcacaagcgtgcgccaccatgccttccttctttttaatttttttgtagagatggggtctccctatgttgccaaggctggttttaaattttttctagaaacgaggtctcgctatattgcccaggctggtcttaaattcctagctcaatcagttctcccaccttggcctcctaaagtgttgggattataggtgtgagccatggaggctggccaggaacttgattttcagggagaagcctattcagtgtttccttggacttcctcagcctggttttatcatagcatattataagatgataaactgaaaccatctgatttgaaatcaccaacctgggaaataccagtcagaaattaattctatttttatgacattcttaaaagactgtttaaaactgaccaaagtaaaaaatcttcttttagagttataagtgtgtaaaaaaaggcatattcaaaataatgtatatatttaagtttactggacagatttaaatttgtgttctttgtgtaaggcatagattggaatgtttgctacaggtattttttggaacacggatttcagattgctgtttgcttataaatatgcatgactgctgaccttcagaactgctttaaatttctcaaaaaattttctcattatatgccaggcttagtggcttgtgtctgtaatcccagctacttgggaggctaagtcaggaggactgcttgaggccagtagttcgagacc

SEQ ID NO: 42820 - DNA, 1351 bp, Homo sapiens
tcctatggtaagactatgtttagttttgtaagaaattgccaaacaggcttccaaagtggctgatgtatatattttcaggttgctcgtgtgtttttcaaaaacaccttactcaggtatattgatggactgcttgccctgtgataggattacaagtaattgaggtctgtggggctggttgtccctacataaataataccagctggttgtacttcgcttgttcttgtttgctttctcttttctttatctatttttttccttttccatgtgtttttactctctttatcttgctttaccagttctgctttgtcctcagaaatcagaggactgcatttgttggaatagtgtataaatttaaaaggcaaaataaaacaagtccaagtcctttctcagggtctctaggcggttggggatggttgagattgtagcattaagtaaggtattgttggagcattaatttgactatatagaatataatcttcagagatgggaaaagggaaacaatacgttaataaaacttgctttcctttgtaatttgttaattatagggcaactgtataaaatgttttaagactatgatagcagaagagttttggtttttttcctacctttctctgggagagcttttcagcttctactgttacagtttttgtttgtttgtttgttttttaagcacaccacctttgggagtgttacagttctttaaagaggaccgagcctttgcttaaggctagcttcatactgtttgtataattctgtttgtatgtgcatttgtacatacccccagctgcagcagaatatcaatagattctgttctcccaggagaagggcaaggactgtatccaatcttatctggggtatgtatccaaatgacctaagacagtcttcctaataaacacttttggaccgcagggttcagactctcctggggtggaatctttttttgttacctttctttctgcctgctcgtttaagtcaggatgcatgcaaggcccacgtctccagtgcccccaagtggttgtctaggttttgcaagaggacatctagtgatgggagaactcactgcttccagccactctgtctatacaccccgttagaaaaatgatctgttgaccagaattttgccataatttcctaccttttttttttattagggtcacagacttaatctaattcctcttcctcataatggtcttttaatattttatgagagagattcctaaagtccttctttagatttaaacacctcttatttttctaactattcattaattaagcattttcatagtcccagtgaaatgtaacgggctttttctcgtatctttaaaagtggagtgcccagggctaagtacag

SEQ ID NO: 42821 - DNA, 1050 bp, Homo sapiens
acccctggctaatttttgtatttttagtagagatagggtttcaccatgttggtcaggctagtctcaaacttctgacctcgcgatcccccagccttggcctcccaaagtgctgggattacaggcgtgagccaccacgcccagcccaaagcttatttttcttaagcattatataaaagcatcattgttaactggattatcgtgttattagtattaaggaatatttacaaagttaacctattggtatgaaaaatatttgattagtcatacaattttgttagttttagatgccgcaaattaggagtttgtcttcctcaaggcaaggccacttctaaacttgaactgtgctgttctcagttcttaacgtaagaagggagctttatttatctagtgacagtttgctctaacatgtcatttaattttaattttcaaaaggatcagtttggaagactatatcatagctatttgtttttaaagctcattttgttaaaagtcaaagtaatacattcatataataaaagatgaaatagaaggacttacaataaaaatcaatagtcttttgccactctttccccatcccgagtcccacttttcagagacaattagctgttttttgtttatagtttaactgttttgtttatagtatcatcaaacagtaatgcctccataactctaaataatatgtctataccactatttcttgatttatcaaatgggcattattgactttttttttttttttttttttttgagaaggagtctcgctctgtcgcccaggctggagtgcagtggcacaatctcggctcactgcaagctccgcctcccgggttcacgccattctcctgcctctgcctcccgagtagctgggactacaggtgcccgccaccacgcccggctaactttttgtatttttagtagagacggggtttcaccgtgttagccaggatggtctctacctcctgacctcgtgatccgcccttctcagcctcccaaagtgctgagattacaggcgtgagccaccacacccagcttgactttcttttatggaatata

SEQ ID NO: 42822 - DNA, 1088 bp, Homo sapiens
ttagtggtacatgcctgtaatcccagctactcaggaggctgaggcaggagaatcgcttgaacccaggaggcggaggttgcagtgagccgagatcatgccatcgcactccagcctggggcaacaagagcgaaactccgtctcaaagaaaataaaaataaataaataaagtgcaaagtttgataatgtttctgctttgttttacgcaaagattactttatgttaacatgaagatgtcaacaactctctttttccccccttattttcctcttaaatagatactgtgtgttggaaggcacattactaagttctttacaggggcatctcatttaatccacctttctgtgtgtgtgtatgtgtgttgtaaaaaattcttattttatagtcaaggaagcagagctcagatatagcttatagccataaagaacaagtacattttactggacattaattctagatttcagaacatgtgggtaatttatggcttccttgaagtgataaaattctagaactatcaaattggactgtaatagagatagacttgggttaaccagacaactctattaatcatcttatctgcacttaatggtatagagataacttgatattgatgaccctaacttagaaatctatataggatcctaagatacattctgaatcatctaaagagagtaaattatattcaatattgttctaatattatgtgttgcactattttgtatctttataaatgagaaggttagcatgatttattggaaagaatactaactcagagtgagaagatctattctctagtctcaattctactacatataaccatggttctcactttcatcttctgatgaaatatatgccctcctaccttaaggagttagaggaagaaaaataaaatttggtgtaggaaaatgttttgaaaactaaagcatcacaccaaggtattattactaattattaatgttaattatatgtattgcctatattcatttttgaataacctgaacataccatctctcagccatgctttattagagaaagttcatgaaccaagaattttaatttttctcaacaattaagtgagacaacacaggtgg

SEQ ID NO: 42823 - DNA, 1774 bp, Homo sapiens
gaaatggaatcctccagtaaaaggtagtttccaaaactcaatgtattgtttcctgcttagttccttctactggctgttgatggaaagatcatctccgcatcattcttcactcctgccgccacccagccccaacaaccagtgtagcctttctgacttccagcccaagctggtcaagccttcccgtttatcctattctgtgtccagtaagcagaagcagtaaggcttgagtgcttcatgttttcaagggatacagaacaaattaagaggcttcggattattgtccttttgccctacaaaagaaactgcattttgttgggggtattaatccatgtttaagcagcaaatggctgattttacttgcttttgagaaaaatgtgttgcccttgcttatcagcgagctcaagataaataagttttggattattggggaaaataatgaacttttttcttcaggtatgttaggaagggtgctgccaaatgggatgctccaagaggtggtttctgaaactcgattgtattattccctgcctggttctttctactggttgttgacaggaaagatcagcttcatatcattctccctcttcttcattcctgatgcaattttatttttaatgggctcagggatttaaattaatggtcaagagtgtgagccttgacgccagactacttgggtttgaagcccagctctgtcacttacaagctgtttggcatcgagcagttgatttgaactctcagtagccaggctctcctattctgtaaaatgggagtgataacagtacattcttctaggagtgttatgagaactgaattactccatgtgaaatccttaggtcagtgtcttgtatacagtaagggctgaactcttgcggcatgccagctctactgggtaaggctgtaaatagagaatagagtgctctagcatatactctgccctcaaagaaatcatactcttattgcggagactgatttaagtaaaacacttagcaaacagtattacttagagtgtaactcactattgaattgtatggtaaagactgtgaacgttgtagaaattcagaggagggtgatcacctcccctaaatataaaatcagtgaaagtttagattgattatgatagatactagagagctgtgatggatttgtatacagttcactgtatgaggctgtatagtatggtggctgagagcagggttccaacgtcacatagattcaggtttgaatcctggctccaccatttgatcctgagaaacataacctctgagccttgttttccccattgttataatgaggataagactcatcacacagaatcatgtatatgagataatatagataaaattctcatcgcggtgtccaacctatagttagcatttcaagaattatagttattatcatttaagttgtattttaagagttgtctattctgaattgattatagtgagaggagattagaagatcagttaggaagaggcactccaggagcgccttgttaaggtcttggaaactgaagtagtaagaatggaggtaaagtgattcttttttttttatttgaaacggattttcactcttgttgcctaggctgaagtacaatggcatgttctcggctcaccacaacctccgcctgccgggttcaagtgattctcctgcctcagcctcccaagtagccaggattacaggcatgctccaccacacacggctaagtttgtatttttagtacagacagggtttctccatgttggtcaggctggtctcaaactcctaacctcaggtg

SEQ ID NO: 42824 - DNA, 1840 bp, Homo sapiens
atacaaaagaatgaagttggacctttacctaacacagtgtataaaaattaactcagagtggttccatgacctacaactataaaactctttgaagaaaacatggggcaaaacttcatgacattggatttgccagtaatttcttggatatggcaaaggaaaaatagacaaattggactttacgaaaattcttaaaatgtgtgcatcaaaagactatcagtagaggaaaaaggcaagccacagaatgggagaaaatatttgcaaattgtatctgataagggattgatatccagaatatatagggaatgtctaaaactcaacaacaacaaaaactctattcaaaaatgggcaaaggtcttgaatagacatttctccaaatttctccagagaagatatgcagatggccaataagcacaggaaaagatgtgcagcatcactaatccaaactacaatgagatatcacctcacacccattaagatggccacaatccaaaaaacagaaaataacaagtgttggtgaggatgtggagaaattggaacccttgtgcactgttggtgggaatgtaaaatgacatagccactgtggaaaacaatatgataattcatcaaaaagttaaaaatgggactaccgtatgttgcagcaaatccacttctgggtacatatcccaaagaattgaaagcaggatctcagagaaatatttgtatgcccatgttcacagcagcattattcacaatagctaaaacatgggagcaaccaagtgatcatcgacagatgaatggatacacaatggaatattattcggcctttaaaaggaaggaaattctgacaaatgctacgatgtggatgaatcttgagcacattctgccaagtgaaataagccagacacaaaaggacaaatactgtgtggttgtatttatgtgagatagagtagtcaaaatcacagagacaaaaaataactcaaaatggatctaagacctaaaactatcaaactcttagaagaaaacatgggggcaaaatgtaatgacattggatttgcctgtgatttcttagatatgacaacaaaggcacacacacctatagttccagctatttgcgtcaggaggctaaagcaggattgcttgagcccgggaattcaagaccagcctgggcagcatagcaagatcccatctctaaaaaaataaaaacaaaaatgaaaaaatcatcgaggcagaaagtagaatggtggttgccaggggctagggagatggtagaataggaagtttaatggtccagtttaaagttccagttttacaagatgaagagagttgtggagatgaatgatggtgatggctgcacagcattctgagtgtatttaactccctgaactgcacacttaagtgttaagaatgtaaattttatgtgcattttaccacaacaaaataatttttcaaactgtacagtacaatcctaattattatcttttttttttttttgagacagtttcactcttattgcccaggctggagtgcaatggcatgatatcggcccactgcaatctccacctcccgggttcaagcaattctcctgcctcagcctcctgagtagctgggattacaggcatgcaccaccacacctggctaattttgtatttttagtaaagacggggtttctccatgttggtcaggctggtctcgaactcccgacctcaggtgatccgcccgccttggcctcccaaagagctaggattacaggcgtgagccaccatgcctggccttatcttatctttttgaagttgtatttaagattagaaggaaataattatgatatttaaaattttcttttatacttaatagagtttgctca

SEQ ID NO: 42825 - DNA, 1049 bp, Homo sapiens
atactttcatcatgtaggcagaaggttccttaatggcattagtggcagaaagaaaagtacctggcactttgtttatggtaggtgcctaagaaccgaatgctctgttagttggaaaagtctttgaagaaagacatagtgctgtgtcctcctttggaataggaggaaacaaagtacctctgtcccgccagagaagaataacataggaaatgcaaagagccatcgtggcttctgagaatcattttccaaagatgccaaacaaattcaattctaaaactatagcctactttttctgtagggaaagaggcttttgtgcttatctaaatctagacagagttgatctcaaccagaatgctgtaggacaaaggacatcttatagccacacatgttcaggatgaaatggaccatggttggaattaaggagaacctctctctctagctagactcctacttctatttttttacctttttctattcctcatcagagtcctaaggcaccctgagcaaagggtaggatatctggcttatgtggcattcatgtgaagtgtgattgctcttattcactatggaactgctaaaaataacttcccatgtgggttcagtaggaaactttattatccattctaatcgacttgacctgtctgggagagaacagactgctttataattctggctcctccccagcatcaccttttcagatggatgaatttataataagtccaaggaccctctggctctcggccaagtagaaccgttcagccatacaataaagttgaaccacacccgctactattgattactggaagctgcctcttttcagtagcattgggttgtgtgaatcatttggtgtgatttcatgttgttggctacatttgtgatctgggaaaattctggttcgcatcctaaaagccagtatttcccccaaagcaggccatcctcagtctgtgactgccagtacttgctgaactcaggccttgagagttggaagttatctctttctgaatgcagcatttctgtatcaaatcagacccttgagttgtgccgtatcccag

SEQ ID NO: 42826 - DNA, 1042 bp, Homo sapiens
aaagaaggcataatacaaatgaaaatcatggcctttattattcatctggttatgctagtacttggtgtggtgactcctttgcaggattattttaaagaatggtggcagctatgttttactcactttagaagtcaaagactcacggtaaatcttagcagaggcaaataaaaacatgataccaaaacctaacatctaaatctgtactgtccagtatgatagctgttagctacatgtggctatttgaatttaaatgcaagttgattaaaatgaaataaaatgtaaaaggtagttattagtcacaatcatatttcaagtgctgaatagccacatacgccctgagatactgaatttttaatttaattataatttattcacatttaaatgtaaacaggcacatgtacctagtagccactttaatggactgtgtagatacagaacatgtctatcactgaagacagttctattgggtggtgctgatctaagggctatatcaataacactgtggtctcctggcaagttgtaccctctctgtacaggggaggacaacacaaatacttcatgagctttgtcttccagtgaccttctcagctcataaacagcatggctttgcttttaaaaaaaaaaaaaaaatctacccatgtgactgcagtaatccgcagccagtaaacagcagggtgggagggttgcgaggagaactgatctatttttatgcactgcagagtccaagcaggaaaacctgagaccggagacagtggtgacatcaagactcacttcctagtgagtttattcatgactcaggccatgtgcatatttccacttggattcctcacaagtgcaagtttctcttctaggctacaggtatctgcagccaggtgctgtaatggatttatagtagcccgccaaaagatcaaatatctgaagcctgacgggtcacaaagctgacaggagccatgactattgcatgaattccagatttcacagtgaaacagagctgctgctgaaaaatgggagcacagagctgttcactggggctcttgattct

SEQ ID NO: 42827 - DNA, 1047 bp, Homo sapiens
ttgttgctaacatgggaactggaaaactgacaaagaaaaagaaggaaaaatgtaacagttggtaaagctgggtaaaaataatactgtagtcttaacttaaaaattttaagtaagtaatgtgtataaaatccaaatgatacaaaaaagtatatggtaaaaggcaagtttttcttcttcctttgaccccagctaattgactgccttccctagaagcaaccaatgatacatttcctgtatattttttccaggttcaggggggacgggagggactttgtggagatggtagcattcctttgtttggatgggtatttaagatgtttacaatcttgctaatacaaatagtgatacaatgaatagccctatacatatataacttttgcacatgagagagtctttctttaggataaatttgtagaagtacagtttctgggtcaaaggatttatgtttactgcttaaattttgatagattctgtcaaatttcaagtttatgtttccctgttgttgttcgagtgctgtcttccttgttcttttggtaacggagtgggttatcaaacgttatttaaattgtcagtttaataggaatagttttcttaagtgtctttccaataggtagataaaagagccatttatttgtttcctttatctatagatctgtttatattttttgttcatttttctattgggatggttcatattgtttataaaggcggtacccaacctttttggcaccagggaccagtttcgtggaagacaatttttccatggaccgggatggtggggtggaggagtggggggaatggtttcaggatgaaactgttccacctcaggtcatcaggcactagagactcaaaaggagtgcacagcctagatcccttgcatgcacagttcaccgtagagttagcactcctatgagaatctaatgcttgatctgacaggaggccaagctctggcgggaatgctcactcgcccaccactcacctcctgctatgtggccaggttcctaacaggccatggaccggtaccaggggtccatggcctggggcttg

SEQ ID NO: 42828 - DNA, 1815 bp, Homo sapiens
cttacccacacaaaatgtaagttaaataaagtgtcgaggtgggaatccaactatacttttcttccagatggctgcccagttatggcagtgtccttcatttagttcagctttgccctgctgattgaaatgttgtctataggtgtacttagttcctacagtttgaggttattactggacttttattctgtttcattgatcagattacctatttatacctaatgactctattccttggttatcatcttccctcattctacttcccagagttttcctgggaagttttctttgtttatttttctatatggcttagaattagctaaccaagtcctgctcctctgtcctgttggcatttttattggtattgtattatatttatagattaatttagagataattgacatcgttttgaggttcaaaaacagggtctatattcatttctttatgttcaagaacagtatatgtggccaggcatgggggctcacgcctttaatcccaacactttgggatgctgaggcaggcggatcacttgaggccaggagcttgagaccagtctgaccaacatggggaaaccccatctctgctaaaaatataaaacttagccgttcttggtggcaggtgcctgtaatcccagctactcgggaggctgaggcaggagaattgttgaacctgggaggcagaggttgcagtgagccaagattgtgccactgcactccagcctgggtgactgaacaagactctgtctcaaaaaaaaaaaaaaaaaaaaaaaaaaaaacagtatatgtatttattgtcattcaagtattgttttgtatctatcaacattaaaaagttgtttatttttttatataggcctcacatttcttattatgtttattccttggtgtttatcttgtttgttgctattgtaaatggggtttctactactttcttttttctttttctttcttttttttttttttttttgagacggagtcttgctctgtcgcccaggctggagtgcagtggcaccatcttggctcactgcaagctccgcctcccgggttcacgccattctcctgcctcagcctcccaagtagctgggactacaggcacctgctaccacgcccagctaattttttgtagttttagtagagatggggtttcaccatgttagccaggatggtctcgatctcctgacctcgtgatccaccggcctcggcctcccaaagtgctgagattacagacgagagccaccgcgcccggccggggtttctactttcttttataacttttatgtggttgtttgaatatgagaatgctattaaattttgagtattaattttatacctagccacgttaagaattctaatattatctataatagtttcccagttgtttttctagagaataacaggtatagctaaataatcatatcattactgaataatgataattttatcttctccttttcatttttttttctttttttttaaataggcctggcgtgttggctcatgcctgtaatcccagcactttaggaggctgaggcgggcggatcacttgagggcaggagtttgagaccagcttggccaatatggtgaaaccccgtctctactgaaaacacacacaaaaaaattagccggatgtggtagtgcatgcctatagtcccagctgctcaggaggctgaggcaggagaatcgcttgaaccctggaggcggaggttgcagtcagcaaagattgcgctattgcacttcagcctgggtgacagagcaagactccgtctccaaaaataaaaaataaataaaaataaaataaaatagagatggagtcttgcta

SEQ ID NO: 42829 - DNA, 1079 bp, Homo sapiens
cttagtaagatatcattaatgtcctgaccaaacctacatctatgtctaacccacatctctctctctggcctgtttgccagcagcctctagatgtttctaccaactgacttatgagtacctcaaatacaacattttcaaaaaacaatttcatcatttttcctggcaaacctgttacttcatcctgtgctccttatcctgactaatttaatggctatatcatcaatttagtgagtcaagccagaaatgtgggaatcacattagattccttccttttactcattccttatagaattggtcacaattcgataaggaattgtgttgttgattcttcctccttaccctcactctatttgtccctttctacctctttaccctccgcatttatgtctttcattttatatttcagctatacagaagtattttcagttagttgccttaaattcttggaacaaggtaggttgagaggagagattttttaaaaacttggaatttcctgtgctacactgttttttgattctgtacataccatttcttctttctaaagtgccattctcctagtcatcttcttagacccacccatgtatactttaatctacatagcattttttcctattctctcttttaatcccagcactttgggaggctgaggcaggagaattgcttgaacccgggaggtggaggttgtagtgagctgagattgcgtcactgcactccagcctgggcgacagtgagactccatctcaaaaacaaacaaacccacaaatgacttatgtgtgtcaagtcaaagggacattttaaaatctccatctgccttgatctcccttcatttttaaacatccttttcccttttggcttcctgggtgtcaggtctcgttttcttatgtgtctggcctcatccttagtcgtctttgtcaactctttcccttctaccaggactttatgtatgagagttctcaattcttggttctgtgtccccacccttctcttttcaacttacttgaggtgttctcttccaaatctgtgattttcaatatctatccatatgccaataagttatgccactttgtaatttcagccca

SEQ ID NO: 42830 - DNA, 1035 bp, Homo sapiens
cctgaattgtatataggagtaggactgtaccacatgttgtagccacctaagtcagaattcttggatcattttctctgattcaatagttttcatttttttttttttgagatggagtttcgctcttgttgcccaggctggagtgcaatggcgcgatcttggctcaccgcaacctctgcctcctaagttcaagcaattctcctgcctcagcctcccgagtagctgggattacaggcatgcaccaccacgcctggctaattttgtattttttttagtagagacggagtttctccatgttgaggctggtctcgaactcctgacctcaggtgatctgcccgccttggcctaatagttctaattgttaaatattcataattgttttagagatatcatttttgaatgtaagctattccatattggcaccatcttttttttcttctttttggtttttatttaatttttataccttttactttgagaattgtagattgatttacagttttaagaaataatattggctgggtgcagtggctcacacctgtgatcccaccacttgggagaccgaggtgggcaaatcattggagcccaggagtttgagaccagcctgggtaacatggtgagaccctatctctacaaaaaatacaaaaattaggcaggtgtggtggcacatacctgtagtcccagctacttgagaggctgaggtaggaggatcgcctgagcccacgaggtggaggttgcattgagccaagatcatgccactgcactcttgcctgggtgacagagcaagactctgtcttaaagaaaaaaaaaaaaagagagaagggaaggaaataatactgagagatccatatacccttccccaggcaatttcttggaatgataacatcctgttactattgtacaataacacaactaggaaattgacattgatacaatccagtgaccttactcagatttcatcagttttacacatactcgtgtgtgtgtgtgtgtgtgtgtgtgtgtatcatattctgtacaattttatttcatgttaga

SEQ ID NO: 42831 - DNA, 1141 bp, Homo sapiens
taaaaatgtcaaattttaagctaatcacttgttatattctgtcttgtattgctaattgttttgtgtgtctgtcttgtctccctaattagaatgtaaacttaagggcaagggaagtttcttatatatttaatgtatcctttgacagtgtggtttacaattttggactctggagtcatctcaacacatactgtattgatttaaaacaatggttctctaagattgttgaatgtcataaacctgtacattaaaaatatatatatacttatatttatccatatatgtatatttatagtagatatgggcttgcaaattttcagtttttccacgaaaaaatattaaaaagaaaaccaactaccattttcttatcagcatcatttcataaagtaaagaatatttaacaacaaaaaggttctaatctctgaaaaaggagcaggcctttaaatggaacattttagctttttgaaaaacttattgccttgtccatatttttctcattttatgttggactggtgaatcttcaccttagcctagcagtggtctgtagaccagcatttgagaatcattgatttaaaagacttagactattaaaagataaatcattttgcaaaataaataattctccttttccatgagtctgtattctctacaaaattaagtgcaaatgtgcaggtgatgccatttcattatacagaatctgtatatctctatgtacaagttctgtagtaagcaaactagaccctgctaatggacatctgaatatatatttccagttgccaaaaataaaaactgttctttttctagggaatttaagacaggataaaatatggtgtagtgggaagaggcaagtttttagagtcagaaggcctcacttgaatcctggctctggcattaagtcatttaattttcctttagcttccttgcttgaaaaattatgatgatactatcttcttcaaagtattttgttagctcctgttacagcaattccttcacagtaacgtaattatttgtttacacatctgccttccttatgagaccatgggctctgaagagcaggaatcatgtccttgttttgcaatctcaggtcctagcatagggctccaggcatagcagatgcttaataaaatgattgttgaatcaatac

SEQ ID NO: 42832 - DNA, 1036 bp, Homo sapiens
aatcccagcactttgggaagccaaggtgggtggatcacctgagttcaggagtttgagagtagcctgaccaacatggtgaaatcctacctctactaaaaatacaaaattagctgggcatggtggtgcatgcctgtaatcctggctactcgggagactgagacaggagaatcgcttgaacctgggaggcggaggcagtgagccaagatcacgccgttgcactccagcctgggcaacaagagcaaaactccgtctcaaaataaataaataaaataaataataatctgtacatttatatttatgtaaattctaatgcatgccatatttaacaataaaaggagttaaatttaaaaagcaaagatcctgcctcacatcttcactcaaccaccattaacaggcgagtctttccagatgtggttctttctgaagagtgttaaaaaataaaagtttgtttttcagcaagtgttaggggtaataagatacagatctttgtaggggaaaaaagaaagcttatttcaataaaatcagaaaagtgggaaaataaagcgagaaagagcggtaaataaaaaatacataagattgcagggacaaatctaaataagaaatcaagatcaaatggaccttatctgtggaatgtatttagtttactattttaataggcttaaagaaaaattgtgactttgctgtattaaataaaacatttaataaaatttgatatttaatgtgttcattttgttacaatgcatccagtacccttatgacatatatgcttttctgtatgttacatttgaatacaaactttgtgttgggcgcacagtggctcatgcctgtaatcccagcgctttgggaggctgaggtgggaggatctcttgagcccaagagttggagaccagcctgggcaacactctgtctctaagaaaaaattcaaaaattagccgggcgtggtggcacacacctgtggtcccagctacttgggaggctgagatgagaggattgcttgaacctgggaggtcaaggctgcagtgagcagtgattacac

SEQ ID NO: 42833 - DNA, 1986 bp, Homo sapiens
cacgatcttgactcactgcaacctccacctcccaggttcaagcaattctcctgcctcagccttccgagtagctgggattacacctgcctgccaccacacctggctagttttcgtatttttagtagagacggggtttcaccatgttgaccaggctggtctcaaaatcctgacctcaggtcatccacccgccttggcttcccaaagtgcttggattacaggtgtgagccaccatgcctggcccaatatttttgacctgagtgagtgagtagagaaatatgaaaccgtcttttcacagacccctcaactgtgtaatccatgtgaattgtatttgtcacagagatagttggcaataaacttataacattactttccctgctgtacagccatttagagaaaatgtagaatagactgcatttcttttcatatttgcccaaaagcagctttaaaaattatctgttggcttcaggtaatacagcaaatgacagagatttttagagttcctgtctgctgaacatagcaactctgttagatttcttctttaaatttgtcttgctaattcttagaaagaagcatttgtgccttgagaagaacattgcataatccaacacccgtgccttaaaccatgtatctgttaggcataataataccaaagtccactgagagttagacactgttttaatcttccctgtcgctgtttactttggcctgacgttaaagtcaaccaaacttttagtacctgtttttaggtactaactgttttaggtgttgtgggtgatacaggataattattatacatgacctttgcccttgaggagcttataaactgtttggaaaagaaaaacaaactgacaaaatgcatagaaaaaattaaatgccaaataaattgattcccgtttcatttagtgtttgctgtgtgcccgaggcttggttatagaaaggtaaatacaaatgtattccttttccctcaaatagctcacagcctcctagaaagttacctgtataagccaataaacatttcaacatgacaaatctaacaaatctttgaagtgcagtaataatatcccaatatgcaaatgaggaagctgagactaaatgaaggtcagtgacttgctcaaagtagcaattagaaagaacctggattcaaacttagacatttataggagctcttattttttcttccacaccacactttctgtttcaagagtcctaaaaagaggaactgagttcttcatttaaggtaaatagtaaatttgccaactgattatagtttgcctgatattcatgtatttacatagttaaggtgtgatcttattaattgtacatgtatacactaatatatgagtagtatggtactgaactggaagggttcatttgatgaaaagggtggtgtgcactagacttaggtatttccacaagtagggattgatgggtaggtaggtagactaggccaaggtgtaagggaggaactctgggatttccaagcagagagaagtatgagaaactgacagtaggacaaggttagtaggagaaaagctctaacatgttgggcaggggacttgatacttgagtggtgaggaaccatcaaagactttcaaacacgactaacaggttggacgtgagtgactcagtgattcactgttttttgttgctctcaatctgtgcacaatttcagctctggtttaaaaatataaccttagaaagtgggattttgattttaaaaagtaaatatagaaggcctgtattaggttggtaataaatgtataacatgtttattaggtgtctagcgttgtcctaaatattaactttatactagtatctattaccaacataaaaaactacgttcatctttagggtcacaactatagtagcttcttattccatccaatatgtatttaagcatctttggttctgaagttgggcaagggtttgtatagattggtataaacattttaaggataacagaaactacaataaagttttttgttt

SEQ ID NO: 42834 - DNA, 1058 bp, Homo sapiens
gaaaacacaaatctacccacgaaatggcctgagaacaaaacgcacccagtggccgtgatattcatgctacttaaaccagaaggcttcgaatgggcacagtgcagtgaggctgagggggctaatcagaggagatattaaatgttcaagaacactagcatgcaagaacaactgtgacccagggagatgtttgctaccaagtacactgtggggccccaccaccccagaaaggcgcatcagcaggtactaaggaagaccgggccatggctccccgaggtcgcgctgtgtgaactcaccaggtgcagttaccgggaaagcttgttaaaaagggcaggttaggaggccccaggcctacaggttctgattcagtaaatcagcgtgggcccagacctgcattttaaggaagggccacaggtggccgtgctgtaggaggggccgaaaccacacttttttttttttttttgagtctcgctctgtcgcccaggctggagtgcagtggtgtgatctcggctcactgcagcctctgcttcctggtttcaagtgattctcctctctcagcctccctagtagctgggattataggcgcacgccaccacaccggactaatttttgtattttttttttttttttttgagacggagggagtctcgctctgtcacccaggctggagtgtagtggcgcgatctcagctcactacaagctccgcctcctgggttcagccattctcctgcctcagcctctccgagtagctgggactacaggcgcccaccaccacgccctgctaattttttaaaatatttttttagagacgaggtttcgctgtggtctcgatctcctgacctcgtaatccgcccgcctcggcctcccaaagtgctgggattacaagcgtgagccactgagcccagcctaatttttgtatttttagtagagacggggtttcaccatgttggccaggctggtctcgaactcctgacctcaggtgatctgcccacctcggcatcccaaagtggtgggattataggcgagagccaccgcgcccggcctcaaaaccacacttctaa

SEQ ID NO: 42835 - DNA, 1038 bp, Homo sapiens
cttaaaggcttaggaagcatgagccttcaatttctctgtaacagaatgcattatttacaataaaaatgtagaggagctcataatcctggtttcagctttaaaacagaaaaaggtctaaaatcattaagaatcctaatttggcaaatgaaagtggatgaatgccatggttttagatttgggaggctgagagtttagttgagaaactctccaggctttcatgatgcaaatctccctgttggagtaaaaagataaagaaaattctaagtcgtggtattaacacttgtataaccagttacgatgtaggtgtatgcatctgttttgtaacgattgtgttgttcagacttattcctaaagggctttaaaacagttacaagaatctgacatattggacatgtaaaaaatttaagctactatccatgttttaaatgtctgggaaactctcattttttaatatccatttattttttatttactgctaagtaaatacatatgtagataaatttaaaatgtttacagcataacgcattggaccgtgcaggatactaacatggatattagataaagtgctaataatgaagtgtgttcctcagatagaaacatctcgccctcccctggtaactgcatattctgctttcaaagttctctctgattacaaaaatctttcaaattcttttgatctaagaaaaagaggaaaccccatagagggggaacaagcccagtgccagggtgatcaattttgcctcatttttatataatcctttttgtggtcatatttctctcccaccttaaatccattattcttctccccatcccctcagatggccatttcttcagtatggttggaacactccctagaatagcagaatggagagtgtccaaaacaacttttactatttgtgctagaccttcaccaaacagtaatatgaatttactcttaataaatttgttgcctctttatattatctctctttataaaagttaaaacaacaaaataacaaaaccaaaaacccaaacattctaggtaggaaaaaaaaagag

SEQ ID NO: 42836 - DNA, 1051 bp, Homo sapiens
agagaagagagaaaagaggagagggagagagagagagcatgtcgtgagggtgcaagcctgaggaagaagacaacagaatcacagtctatttgtaacctagtctcagaagtgacatctatcacttttgacatattccatccattagaagcaaattactaggtccagtccacactccaggggagggaatagcacagggcatgaatgccagtaggtggggatcaaggggaccacagatgaggctgcccagcaagtgaacacacccatttacgccatctcccacactgaaatgagcagtgctgatttaagagcacaggctctggaatcacagagatctgggtttgtgctcctgcttggaaatgtcagttagacgatcttggattatttaattcttttgtttcttcatggcaaaatgggaatgatgataataacactgacctcaaagggctgttttgaaagtcagactaaatgagctaattcatgcaaaatacttaccaagtatctaacacaaaataagagctcaatgatgatgataagctgctattatcatcatcatcaccaccgccaccgccacctgatttgtaattcaaactctcatgttgactagccgtggcattgcaggcaagttacttgactttcctgtgcatctgtttcctcgtgcataagctggggaaatactacccacccttcagagctattgggagaggagggtggtgatcacgtgcttggcccttggtcgctgtaaatgattacttttaatgggggttcagtctgctttgcataaatttactgccctttttggttaaggcacatctgtttttctgtctttgtttgctcttctatgaaatgaggacaacaatccttaattattttgcttttcatggctctctagcctattaaacaattcctgtttatgcatttagaaggaaaaaaaaaaccacatgggtaatccataatggaagatacatcaaaatcatatttatggtctcagaaatgttctttgaagcagggttattttcttccatcttattttggtcatcattggaagtagttt

SEQ ID NO: 42837 - DNA, 1034 bp, Homo sapiens
tttggaagcagtgaaacttgtttatgaattctttccttacacaaaagaagacaggttttttaaaaacaaattaatctttttctctttgtttctttcagcattgatgactgggaagtgagagacatagatttttgaaaagctgaaaataacttctagtttaacaaaatagtttcttccagagcttagaatttcagatgattggaaaattcatacatctaggtctgaaagtttaagtctttcgcatctatggagatctctattttctacaacctaaaatgctatgatgggtgacaggttaaagacaaacctttttaaaaaatgtatatttttattgctatatagtggtattatggcttttgaaattcctatttttaccataaacagattattaggtgcttactgattccagataatagcctaatctattagaaggtagaagagagaatctctggtgatacactgtccatacatggttcaataggaggtagcaaaggctaagtatgagtaagtgacaaaagcagtaaatgctgcagaactgaaattcagagaattgcgcttccactgttgggtaaggcttaaggggagactttgaaagaggaagatgagctatgccttcctttgggtactgatttaatttcttttgccatttttttgcatttcttgaatgtaggaatttatccttacccatgtgcatattcatcagctccaatttaggagattgactagtgtagcacgtcataaccagaaagatacttggaggtagacttttccctaaagtttatacaagacacttaatgggctgggtccttgatcatgtacttctttcttagactttgtgtatatgaagtggtgttcttatccttatttctttccacattcaccctttttaatgcttttagtaagtcttttcagtttttgttaagatttattttatagttacactattgtatttattgaaggtagcttggctgatactgttccaaagtcacttgccactttcctctctgcataattaacatttattctcctcatta

SEQ ID NO: 42838 - DNA, 1034 bp, Homo sapiens
ccactcttttatttcactgttttgtattctgttcctgattgtgtattcatgtataaatatcttgctgctttaattacagagacttcataatatgctttaacatctgacagggtctagtcttctctccttgctcttctactctttttcagggtttctttggctgtttttatccttttaatttttaatgtgaaatttattatttgtgtgaactgtatcagccttatttgttgtatggtcatagggaaacctgtttttatttttgggtctaattaaatttataagttaacatagaattgtatttttatgatgagtctttttatgcaggaacatggcatgtctttgcattttttccaggtttacttatacatacatatatatatgtatatatcaggactgtttaaaacaattttctcataggttttgcacatttttctaagcttatggctaatactgtattttattgttgtaattagaggtcttctcttgcattatatcttctaactgcttttcgcttttatgtttgaaggctctgatttctttaacttgatactatatatatatatatatatatgctttaagttctggggttttttgttttttttttttaaacaggtctctttggtccaggctggagtatagtggtgtgatcatagctcactggaacctcaaactcctgggctcaagtgatcctcctgtctcagcctcccaaagtgctggaattataggtgtgagccaccacacccagccttgatatttttttctaactaaattcttctattctaaatagtatttttcccattgattcttttggcatcttctagttgtataattttttcatctacaaacactctaatttgtatgctttgtaattactttttctatctcttaaattttagactttatcctttagaacagttttagatttactaaaatatcgagcatgtaatacagagagtttgtatatacctcccaatagttcccctattttttttttttttttttttgaggaagggaagaaaaggaaaggagcaaag

SEQ ID NO: 42839 - DNA, 1048 bp, Homo sapiens
taagtgatgatcttttcctttcattttatacttgtgaggcagtcagtaagtatattccaaattccacttattctccattcttctctcatttttttttggttagctctatcttttctacattgttgcaccacacatttatattctgttatgtatgacattcttatcttcatggttagttttagttcggtggttaaatatttttatttcatgtaaccagattttatgctgaagcttctcaaatcatttcttcagtatgtatagtttattcattagtagttttctcagaaagaatggctcaaggaacgctttgttaactatgcctttaaacttgaaagatagtttgattatatatacagtcctaggctcacattttttgtacttgattttcttaaaattttttattttattttgagtataaaatacctgtttattgtatttgggtatgaaatacagtcacgtgttgcttaacgactgggatgtgttctgagaagtgtctctttaggtggtttcgtcattagtgaactatggagtgtacttacacaaacttaaatagtatagcgtactccattatatagctctattataatctcatggggccagcatcttacatgtggtctgttattgacagaaacataatgcggttcatgactgttgtagctgttgtaaggtttttttgacaataaacttttcttaattttatgagtgacttgatatttctatctggaagctcaaggaagtttttaaaaaaagtcttcaaagtctgcatagtttgtactaggaatattgagttgaatttccctagcataccgtgtattctttgagtgtgtagattcaacttttattttagaaagatttgcttgaagcacagtttgatgtatctgtctagttccaattatatatttttttgtcgagtccaattatgttacgttatagacagttgctgtcttttgtatctgtttcattattttcatcactttccaacctcttttcccttactgggctattttagcggtatcttttttgggaggaacttttaaaatttagtctg

SEQ ID NO: 42840 - DNA, 1512 bp, Homo sapiens
tttaaaaatttagtccttgtttctgaaaaaaaaactcttctcacttatatgtaagtcttatcagctcttcctgtcattctggccatactatttttgagctgttttaattttgaattattgcttcttaataaaagtaatgataataaaaatataaactattttcttaatttcatttaggtcattttgaaataattaacaattttcatcttcgtggccacatttttctcaagtatttttatctattacaacatcttagagtggatttttattttattttctattgtttaaacaagttggttttcctgtagttttagaaggaagaacttctgtaggaggaggggatagaccagtgcagtttttgagctgtgtggctccaggccgcatttgtgaattttttttttaattgcacttttgagatgtagtaaagcttttcacctttatgttttccaggtattttgctttctgaatagacccctttaaatgtattttactgttgtggaactttctgagatctgtgtcacttggacctcctgcccacctagaatgtgaatcttatctctcctggagggttctcattctttttgctttgcttaggtctatttctgtttcttgcaatttctccagaatgggtctctgttttcatgaaagtaagagagtatttgttggtaggatacttctacagtcctcttagagtgtagaatctgcctctctcagttttccagttatctctgcatttacctatatcttggagcctgagaaggatgtgttatctaactttacttagttctcagattttctttcccatcaccagcatttgaacttgtttgttcctttgtgaagaatagactttttctttatttttacatgagtggttccttctgattagcataattaaaatattttcagagaggtgatttttttctttttttgtaccatccctgggaaaaaaaaaaaactgtcctgccgtgtcaccaccccgtttatttcttttgtagcacttatcacagtctgtaattaccatgtttacaattctacttgtttattttctgctgcttgtcatttgaatgttagcctcacaactggagatcctatctcatataccatggtgttcccagagcctatcacattgtctagcacaagactaggactcagtaaatatttgtttgataagtaactccaacaaatagtaaaatccccttcttactatgctgttgtcttaaaattgggaaatacttgtgagtctaaacctctgcagtatatgtaagtctaagtgatttgggagaaagctatcatttttatagtatactctttatagctggagatattaaaaattgatttaagagttgatccttactgcattttgaattatagtcttttaagaaaaaaacgtttgtttatttatttacatgtacttatcctttcaaaatacaatgttcttagattttaaatcagaaagccttgaaaaattatcagcattcccccttcccacacatttgtagctataatcaaaaa

SEQ ID NO: 42841 - DNA, 1022 bp, Homo sapiens
ttccaatttaaagttggcggggcttactgataagcatcctgaccagcccttatcagaaaaaatgttaaatgctcaattttttgcccaattgctgctgttatatttaagtattcttaagagtagtaatttagggctgggtgtggtggctcatgcctgtaatcccagcactttgggaggctgaggcggcaagatcacttgaggtcaggagttcgagactagcctggccaacatggtgaaatccccgtctctactaaaaatacaaaaactagccgggcatggtggcaggcacctgtaatcccagctactctggaggctgaggcaggagaattgcatgaacctgggaggtggatgttgcagtgagctaagattgcaccactgcactccagcctgggcgacagagtgaaactccatctcaaaacaaaacaagagtagtaatttgaaaggtatattgctaagcaagcttagggtttaagcatatgtaatcaagaaaggtttttaatttgctgacttgaattaaaacctaaaatgtcaaataaattatcttctcatggtgaattgtaatcgtttgttactgacatttaattggtagtatatacagatatagtagattttaaaatatgcaaaaataaagacatataacttgggaaaaattaaaactgtatcccatttttcagttacccatttgtgtttcattataaatttttaaagttctcatagaagaatttaattactcatagtcttgcttttgttttgtagtctttgtatgagaaacttaaaatgttattcatttttattgctttcagttttcatccagcattggtaagaatgaaaatgtacattttaatattaaactaacctgatggaaataggtagccattttagtcttcagcccaactctattttcaattcttcttaaccagttctcagttattatttgcattttaaatatttttaaatggcagatatttaatttaactctagttggcaaatctttattatttgactcatatagttgataccga

SEQ ID NO: 42842 - DNA, 1034 bp, Homo sapiens
ctactagaagctttctgtgcttttcttactctgttttgttttctattcttattcaagttccaaacattacataactttatgataatttcagcatctggtagattattcctgtttttgcctattcatgttctcttaattttttaatactttctttattccaggaacattttagtggacaaaccaaatgaccaatcttcaagatggtcttcagagagcaactatcctccccaggtaagattacatgtatcccttaatgctgtttagaagtcaccatttaaataaacactcaattgatactagttatctggaatctactaatagtttattctctttttgagattgtgaggtaaatttttattctctctatttttgcttgtttattaaattttggaagaatttttatctcataggcaaatgcagtgtgagatttgatgaaacatggacttttacttctgtctaccagaacagttacgctcaagttattctgtaaatgtttaaggaaatgttagtaaattgaactctgactcaatgactatcttatggggaaaataaacttaaatagtttattttattataatattattatacttaatattaaaataatatttaaatggcatcaggaccatgtgctaaatttcttttccctggcaagtagtgtctggggttgactgaatttaaaatcagtctttcagttatatgcgttcagcattaatatttataatgtattaggcacacgtatgtccatatccttgaagaaattaatgctctgctaggtaaagcaaatgggtaaataatacttactttattttttaattgtagtataattcatggaaatatatatatatatatatatatatatatatatatatatatgtatgatgtatgtatttttttttctctttgcctacctatttggatcccctggtgtttacatgttttattgcaaaagacatgtctaaagaatatatatttataatttttgggagccgcagtggctcaggcctgttgtctggtgcataaggaggcgaggctag

SEQ ID NO: 42843 - DNA, 1032 bp, Homo sapiens
actgcactccagctggggtgaaacagtgagactctgtctcaaaaacaaaaacaaaaacaaaaacaatatatttgtgacatggtatggcccattaacataatattttatataagcaaatactctatactgtatttaagtcatgaaagtatttcaggaaatgtaaagcaacctgagggtgagtgactttcccataaatcattgtgtcagtcctagttgtttaagtagagaggtgatatccatttatttttatttaggataaagcagatgctattaagccaacagagtaaggttggctttgaaaatttgttgaactataaaagaaacattggcatctcagtcagaattaaataactaaattctttggcgtattctaatatgtggttttaaattgtcagatttgactgtgaattatttttgaatttcattcttaccgttgaaaattttatgttatattcagttatccattcaggacactaggccctgtcacacatttttaaacaccgtagctacattctttataatactgaacatttttcattaatcctcgtataattaagagaatccagttataatgctgttgatttgaatgtaccggttttgacctatatgcccatgttcaactacttgtttatattgtcttggtcataatattttgagcatgagtttaaacttaaaacctgagtgtgcattaattcgtgttctagtgcatttactaaattatgaagtcagatttaatagccttatttttttcccacagtggcttaaagaatgattataacaaagaaacattcaccttgaagcataaaattgatgaacagatgttcccttgtcgattcattaaaataggtaagattttagcattctgaaatagaaacaaattcttgatatcatcagtcagcaaactatagcccatagaccaaatcctgcaggcctcttgtttttttaaatacaattttatgggaatattgctgcgctggtttgtttacatattgtctgtatctgcttttgtgctacaaaagtagacttgagtag

SEQ ID NO: 42844 - DNA, 1076 bp, Homo sapiens
tttagaggaagcagatatcaaattaggcagctaagtgttggtaagtccattaattgctaaaaactgttcacaagcctgtaaataatttagttgttgttttttgtttggttttgtttttttttttcctgtcttttaaattttgttctgaagcttggtagcaaacttttttttaagtttctaaaacctaggaaaacttaattaccataatatttagaggttaatgccaacattataataggtctcagattagcagcttaaaaagcaaataataccaataatctaccatagctatattttattattggattttagaaaactttactgcatagaataccactctttccaggcgtaatgaatgctcaattatactgtgtgttatgccaactcatagtgcttcgggaataaaataattgcttggagactcatattctaaaataattaagaataaaaatggttacaatgtagacactaagtcttcttgacatgaatttattttcataatttttgtaagaagagaaattataatttttaatttaaaattaaaagctaaatttctatgataacctctgaactggtttgagactgttattagggtctctttggaaaaggttcatttttaaggtataggaattcactttcttaattttggtccctctttccaaatgcctttctgccctgcagaaataggcttgaattagctatagagtcttaggcatctttttttctgcctgagagtataataaatattcatatgcttatttactaaagagctagatttatatacaaactggttttttatccagaataattatttatgaatatagacatgaaaatttgtttttagattgtctacacagtagcttcccctttttttgaacatagagtagaatttgtaatgcttttcttttttctccatcagtactataaggaaaatattattaaacacccctcccctgcccaacctttttttaaaatagagatgaggttttgccatgttgcccaggctggtcttgaactcctgggctcaagcagtccgcctgctgcaacctcgcaaagtgcttgtattacaggtgtga

SEQ ID NO: 42845 - DNA, 1037 bp, Homo sapiens
gaggttgcagtgaggcgagattgcgccatcgcactccagcctgggagacaagagcaagacttcgtctcaaaaaaaaaaaaaaaaaaaaaaagagagataaatcaggggtgttcaatcttttggcttccctgggccacattggaagaagaattgtcttggaccacacataaaatacactaacaatagcttatgagcttacaaaaaaaatcacaaaaaaagtctcttaatgttttaagtaagtttacaaatttgtcttgggccacattgaaagccatcctgggcctcatgcagcccatgggccacaggttggacaagcttgagataagtggtagtagagccagcaggatggcagaatgccacatttcatgacatgactctgtctttactcaccaaattcttagaagttttctctagtaaaattgatttgggagttgatttttatttacttattttttggtagatactggtgagacaattaggtttggggttcaaactgaggtaggacagtagtgaggcaacttctgtggattccaatgtctggaagcagaaatatgaggaaacatgccctggaactcaataggaaaagctctgaactttcacaagactgaaattatggttcaggttaaattaaacaggtctctagttgtgactgggtaatccaggactctgatcaagagaaaacaaaagaaatcagaaaatactattcagaagtctaacaactttcatgccttggcattcccaatcttttatttcagctagctattgctgtcgattttttgttctgttctcagtcctttggctatttcatgtttgtttacatgaagcttcatgaatagattttaagggagcccatgatagtctttaaacggtgtgcaaaatttttgtttttgtgtagttttctgggaagattcattacatatatatatgtatatatatatatatatatttttgttttttttttttttttgagacagagtctcgctctgttgcccaggctggagtgcagtggcatgatctcggctcactgcaacctctgc

SEQ ID NO: 42846 - DNA, 2902 bp, Homo sapiens
atagatctaaccaaagtaataattccctctacatttatgtaacactgttcaaaccattattactacaataatttccacattgttttagagttgttcacacaagtattgtatataccattgctgtctctccagcttcccagcccccatggacaaggggggaaggacagggatcttgccttatttatttttatgactatagaggctagaatggagtagatgtgcactaaatatttgttggattggatcaaagttttaaaattcattttcctttgagtagaaagaaaaatatttacctggaaactgtattcagatactgctgtaaaccttgataagtagatcaggttattatgtcatttattatactaatattttctgtggtggatctgttttattggttatattcgaacatatttaaattttcagattctacttgttatgccatttagactatgcttcccaaagctgtaattatcattacttcgggatctaggtagaaaaactaaatatagagctttgcatttgttaaagtaaaatttgttgctttctgaacttggtttgggctcaagtgcacaatctggtgtatccttgggtttttctctccaaaatttcttctgtgtttctattatgactattagtagcataatttactgagggctttcatatactctaagtatctatttaatcatttaggtaccatagccctgttattgatcagcagttaccttaattatcaggttgatcttaatcactttcaaagagattgtatttatcatcaatctttgaaagaacctttctagtcagatcttaatgatatggcagccacatataataggtaggtgttaagtttgtgggaaggagagttgggtgtctgacatccctgggattgaatcctggctctacccctgacttcttattcgatcttgaatgaattgtattgattaaaatggtgataataaactaagtaattgtgagagttaaatgaaataatgtattttgtatgtgcatatattatttatataacatgcatttgatatgccatatattaatatgcagcagtgattaattatgctgagagaattttatatgactcaaaggaattttcttttgtgtgttttttgcataatttgacaaaatttcactatggaaatgttttaaagtaattaaaaagtttgtgaaaaagtttaaaacaacttgaaaagcagtgttgaggggaaaaagtaactcactcataattccacattctaaaaaaccaatgttattttggtatatttgtttaatcttttatataattggtgccttaggaagggacaccataaatatatttataatatttttgagacaaaatactaaagtgcatataagaattttcttgatgaagatcaggtaggtttagtagtgaagaataactttctctaagtagagtttgaacaaccaggaaattccatgttaacaaaactggtgcataagtagtaaaatatagtttaaagaagcccagttattactttaagtatgcattttaaagttttctagcacaaggattctttatctgttgaagttaggtgcaacatgttgtctgtttgcaaattttttctaggaagaaaatctgtggcttcagataatcaaagagactcttactaactcacaaaattaagaacactggccagacatggtagctcatacctataatcccagagttttgggatgctgaggtggaaggatcacttgaggctgggagttcgagatcagcctgggcaacacagcaagacctctgtctctgcaaaatattttttttagttagccaggcatggtgacatgtgcctgtagtcccagctctgtgggaggctgaggcttgaggaggatggcttgagcccagaagttcgaggctgcagtgagctatgattgtgccactgcactccagtccagtcgacagagcaagattctgtctccggaaattgttttaaaaaaagaacaccttcactagagtaaaacttcataaagttaatttcagcttatttaacatggcttatattttaaagcaattgttgcttcccggtgtctcatataccttgttttcttagatattagaaacttaatagtacctagcttttgttttctttttttagtctgtagggttttttttttcccatattgctgtcttctctaaggatacagtgaccattttaaaaggtgtatgatggcacaaattttattatttaattttcaaagctttcttccctcctaagggaatcctatcattcatgccatggtagagaaggaatgttgtattctgtcctactgaatttgtcctactggatcagttttattaattgtaatccctatacctggcacctctccacttaagattcttcaactgtgacttgggtttcgactgggaaaagaacagtgaatagaaagagaaaagccacgtctattttgtttcagtgtggaagtctgttgagttagaaatatattaataaatttccattgtgttaggctgttccttgttgtgtaactctcattacgttctgagaacctacgatttaagcctttttcttctttctcaatcagaataggtatgaagacttaggcaaagctctaatatttggtatctacaaaagaagttgatggagagttgcttgtcacttggaagagcctttctgtagaaatttgaacctttaactgttctgtagctattatatgaaagtgcttttattattatttttatttatttatttattttttgagatggagtttcactcttgttgtccaggctggagtgcaatggcacagtctcagctcactgcaacctccacgtcctgggttcaagtgattctcctgcctcagcctcctgagtagctgggattacaggcatgtgccaccacgcctggctaattttgtattt

SEQ ID NO: 42847 - DNA, 1047 bp, Homo sapiens
gttgtaagtaatatttataatgcaataagtaattattttaaaactcatgctggaaaaatatagagattattttgatgagaacactttctgttagttcaaagtcagtacagatgagtaaagtggtgattcagtactggagctcagatttattatagttaattaatagactcataaaaacctccgcctcccgggttcaagcaattctcctgcctcagcctcccgagtagctgggattacaggtgcctgccaccacgcctggctaatttttgtatttttagtagagacagggtttcatcatgttgaccaggatggtctcgatctcttgacctcgtaatccactggcctcggcctccgaaagtgctgggattgcaggcatgagccaccgcgcctggccctcaagtggcatttttgtatagttttctaaatctctttaatgtttggctcaataaaagacatctggattcatatgcttctttattcagttgctgtatcagaaagtcatgtagcctctggaaatgttcacatatactcataagagaataagagtgaaaagacaaatttttttgttagtcatgtaaaaataactttgaccttatagactcccttgaagtacctaggagaccccagaccacactgagaactgctgctttaatctaatccacagttcctattcagatatagacaattatcccaataatgccccagtaatgttttttataggcatcccttgtcactctgcaaccccagcccagaatttagaccatgatcatgtattgctttttggtgtcatgcttctttagtcatctttagtctagaatagttccctaaactttctttgtctttcttgactttgatgatttttaaagagtacagggcagttgttttttagagtatccttcaactgggtttgtatgttttcttaggattggatttagatgacatatttttagcaagaataacccatagatcacattagcatctcctccatatatcatatcaggagacacattacatcagtttgtctgatattagcttcaatcacttggt

SEQ ID NO: 42848 - DNA, 1044 bp, Homo sapiens
aatatctttaattggtggtattattctaatgtacaagatgaaaacagttacacaactacgtaatgacagagctgggatttagaagtttgagtgcaaggaaggtgtttctgccatgctaaactactgcccaagattaaaagaaaaaagtggcggccacgtgaggtggcttacacctgtaatcccagcagtttgggaggccaagacaggtggatcacgaggtcaggagatcgagaccatcctggctaacgtggtgaaaccccatctatactaaaaatacaaaaaattagctgggcgtggtggcgggcgcctgtagtcccagctactcgggaggctgaggcaggagaatggcgtgaacccgggaggtggagcttgcagtgagccgatatcacgccactgcactccaccctgggcgacagagcgagactctgtctcaaaaaagaaaaaaaagtggcaatgcgtgatagtgacagagaactagtaaaataaaaattcaccatgacaagtaggctttaatgactgtcattcaaaacaattttttaatgagttaaaattatgtagtaatgtacagtatcgacaattattcttcaatcatggttatggctagctttagagcagtgtggcaattattctttttatttaattttgttgtggtcataaaagtaaaaatatgctcattgtagagaatttgaaaaataagatgcaaaaaagaaaatatgtcaaactgtccagagataacttgttaaaattttgatatatttctgtctagtctttttaaaacttatttattgtataaaagttgatacaagtttgtattctattttaaaatttacattaaattgtgggattttttccattattgtggttttattaatgtgaactggagatgttattagaaaagacaaatggattcattgtttgattactgctataatcaatttttctaaaatcaaaatcaccattttttactgtgtgtgttcagtgtgtaattggtttacacaattgaattttcccacaatgcaaataaattcattaataatatttgtt

SEQ ID NO: 42849 - DNA, 1025 bp, Homo sapiens
ggacttaacatataattactgtgtttatctgtgattcagtaatgtggcttatttgattaaaattatatttacaatgtgagtatcaaatgggattgtttgagctcatagagtaaatttgtttgaactattgagatcaccgagatggtatagctaatagtaaaattactgctgtttatataattctgtattgtcagatactataaaatcttaagttgttgctctttataattatctgaatgtaccatcttagatttaacatctgaagatctgaagaaactttaatgcttatttttaaactacagtgtaacaattttatgctctcctcagaagaaaattataatttaaatcaatggattggcagctgctttaagggatttattagcattgtgtctaatacatacataattacatcaaaattcagcatatctaaaacttgagtttatttctgagaaacttttggcaagtaagactgtgaacacaaggggtttagcagattccccatatgtaagctctgtatttaacactaattgaaacttatgtgtagaagatggtctgtcacaccaccagagttttgtagttttctatagaaactcagtctactatagtaagagtgctttctcctgttcgtattcattcaaggaagaagcatatattgaaccttcttcatttgccaaatgctaagtcaagtattggtaatactgaggtcttacaacctgatgcttgttctttagtagttatgtatttacttgttttgatttttaaattgtgtccactctgttttcccacatctgccattgtttattccatcctgttctaaccattatagcagattggtaccattgaaagaatagcaaattgagaatcagaagacttggtctctctttgtctgggtctgccactcatccctctgtaattctagaaaaattatataacttctctgaacctgattattcatctgaaaatgaggagattggaccagttgatcataagacctcatctagctccaaaattttgaaaattaaatt

SEQ ID NO: 42850 - DNA, 1048 bp, Homo sapiens
ttggccctttcttctgttaaccaaaccataattttgtttaatggcaagttgcctaaccccagggcatgaatggttaatcatgattagtctaaaccagtcattattatcctttggcaaattatttcactttaccttcctcccatgtgacacaattctggccaatgagacataaagaaagtctactggaggacatttgacaaaaatgtcttccctgatgacagtagagagatgctgaaagaattctttgcctccctgctttgggtgctctatataaggatgtgatgcttagagttggtattggcaagtttcaaaaatgagaaggcggccaagaaaattgcagaaagttaacctagcaccatgatttggttgaactctgaaacaatcttggagctgtctacttgcaaaattttgttacatgagctaattaatctactgttagttaggttttctgttacttggagctgaaaatatcctaacaaatagtgaatttgtggaaagctattttttattagattctgtatttctgtgacagctctgaaaactgttcttttcctttgtcttagctaatcagtaatgaatatgtgcattggaccgtgaagcaaaaatagagttgagattaattcataagttaatgcaataacatatcttcctcaggaattcaaaggacttcgaaaatatttgttaactttttttttatcccccctcccacagggtttctttatgttaaatattctgacaatctctcccatttgcttagaggataaaccaaggaaggaagagaaaagatgtgattcagacatatagataaaatttttttacttcccctttagctgttctattttgagttttaaagatgttaaagaagaaatagagttgaaggattatcattgtaacttcctaaaacaattataaaaataacgagttggcagtgataattgttgtatcattcttattttctgtttttttcagataaatgttctttcaaaatatgttaatgattaacgtttactgatctgcttgattaatttttctttgtgagtcagtttct

SEQ ID NO: 42851 - DNA, 1373 bp, Homo sapiens
caaagaaaacaagacagtttgttcttaaagttaaactaatggggaaaaaaaacaggacagggaggtatctcaagttcatttgagccatttttaaaattttggtagctggtttctgtttttcttctttttaaaatagtaacaacttaggattttgtgtgccaccagcttccattccatttcataaaagcttaatctagcaagaattggtgagccctagtagaagttagaaagaaatgttgaagtgtgtatgtgtgtgtgtgtgtgtgtgtgtgtgtgtgttggcatcagaatcaccttggacactttttaaaacaatgcccttggctgggcgcggtggctcacgcctgtaatcccagcactttgggaggccgaggcgggcggatcacgaggtcaggagatcgagaccatcctggctaatgcgatgaaaccccgtctctactaaaaatacaaaaaaattagccaggcttggtagtgggctcctgtagtcccagctactggggaggctgaggtagaattgcatgaacccgggatgcggagcttgcagtgagctgagatcgtgccactgcactgcagcctgggcgacagagcaagattccatctcaaaaaaaaaaaaaaaaaagaaaaaaaaacaccatgccctcaccctaaggttctcctctgtctgctcttaaagaacagaaaatagaaaacattcctgacattgagaattactggtccatagtattaatattttgttttaaaatttgtgaacatatttaacttttaaaatgttttatatccaacagtctgtttggggggaagaaatcctctggtaacagttcacatgtatactcacgatatttgtcagtgagacatgtagatctcattgtaggaaatcattccactcattgagaaggggcttactgttcttcattttctatagtaacttgtttttgttctgtttatatgttttacagacatttaatgttattaaatgactttctcatttaagtctcaaaacacaaaaagtgttttttagattttttttttcacagttgttatgatcatcatcattgtgcctgttgtcaggacattgacagctgactatcaactatataacaaaaaaatgttattggcttcctccagtcttcagaacatgggttctgaattggtgatgaacttacaataaatcttataaaaaatgatatttttttctagaaaagccatgagaaaaggatgcctaatcaattataccactttcagagaagacttctataatagagaaggaatgagaataagttttcagctacaataacacattttatattcattacacttctgcggagtttccagagtgctggtgtcattcatttaacagttgtgtatcgattccc

SEQ ID NO: 42852 - DNA, 1020 bp, Homo sapiens
gtctgcaaaaaaaaaaaaaaaaaaacctcagccgaactttctgaatgacttcctccagaaataatccaatttatgttcatcccttagtgagaattaaataaaagtattaatattgtatgtaaaattttaaagaatcagaaagatggaaggtgacattatcttagttttggaaaaatgagtgatctcggagaaaatctccaaggatcttgattttagagcttctggtggctataggcacttttaaggttgaactcagtcactttgctaagtttaagagctatatcttatttctagaaagtatgaattggagcaattaaacttattttcagcagggtatgtgacaagtaggaaaaatctggtctgtaaagcatgttgcctatttatttatttattcattcattcattcagacaggatcttgctctgatacttaggctggagtgcagtggtgcagtcatggctcactgcagcctggacttcctgggctcaagcaatccttctgcctcagcctcccgagtagctgggactgctggcatgcacaaccatgctgagctaatttttttttccttttttacattttttgtagagatgagatctcactgtattgcccaggtttgtccttttttggtcctcacaactctttttagaagtttacagtccaaatataaagtttagtgttagaaataagaagtgtacatttaataatgtgtatgctaggaaaaaaatgagaattcatgttatttctcctttaccacaagtaggaaaatccagctacgtgtaggatgttaagttaaaagtatattcctagccaggcatggtggtgtgagatggaagaatctcttgagcccaggagtttgaatccagcctgggcaatgtagcaagactccatctctaaaaacaaaaaattactcctaataggtcactttctttttagagcagtcattgtcatcagtcatactactagtgatatgctgatagctaattaatatttattgagcacttactgtggggccaagtgctct

SEQ ID NO: 42853 - DNA, 1036 bp, Homo sapiens
gaagtgtcggtcgatccagtggctcttaagagtgaatagctttatggaatcaagtatgtccctgagtagcaagattaggcctcaccaaagaagaaattaacctgcactttcaaaaagtaccatgtataggaatgaaacattgaggtcccactttattctgtctttagtacatggttttacttattttggggatggatagaaatatatttttgctagttctaggcttgaatcatgggctccttggctttcctagcatcccaaagcagtcaacagtgatttcttaagcaatttgatctgtacctttacttgtgaaaggtatgctatataattcagcaagtaccaacttgtgtagctgcagaataaccaagtggctatccagtcaagtaaatacagtttgcttacatacttcaacagtttcataaaacgattcccctgagtgacacaagaacataaaatgttaatatcactaatatagcctgttaaatcttttgtggagacaggtgcaaatcagaagattgacaaggaagaacttgagcttgctaaataagacttcctaaatttaaaagctctagttttgcttagtgtgaattctggcactttaaaaagattaagcaagtgaaattctgctgccctccaccatttatttttacagtgctttgtaatttttttcatcagttccttaaatgttatttggaggaaactaagttcttgacctcagtaattttatttttgtttttccctaaatgtttccctactagtctttttggaaaacatgtttgttttaatttcatcttccctcactttatttaggtagaatttttcccccttcatttctgaaattttttgctcaccgccatgtttaaatggggttgaatcatagcgagccatttgctcttgccaaagtgagatagatgtactgaggagataattgaaaagtcagactctgtactgtggggctttaatcggagcactgctggaaatgattgcagagaatgtagtgcttcatatatccatgaccaagattgacatgttgctc

SEQ ID NO: 42854 - DNA, 1046 bp, Homo sapiens
gtttttccatttatttttcttagctaatgtaactttattcttcacttttttttagccctagacttcctagattttctgtggcattctgtaggacattgtattgcttggaaaaaaaaagatcaaaatcattctggggcaaatgctctattatccttatttatgacaagagaataatgaaattcataagaaattaataacattcagatattgctataaatgtacttgagtcattttcatttggggatagtaataatggctgtggcagctttaatggagaaacctgtgttggcctctttttctggcattaggatctcttgtcatagaactattggtaaagtacaggtttgatagcagagttcctgaattcagcatatcatcagaatttccatttaccttttgtcttttctttttattgtattttttaacctttttgtttctattcctacctcccatgagtaacattgatttctgctgaagttagaatttgtgttaagaattgactttaaacttctgaaatagttgaatattagaagtggcttcagttgccatgaaatgattgcttttctttttctttttttttccttaaataaaaataatgcagccttatatatgtctcttcccctcaagaatgtgaatttaggctgggcatagtgactcacgcctgtaatcccagacctttgggaggctgacacgggaagattgcttgagcccaggaatttcagaccagcctgggcaacacaggaagactccatctctacttaaaatatttttgttttttagccaggtgtggtggtatgtgcctgtagtcccagctacttgggaggctgaggtgggaggatcacttgaacccaggagtttggggtgcagtgagctatgattgcgacactgcactccagcctgggcaacagagcaagaccctgtctcaaaaaaaaaaaaaaaaaaagaatgtgaatttagctccaattccaaatgactaactcttaggccagtcatagccaatgaaatcatctgacggtagcttctgtagcccttaacctaaggagtca

SEQ ID NO: 42855 - DNA, 1596 bp, Homo sapiens
tgattaaattagaggaggcgtgtagaataaatcccaatcccattgcaactggcagagctttataaatctttataaattcagttacaacaaaggagaggatcctacaccattagagccatgccatcaggtgtttgcaagtgacagctgtagtgtgttgcctcaaataataccaagttataaataataccaagtaattatcaactcactcccaaatttaataagatatcaaagtccaaaaggttacttaggagtagtcttccgtgggggaagataaatttattaaagagtcatgtactgatctttttcttgggattttttttcctttcccagaaaaaaaaattattttggtgactgatcaattgtaaacaattttcttccttacttacaaatcatccgttcagaaaaataaaagtggacttcctttcctaagcattacaattagcctgggcaagaggtgttatgattgtcttattctttaagccggcttactttttggatttgtgtgaaatgtcttttgaaaagaaagtagatagtatagtattaattaactactttgtatagtcttctgcataatttagagttgaaaataatgtaacattttcctgtgaacagattcctttatgcgtacatactttataaatatacatacatacacatacacatacatttttaaaatgctctttttaaagagattcttatcttgctcccactccaaaagctatgtacagttgagttattagcctcagaggaagagtacaggaaagcgaagatgaggacctccttttcttgtgttggtcttgggaacaaacagtattccgtctttcaaatatggcatatttctaaacagtttgggaaagatgttagaattttttaaaagtcagctcttttataaattggaagtactcagtagtcagaaattaagatcccctctgatagagatagattctcaaaaccaaaattggactgaaaattagattgagaagaaagatacaacttcctccatagccaataaaatctgtctttccaagtctgcttattaatgctgtgaatcgctccttctgtttgtgaaaacatctcctggactggaaatgtggtgctgtaaccagctgagccgaaagttggagaatgttaaatatcttatatgggacttacgataaaatgtattgatgttagtgattgtcaaaataggtttatcatttaaaaaactaggaaattactaagtataaagaagaaaaaccagtattaattaagtgatgagacctgttcattttgttttccctgacttatttccattaccaaacatagtaaaggccagaaaagattaaaaaaaaaattaacacagccattccattgttttttaccacatggagaaaggaccaggctggaagcatatgtccccccacccttatttatattcctttgagcattgccgttttctagacagacaatccgaaaataattgtgttgataggtctgtttaagcctgaactctgggtgtaaaatgttatccagaagctatagggagctgccttgctcaggtcattggaaatttcaaccctaagactcattggaatttctaagtccgttatgcaccat

SEQ ID NO: 42856 - DNA, 1027 bp, Homo sapiens
gtcctttgagtgtggcccttaagtaacgtttctttgtgttctcaaaacaggaaagcatgaggtgcagtgataaggtaaggaatcggcctttccttggtcagtcctccagagaattaactcaaaaggatcaaaatgcaggacactacccttgatatatttgtcactaccttctggtgggaagacagcagtaagtaaagaaggcttggccctaaacacagatgagagccagctgctcccaggtcaagcacatgtggagactgtactacagagcttggaagttgctgcgttaggagcttctgccgccaaaggaagatgaccgagcatctaatagggaaatggctgtgtgcccatgctcctgtaacttctcatataaatgacgactgcagagtccctagaaacggggagggggggggcgtggggggggttattttccctgtaaatgaaggcaacattggtttatcactaactgttcagattctgaaggtattaatatgactggaaagaccatctgaggcttgtacagttctggcgtaagtcaaaatcctggttgatgacattccttctttagcaccacgtatgctacatcttcctttgccttttacattcttagagaaaaggaagaggggactggagacttgggctttctggggcatagggcagttggggcagcagaggatgatgccaccatccttactctacagcttcactattgtcttacggggacttttttcctgtgggctttcacccagcaaaagcagcagccgtcaatcatatccttgccagagagattcttaatataggagaaactgtaataaggagaaactacgtagaagtagcctgcctagcactacgttcgtaagttttaatggttggcaaaccccgagaggtggttaggacccttggcgatgtacatagcagcattgtacagctgccctctaaacttgggacatagaatggagagtccaggaggaattgggaatcctggctttcatttcctgatgaccaatgacttctgcataatattgca

SEQ ID NO: 42857 - DNA, 1034 bp, Homo sapiens
gtcttctaggttgtttgcattttcttacaaattttagaataagctagtcagtttctgcaataaaacctgctgggattttgattgggattaatatatggaattgacatcttaatattgagtcttctgatccatggatggatggtatatgtctccatttaattcttcaattgatctcagcaattgtgtgtgtgtgtgtgtatagattttagtgtctaggtttatatgtctttggtcagatttctattttaggccacttcaagttgtgctacagttcatggaatgttgatgttcattaaaaaatgcattctttttctcttggtgttttgttttatatagtttgtgttgctatgctggttcactagtcttttctgctattcctaatctcttgctaatcctatctaatattatttttatcttagattatacttttcaatctaagatacagaagcttatcttctttatctggaagtttgctttgggtctttttcatgtctctgcttacatgttttaacttttcctgtagctttgtgaacaaatggaatataggtattataacagttttaatgtccttgtgtactaattttatcatctgtgtcatttctgggtttccattgattaatttttttttccctcttcctttacatgccttgtagtttttttttttttttctttttgagacagagtctagctctcttgcccaggctggagcgcagtagtgtgatctctgctcactgcaacctctgcctcccaggctcaggtgatcctccccacttagcctcccaagttgctgagactatagttgtgtgccactgcgcccggctaattttcatatatatttttaggttttgctatgttgctcaggctggtcttgaattcctggcctcaagcaatccgcaggcctcagcctgtgagccaccacacccgggcaccttgtagtttttgagttgatgctagacattgtcagttttatcttgatggtggttggttttggatatttttgtattccactattcttgagctttgttctgagatgt

SEQ ID NO: 42858 - DNA, 1038 bp, Homo sapiens
ggcatacaatacattgttattaactgtagtcaccatgttgtgcaatgggtttcttgaacttacttctcttgtctaactgaagtattgtatcctttgaccaacatcttctcaacccgtcctctcaccctgagcccctggtaactactgctctactttatgcttctatgagtttgactttcttagattctacatgtaagggagataatgccaatattcatctttctgtgtctggctgatttcacttaacataatgtcctccaggttcatatgtgttgttgcaaatgacaagagttccttttatttttgagacagggtcgcactctgttgtccaggctggagtaaatggtgcagtcggctcactgtagcctcgacttactgagctcaggcgatcctcccacctcagtctctctgctatctgggaccacagatacttttttgtggagatgggttttcaccaggttgcccaggctggtttcaaacccctgggctcaagtgatctacccacctcaggctcccaaagtggtgggattacaggtgtgagccaccatgcccaaacagatttccttctttttaaatgctgaatggtattccattgtgcttataccacattttctttatccattcgtctgttgatggacacttacgctgcagtgatcatgggagtgcagatatctttttgacatattgacttcaattccttttgatatagaccctgtagtgagattgttggatcatatggtagttctattttttaattttttgaggaaactccatactattttccacagtggctgtattttccatctttattgaggtatagtttacgtacagtaaaatgccatattttcagagtgcagtgcaatgagttttggcaaaggtatatatcactgaatgtgttaccatcaccccagagctctctcctgcctttttgcggtcagttctctctcacatcctgctccaagcaactgctgatttgaattctggcactactgattagttttccctattccggaacttcgtacattattccctcttttg

SEQ ID NO: 42859 - DNA, 1056 bp, Homo sapiens
ataattgttggagcctggcctcatgctgttcccagtctaaatatgtagggcatgtattttgcaagcctttctcttattctcctcagtcacagtattttgtaatgcacagagaaactaatgtctaatttagatgtagtagttcaactataacttaggtagaaggatgggagaagtgtggagaaaagccaataattgtagtaaaatgttggtttaagcttttggactcccagtatgtcttttcatttggcaaactgcctttggaacattttgactgagtagttactcccagggaacacaggcatttcatttgtggcctctttattcattttattcatgcttctgctgggatttcgtgaatatgactataatgaaactggacttcttagttcttttcttttgggtacaagcataggttaagcagtaaaaacctaaagagaacacaaattaaatgatttttatgctgctattttcttgatgtgcattttattccataaagtgttgctctgagactttatatatatcttaagaatttggaggccgggcacagtggctcatgcctgtaatcccagcactttgagaggccaaggtgggcagatcacgaggtcaggagatcgagaccatcctggccaacatggtgaccaaaatacaaaaattagctgggcatggtggtgcgtgcctgtaattccagctactcaggaggctgaggcaggagaatctcttgaacttgggaggcagaggttgcagtgaggtgagatcttgtatctaccaattttgttgcattattttcaaaattctaatagaatatttgaaaaaatatatttgtatattttcctggattttgtatgtaaacagtcagtgtctgcagttaaggcagtgttgtctcctttttgtaaagattcaacagttatttgccctctttttgtttatttgtttttaatttttgcatagctgggaacctatcatataacttgaatggtagaggcaatagtgtgagtcttgcccttaatggaaatggttctaaaatgtcatcaagtatgatatttccttttcattttt

SEQ ID NO: 42860 - DNA, 1049 bp, Homo sapiens
tgcatcttcctcgtgaatactttccaaactattagccctttggtcagatatgaagctgtgtacaccacaaggcttggcaggaaacaactactgtgggactgtgagctgaatgaagatttcagaagttggaaacttctcagcagtgttggagctcagaccagccagtgtggggaaagcttgctgaacatactgtgctttcagctgtgacctcagaaaggtcacaccttatgagtagggctattctaggagtagaagacaggctactatagatctcatacagcaaagccccaaaccaagcctctattttatcatcttgatccacctgtaaatttattgtctgatagaacaaaactctctctaaagtaagacaacataattcagtttctcaataacaaagcacctgcaatgtctagcatagaattattatgcttgttaaaaagcaggaaaatgtgactcttaaccagaatgaaaaagttgatagaaataaatatctaaaatgaaaaatccaccagggagtggtggctcacgcctgtaatctcagcactttgggaggctgaggtaggtggatcatttgagggcaggagttcaagaccagcctgaccaaaatggtgaaaccctgtctctactaaaaatacaaaaaaattagctgggcgtggtggcaggcacctgtaatcccagctactcaggaagctgaggcagcagaattgcttgaacctaggaggtggaggttgcagtgagccaagattgtgcctctgcactgcagcctgggtgacagtgtgagactcaatctcaaataaataaataaataaataaataaaatgaaaaattcaccagatggatttagctgcagataacatactgtggaagaaaggatcagtgaatttgaggatagatcaatgtaaaccatccaaatcaaagcacagagaaaaaatagacaaaaggaaaatgaacaaagctataatatcttcaaggatattatgcagcttaacaattatgtggtttacaggtacagaaggagagaggacagagagattggggtagaaaaatat

SEQ ID NO: 42861 - DNA, 1210 bp, Homo sapiens
atgtcaatctaagaatgctgaaaagaaacaaaaattgtcaatctagaattttgtgttaccgaaaatattctttaaaatgaagctgaaatagagacattttcaaatgaactaaaacttaaagaatttgtcaccactagactttcacttaaagaaatgttatagaaagtttttcagccatgcgcgatggctcatgcctgtaatgccagcactttgggaacccgaggcgggtggatcacgaggtcaggagttcaagaccagcctggccaagatggtgaaaccctgtctctatgaaaaatacaaaagaattaactgggtgtggtgtctggcgcctgtaatcccagctactccggaagctgaggcagagaattgcttgaactggggaggtggaggttgtagtgagctgcgatcgcgccactgcactccagcctgggcggcagagtgagactccatctcaaaaaaaaaaaaaaaagagtttttcaggctgaaggaaaataataccagatggtaacttagatctacagaaaaaagtaaatagggccagaaatggtgaatatgtggacaaaaaaaaaaaatgcttttcccccccacatttcttgatttatttttattaaaagaatttttaaaatttctaagtcaaaaacaatcatagtgtatgtgggttttataatatattttggaaggcaatatatgacaataattagacaaaagatgggagtagggtaaatgatactatgctgttgtgaatttcttatataattcatgaagaggtataatgtttagggtagcctatgataagttaaggatgcatatttcaatccctagagcaaacattaaaattctaagatagatacgtagctgagaagccagttgaggggataaaattgaacagtgaataaatatttgattaatccagaagaaaggaaaggaggaaaaagaacaaggaagaaagaaacaataaaaaacaaagataggatgaatagaacccaaaagcaagatgatagacttagcaccaaccatatcaataattacattagacataaatcgaccagatactccagttgaaagacagagatcatactggatttaaaaaaaaccaagacccaaccatgctgtttcaagagatgcattttatgatattttattactttaaaaatttttaaataattttaaaattgtagaaaagttgtgagaataagaatagtacaaagag

SEQ ID NO: 42862 - DNA, 1026 bp, Homo sapiens
taaaaatagctagtattacacaaatacatcagacatttttagaatatataaatgtaattatttgtattatactactatgacatttagaacttgaatacatcaaggcctagatagtatgttatggactatgtaattttacttatggcaaggtcataaaatactttgtgaataagtttttatgacccccccccatctttggcttttacttatgttctgaactgaaaacaattattaaatctgttaggatcctatttagaatactaccatgaggaattagttatgataataaacaaagtaagatatcatgtcttccctaactctgcttactttgtaattgtcagatgtatataattcctgtacggctgaaaacgaaacccattatttcataataaagatgattgtaatgaactaagcaactttaaattccatcagttattaacaggtgaaatttacagattaaaaataggtttttctggcatattaaatgagttatacgtttcatacatgtagtttcaaatgagtgatttggccacatgttctcactcataggtgggaattgaacaatgagaacacttgttcacaggaaggggaacatcacacaccagagcctgttgtggggtggggggatgggggagggatagcattaggagatatacctaatgtaaatgacgagttaatgggtgcagcacaccaacatgtcacatgtatacatatgtaacaaacctgcacgttgtgcacatgtaccctagaacttaaagtataataaaaataaaataaaataaaataaaataaaataaaataaaataaaataaaataaaatgagtgatttggggattctgtctttaagttacggaatgagttgtttaaacagctttattgaaatataatttacatgctataaagtttacctatttaaagtatagatttcagtggttttttaattatatttatggagttgtacaaccatcacaatcatatcattttagaacattttcatctatgccaaaagaaaccttgtatctatta

SEQ ID NO: 42863 - DNA, 1046 bp, Homo sapiens
tctgagacatgttgaatggcccaagaaaggttttggagattgatgatgagttgatccttggaggatttgtagaggtagaggagatgggaaatggcactccaggcagatggaaaggctcatgagatagtatttgcaagtggcaaaaaaggaatgaatagacaaggatattcagggataggtaagaagaagagtttagcataaatgaaggtttattttgtggatctgatgaaaagcttggataggtagatttgggtgcaggttgtgaaaacctgttagggttatctaagtggtttgtgatttatctttacagtaatagtttctgaacctggttacacatttgacttatctagggattgattcttagctccatcttacaccttatgacagtcactgtggataaggactacattctgtttttcagctcctaaggtgattctgatatatttgtttaggatcttgtatttggaagtctttgtgttgggtaagtggttctcaatgtatacctcttggaccatcatcagcattatgtgggaacatattaaaaaatgcagatttgtatccccacctttgattgactgaaacaagaactctgggggcgggaccttcaggtgattcttatgcacactgaagtttgaggacctttgctgtaggtaatatgggaactttggagatttatattggagtgtgatgagatgaaggaagattaatgtggtagcaatgaaaaggactgagtagagagggtagagactaagacaggcaaactattttgtaggctagtggagagtctatgcatatattacttgaggtattgtttagtagagaagtaaacaagacaggctttggtgtatgctaaaggaatacaaagaagggagaagaagatttctaaaccttttcagagtcttttagaaaatctgtaagatgatatggtccatctgccagcctagtttccagtatgacagatattttaatgatggtttagtgttaaattattgggaccaactatgtactgagtactggggaatagaaaaaaatacatgaacaccaga

SEQ ID NO: 42864 - DNA, 1054 bp, Homo sapiens
agcagtggaacgatcttggctcactgcaacctctgactccctggttcaagcgattatcctgcctcagcctcccgagtagctgggattacaggcacgcaccaccatgcccagctaatttttttatttgtactagagacggggtttcaccatattggctaggatggtcttgatctcctgacctcgtgatccacccgcctcggcctcccaaagtgctgggattgcaggcgtgagccatcgtgcccggctgcaagatcctaatatttcttagaaggagagaaatcctttactcacaggaactgtacacacatgttcacacatatgcacaagcatgcctgctatccataagcatttgtcatctttcagatgatggaagctgtttgagacccttaagggactgtagtcatgactcctgtcttttcagtatccctttccccttatcactgtgatcctactgcatttatggaaaaactgctggcgggccatcatgtttgacccagagctgaagttcagaacttccttgttgattgtcagtgttagtaggaatgaatttagcccattatagtgattggcaattagaatggtaccaacattatcagttaaatcctgtctgtttgcttaactcagttttgggtgctaaggcagctgtattctccatttcagtaacttctgaatattaccattcaggtgctctgcatcaaaaagccccacattggctgggttttgtggctcatacctgtaatcccagcactttgggaggccaaggcaggaggattgcttgagcctaggagttcaagacctacctgggcaatatagcaagatcccatctctaaaaaatttttttaaaattagccaggtatgatggtgcacacctgtagtccttgctgcttgggaggctgaggtaggaaggtagcttgagcccaggagtttgccgtcagaaaagtcccacatcagttactaaagtctaacagttctacctctctctgtctctaaaatcctcttaagtctctctgtctctctctaagaccacagctttagttcagggcactggtctctc

SEQ ID NO: 42865 - DNA, 1034 bp, Homo sapiens
aatttaaaatgttgaggttatggaaagtttatattaaaatcatacaacattgatttagtaataaagctttaatgatgtatgtagagcaaatatcaataaaacaaaatttgtaattttatattagtatgtaggcaatgattcatattaaatatggaagaggagggaaaagatctggaataataatcataaaaccaataataaatatttgagtaaagatagagatgttgtagaaattgtaaaacgttaaatttttccctttttgtggtttctctatttagatcatggtaaatggatataagtattatcaaaaaatattgatataattttttattttctgaatatgatttttatttgtctttggtagcaaatgtaccacattaaggtggtatttggattataatttagggctagtaaacaggaaggaattgccttaatccaaatatacagtagtcttcccttatttgtggggataatttccaggctcctcagtggatgccagaaactgcagattgtaccaaaccttatatacaccatattttttcctatacataactatgataaactttaacttataaattaggcacagtaagagattaataacaatgatagtagtatgctataataaaagttatgtgaatatgcgcttgggaactctttcatgcacacactgtcttgctctctctcaaaatattgtactatattgaaggtatgtactgtactgtgggtaactgaaaacatggaaattgaaactgtggataaggggggactatccatttacctcacttagtaaatatttgagtgcctactgtgagccagacactgtgttaggtgctgggattataagcaagatatacatgatctgaaagataaactatgtccattatttgcaaaaacaagttacatgtgagtgttctttgctgtctgtagataacaaatatgtgtatagtgatttactgctcatagagctcttttgtgcgtcttattgcctttaattccacgtaacaagctgagggaaacagagactgagagtaatt

SEQ ID NO: 42866 - DNA, 1053 bp, Homo sapiens
aatcttatcctggtatcttttccttccagcctgttttctctttaaagatttcttttactgttgcaagaagctatgtgttcttgtgtgctactgaggatgccaggatttactgaaaattttttgtttctagtttttgggttattattattttttttttgagacagagtcttgccctgttgcccaggctggagcacagtgcagctcactgcagtctcaaactcttcggctcaagcaatcctcctgcctcaggctccttgagtagttgggactacaggggtgtgtcaccacacccatttaatttttattttttgtagagatggggttttgctttcttgcccagtctgatcttgaactcctgtcctcaagtgatcctcctgttttggcctcccaaagtactgggattacaggcatgagccaccgtgccaggcctctaatttcttgaaatgtatcttttcctcactttttcttttccctgtttactcattctcaaatgagaggaaatctacctagaccttgtgtctgctgactgttggaatatgaagactgccttttagcctattatttaaacatatgtgctaatgaaatcattttctgagttttactgctagtaatcaatttcatgtacacatatgccagctcaactccttgttaccatataatgcaaatctgtttttctgagatggaacttcaacctgtatcactatctggcttcctgaaacacataaaataataaatgaattactaaggtaaacataaatcgttttccatgattatttttgtatttacagtattttacaaaagatgattctctttgtcagaattccattgttagtcctctccacttcttagtagattgtgtaattttaagtactatttctaatggatgcaggacaagaagtgttcaggtgggatggtgagttcgggagggccagctgcctctcaggccagcaactatgtggtcgtgaacggttgctcactttggtttggagaatacagacagtgcaagagtgggaaaggctttttgtacctacttccaagtaagcagattacttt

SEQ ID NO: 42867 - DNA, 1031 bp, Homo sapiens
tgcacttattatagcatattatattagactctgcatggtagctgaggctggaaatattggtagggcccacggcacaacctatttctaaagtaccttgcgttaaaaatagaatgttcagcttgaactgcaagtgatcatgatggcagcctggttctatatggagattgcagagctctgtgtgctcacatctgatttccagcttgtaattttggtgtggatgaaaatatgcattaagttacttttggcttctccacaattttaaactggaaaagcccatattacagtaatatatgatagtatgtatgaatgcgacatgaatattgtaatagtcataatataggatgttcattcctagaattgtgatgacatctactgaattgcagccagtaatttgcatattcatgcccacttagctcaaataagtccctgtttgtttgcacattaatgtctgatttcagcaccagctaactcatttacatatcctgttcagttggttagtgatgttcatatgtggaatattggtgcagctctgtttgggctttgagtagcttggggtttagtagaaggatcacctgttactcatcctagcttttctaggcaaggcactttacttttctgagctctaggttattcatctgtgtaatgaagttaatgctggttagttcttagggctgtcatatcagttgacacactggaggttatggtgtacagtcaacatttctaggccaactatattctggggcctgttcctggaacattttctgcgtgcagaggggttctagatgctgtagaagataagacatgcaaacagtcacagtttcagtgaatattagaagtactttggggagtacagaagagaaaacacttaacattttcaagggaagtcataggaggtattacaaaggtggaattcttacgccgaactggtaagatgagttgaccacactgaacaaaggaagggaactcgcggcaagtagggagaagatgtggatgaacacacagatgtttgagaatctcatggaactggaaat

SEQ ID NO: 42868 - DNA, 1020 bp, Homo sapiens
tagtcccagctactcgggaggctgaggcaggagagtggtgtgaatctgggaggtggagcttgcagtgagccgagatcatgctactgcactccagcctaggcgacagagcgagactccgtctcaaaaacaaacaaacaaacaaacaaaaataaaatgtcccttgcttctacccaggttctaactgccatcatctcttggttgttcctgcttctatctctaatccctccaaaccattctttataccagaactagagtgagttaaaggtatttaataatttcgtatgtactagtactaaaccccatgtcctcaatatgcctaataaagttctgcatgatttagccaccactacgtgcagcagcttcttggcctcttttgaaaatcataaccttgtgggcttctcagaacatgctgtgcttgttcaggccttggaggctccttgcatgctgctgtctatacatggaattggcttcctttcatattcttgataattaatgccatctttaagataacgttctctgtataataagaattttatatcgtgcttattaagtacttaccatgtgtcaatcagtattctaaaacattttaccggtagtatgtcttcttcttttattctcttaaccattattttcttgggggagctttttgaaaaaaaaaaaaaaaattaccccagaccaggtcaacttccttctttgtagcacatggcatacttacaattattcagttggcatacttagtaatttaattatttgctgttgtttaaaatgtgtgtttatcattcattttaagttccttgcagtcagggaccaagtcagtatataccaatcactggtatagtaagcacctaataaataatcatgcttattaaaagtaaaagaagttcaatattattaaacaaatgcctgatttagacagtagcttaggtattttcccttcaagtttagagcttttttccataagcggataatatttggggatatttaggaatgtatcatagattaaattatattaagaaggaa

SEQ ID NO: 42869 - DNA, 1040 bp, Homo sapiens
atgatttcttttagatggatgtttttaaaagaccataaagtaagtagatattacagttttccttgggtaatctgttctagtgtctcacagtccttattaactttctcaacttaaaaaaaataaatgtgttaattaacatcctacattagtcgatatacctatcttgcttatttggtactctaaaaaaatttcctattaacatgaagttacaagatttcattaagtttttaaattaaatctcaaatcttttgttactaagtagcaacatgactgcttttcttcttaaaattcatctgttttataaactgtcagcatcatagtatccttctggataatttgtgagtgggcagcatctgtacttttcagaagggaagaatagatatttaataatttactcaaggttgtaccgttgcagaatcagaaattagaatctcagtctgttgagatgtgctctcaagataaaatacatgtgccatgcaaatagggcatagctttcttgtctagcaatggttggcccagtatgtggcccaacatatatttcctgtagaaggaatgagaatcactcctatgttgatgaccatagctgaacatgactggaagaattttagcatgaccagttgactttttttcctatcaccactggctagttctgaagtataaagtgttaagttataaactgcagcgttataattcctcttctggtaaaatgaaaaatcagtactgtaatcccagcactttgggaggccgaggcaggtggaccacctaaggtcaggagttcaaaaccagctgtgccagcatggtgaaaccttgtgtctactaaaaatacaaaattaactgggcatggtagtgcatgcctgtaatccagctactcaggaggccaaggcaggagaatcacttgaacctggaaggcagaggttgcagtgaaccaagatcgcgccattgcactctcagcctgggcaacaagagcaaaactccgtctcaaaaaaaagaaaagaaaagaaaagaaaaatcagtaacaaatacacagattttttttttat

SEQ ID NO: 42870 - DNA, 1769 bp, Homo sapiens
ggactacaggcgcatgccaccgcgcccagctaattttatatttttagtagagacggagtttcactgtgttagccagcattgtctcaatctgctgacctcatgatccgcctttctcagccttccaaagtgctgggattacaggcgtgagccactgtgcacggcctggaacatctttatacttaaaacaagtaactttctttttctccatgtaatttctgataaatccactcctggaatgaatgttttagaaaatttgaccaagaggtgcttttgagcagcattagataaccccttcagtatctaaatgattgatgagaggagagactccttaatctagatttagagactttccatactggcagcaagatgtaccagagttcttaagaggagactaatgaaaatataaacatttgtacagaagaataggttaacattttttgagttgattacatagcaaggaaaacttgaggttttatacttaggagtgctaggaactaggcattgtaatgagaaaaatctgggccctgcaggagaatgtgaattatttttgatccagtactttatgctcattgtactatgataaatgatatcatttcatataagggcattttaatctgatgcattagactaaggatagtctgaacttttttgttgctaccaccacttcagtctttatcattaatgagaagctcagattgataaagtaatattaaactattattcttaatatattaatgtcaaaataacaattttttagagcacttttttgtatacatctctacaagatagtttattttgcttactagctgctcagcttttttatatgtggaatatggatttacttgattgttttagattattatactgagaggaggataaagaactggaccaatattgtttgtgcaattagttaatgctgatgcacagtgcagtatattgcaagaacttcaggacatacttttttaggtgggtttgtaaaacctgtatatcttccaaccatggagattactccaatcagtagcccaagtgtgcatacacacacacacacacacacacgtatacatatatgtgtaattatgtataaatatatgcacatatatacatatatatacacgtgtatatatgtacacacatttatacgtgtgtattttacatatacatatacatatagtgagagagaaagagagagagagactgtttcattctgttaccttggctggattacagtgacaaggtcatagattactgcagggtagaactcctgggctcaagtgatcctcccacctcagcctccccattagctgggtctgtaggcaagagccaacatgtctggctaattttcaaattttttgtagtgacaaggtcttgctacattgcccaggctggtctcaaactcctggcctcaagcgattctcctgccttggcctcccaaagtgctgggattccaggggtgagccagagttcctgaccggcactgatttttttaatcaaatcaagtttttacagaagtaaaaacagatgcttcactatagccagtttctaaagaattcaccaacaacatctcttcttatatagtcattctttatagtcattatcaaaattgtgtacaaatgtattgaagagctttattgtaattgtggtttcatcaatctgaatagaaaatttgtcacctagttgctcttcagtgttaattgacttattatctgtgtatctgcgaattgaaccattgctcaatggcagtgctttaaaatactggaagactatcgatg

SEQ ID NO: 42871 - DNA, 1046 bp, Homo sapiens
tttatatatctcttcatgaactgttgatgggcatttgtgttttttccaatttttgggtactatgaataacattcatgtgcaggtgcaggattttatatgcacatgttttcattctgcttgggtaaacacctagaagtggaaagtctggatcatatggtcattcggggtttattcttttgggaaactgccaaactagctgctcattttttttttttttacagaatttataccacttatttacagtcgaaaacatttagttaagatatttttactttaggccattgtcttcaaggtgagttgtttattcttccctctttgatgtgtgaacttgtccatttgtgatgtagattagtcatcacatcacaaatagtaaatgtaaatataccatttatacacatccacctaaatctattctttctaaaatgcatatatctatttatctttctgatgaaccaagggacataagtatgccataaccataatgagattgatactaatttggacaatgagagtaaatgagtccttcacagagcaaaaggaattctatacatttatttaaaagacaaatatttgatttgtaaaaataatattaagacagttggaagacatgtttgaaactgcatgggagggagtgtgattaatagaaagtgtagggttgggaaggaggattagttatggcagttccacaatgagtctggaagtttaataaaggaagtgtgcagggaataacagaaaaatcaaggaaaaggtagtacctgctactatcaattgtctgttgagatgggaaaatgaagcctacaaatctattaatcatttgaagatattaacaaagataatatataatttttgttctctgagttccttcccccgctccatgtgtattagctcattttcatgccgctgataaaggcatacctgtgactgggcaatttacaaaacaaagaggtttaatggagtcatagttccacatggctggggaggcctcacaatcatggctgaaggtgaaaggcacatctcacatggccacagatgagagaagagagctt

SEQ ID NO: 42872 - DNA, 1045 bp, Homo sapiens
tgagaattcaaaatagtttagagaagttgagcatttgtcggaagtcaagttgtccagccagtaccgttaggaagttttcagatgaacttcccagtgtaaagcagaccatcagatcaatggaaatgaatacacatctcagtttctataagaacagtaggttcttactggaaaggatgtagtcagtaaatggtactacagaaatttggaaaaatctcacagataatgtgtggtttaattcacctcacattagctgataaaattaattacagatagctaagtagtaaaatataacaaatgaaacaaaaaaattagaaggtaaaagtaaatatttattaaatgcttggatatacaaatacttcttgcgtaatgaaagaactctaagaggaaatgatagcttaatattaccacaaaaatgtaaaacttttaataatccaaacatataaaattaaaagccaaaaaatttaattgaataatgttgccacaaatatgacagaaaggctaaagttcttaccagataaaatcctcttttgggtgaaaacctgagcatgtatcttattcctgttcttgccacaatattttatagttactgtttttgtatcagtctcacttggggtggggtgtgtgtgtgtgtaccttttagatcttggtattttcagggacaaacacaaagtctagtccagaaggcattttgtaaatgtctgagtatgaacaaattggattctggggctattattttactgaggtctgaaatgctgacaaatgcatttgttaatcgatgaagcagatttgagaaggggatagaaaaatgttcagttaagttactgtgcaaatgcagcatacattaactttcttggtggaaaatattttaaaagatgaaatatatattccaataaaatatttggtggctattgaagtcacattacaaaatgcagctaccacacattgttagtttatatgaatcaattacaggggagatctttctggtgccatttttaatttttcctccttccagttgctgaagccctaccttcattcctcttgtctt

SEQ ID NO: 42873 - DNA, 1056 bp, Homo sapiens
ggctctatctaaggctgttactttataaaattggaaagtatttatttgttaacacttatttatttctgtagtctttgaaatttgtattctcccccaatgtattttagcaaaatgggagaaatgaaggataacctagaattacattcccagagcaaaatatactgtatttattatttgtgattcatttcagttccgtgttttttttttgttcgtttgtttgcttgttttttgagacggggtctcactctgtcagcaggctggagtgcagtggtgcagtcttggctcactgcaacctctgcctcctgggctcaagcaattctcctgcctcagcctcccgagtagctgggactacaggcacgtgccaccacgcccggctaattttttgtatttttagtagagacgtgatttcaccatgttagccaggatggtctcgatctgctgacctcgtgatccgcctgcctcggtctcccaaagtgctgggattacaggtgtgagccaccatgcccggccccatttcagttctgttttatgtatgtgtttgtaactttaacaatataataataatggtgtggattcagtttttttttttaaactggatttgagtagtttatgactcctgtttattaaatcaaaatcagcaaaagtatttcatcaatatttgtcctcttcaaacattttagtaaattttagaaagttaaagtggagttgaataccagtcgtaaagctagtaatacctcttccaaaacaaacatacaaacaaacccctgaactacagttgtggaccttcattatctttctgagtgttgtgccttaatgtgtttgagtctctctgagatgcataatacgtgttatttgtttgagtttcagccataacttagtagtgatttttctccattatagactttgcacataatgaatttcaggaaatacacaacaacagcttcttccgcttgtagataaagacagtaatatgatggagtgatcaaatacaaatgctcctttaatttattttaccaagacatttatccatgttttatttataaggcaattgaagtc

SEQ ID NO: 42874 - DNA, 1058 bp, Homo sapiens
aaaccaggatggcatacggcacagagtagtatggaaaagagaaaattctttgttggaagagagggttttttttccctccagttgaagagcattttaaatgcacaaaatctgtctcagaaatatccctttgaaagatctttgcatacacaagatttaaaatgctttcattctgtgggtgactagaatgaaatgggagcctacattcccaagaatctctgatatgaccatataaaaaccatgaccaactggtttgtttttaactcttaccatgtacgagcccatttgaagggcatgggcaatacttcgtttctgaaccaagtcaagttgactgctggcatttaactcaccaccttgtgtttgctgttgcctgatgccagtaagaaatacatcgaaagctgtaatataatgataaccattatttgccctcagttaaaaatctagctaatgggtctgatgtgcccacagcttcatattgcttgagactgcccccttctaggatattttagaataaaagatcagaccagaaagaaaagtttaaagctcaggatatcatagaataaatggaagataaccagctagttctgttaaagcagactctatattttaaattcagtaaggatttaagtatattaatggttactagtttcctataaattagtttggggaggtccatgtaacattgaagtcatagttcactgccatgtttttccaaagtatgttcacaggtgtttggaatacgtatgatctaatctgaaaattaagagtatatatacctttcagttcttttttttttttttaattatactttaagttttagggtacatgtgcacattgtgcaggttagttacatacgtatacatgtgccatgctggtgcgctgcacccactaactcgtcatctagcattaggtatatctcccaatgctatccctccccccttcccccaccccacaacagtccccagagtgtgatgttccccttcctgtgtacgtgtgatctcattgttcagttcccacctatgagtgagaatatgtggtatttggttttttgttcttgcgat

SEQ ID NO: 42875 - DNA, 1033 bp, Homo sapiens
gcatctagcatggtgaatcctttccaaaaggttttcaatttactttgcccggatccatcagaagaatcactatttatagcagctatagtcttatgaaatgtgttttttaaaataataggacttaagaatccaaatgactccttgatgcacgggctgtagaacagatgctgtattagcagacatgaaaacaatctcgtttttatgtcaacagtgttgacatttcactagtgtttacagcatcttcaccagagtagattccatctcaagaaaccactttctttgcttgactataaggactctttgtccgttcaaattttgtcatgagattgcagcaatttagtccatctttcggctccacttctatttatagagaacaagcagagtagatttagcataattcttgggggccctaggatttttagaatggtaaatgagcattagcttcaactttaagtcaccagctgcattagcctctaacaagagaatcagcctgtcctttgaagctttgaagccagccattgacttctctctagctctgaaaagttctagatggcatcttcttccaatagaaggctgtttcatctacactgaaaatctgttatgtagtgtagccaccatcaatgatcttggctagatcttctgaataacttgctgtagcttctacattagcacttgctgcttcaccttgcccttttatgttatatagatggcttctttccttaaacctaatgaaccagcctctgttagcttcaagcttttcttctgcagctttctcacctctctcagccttcaaagaactgaagagagtagagccttgttctggattaggcgtttgcttaagagaatgttttggttggtttgatcttctatccagaccactaaaactttcgccatgtaagaaatgaggctgttttactttcttatccttttttcttggttcactagagtagcacttgtaatttccttcaagaacttttctttgcattcgcaacgtggctgtttggtgcaagaggcctgtcttggctttctacgt

SEQ ID NO: 42876 - DNA, 1031 bp, Homo sapiens
agctagggcaaaatgactttgcagtgccacgactgctctgcccctatctgagaaaatgcttcttgtgctcggtagctcttgttaacttgaaaaactctagaattacataaataatgaatggatgcaaaaattcattggtttttgtaatgtagatgaaggtaagatgtcctgtcagaactgaaatttgcatagtagaaaaatttagttatcctatcttgttctttaaagcaataaatgactatgaatattcatggtcaattaaaatattaatggtatactgatactttagttttaggtctctagccatccataaagagtttcatttaaacttgactaacagtgaagggatactttagcatagtgtataatatattggcattttgtctctgaaatgaaaatgtagtacctgacatgagtaaataatttgcttactcttataattcatcatttcttttgataagaaaatattctcttcttgtatagactaaaacagggacacagtatgtatatcttttggtgttgaaatactctaatgtttttaagcactagtatttatctttatcatgtagttagagtttcatttagttgcttcaattgacttttagacttaaaaaaatttttaagtgtaaagtgtacagtacagtgttactaactccatccatattgtagttcaaccatcaccaccatctgtctccagaactctttttcatcttacaaaactgaagccatatccattaaacaataattccccattctccccttcctcaagtccctaataccctaataatcacaactttacttttttttttttttttcttgagatggagtctcactctgtcgccaggctggagtacagtggcatgatctcagctctctgcaacctccgcctcccgggttcaagtgatcctcctgcttcagcctcctgagtagctgggactacaggcacgcgccaccacgcccagctaattttttgtatttttagttgagatggggtttcaccatgttggccaggatggccaggatggtcttga

SEQ ID NO: 42877 - DNA, 1657 bp, Homo sapiens
ggtagctgggactacaggtgggtgctactgtgcctgtgtaattttttgtatttttagtagagacagggtttcaccatgttgcccaggagattcttgaactcctggcctcaagaaatctgttggccttggcctcccgaagtgctgagataagtcaggcataagccactctcccgtgacttttgaggtctttgaatgttgcttgcattgcctagcacttttatttattttcaaccaccaaccatctgtgaggatcttgggcaagatgcttcaccttttggtatcttggttttctcactggttgcttcagtaatatttgctttacctcataatactttgaggctcagaggagaatataattgcaaaggcaatttggacacttagtagctacgttattataagctattatttacatagacctattttcttcttcagtgaaataagagtggtgtagttttctactttcccaatcacctaggtgcagtgtaccctctattacttgcactaatggagagaatcgatgttgcaaattttccagaacgccaaataattagaaaatcattcagaaaataattcagcatttacatttacatatgggtctctcttgtgttccaagaattcataattcagaaaagaaaagcaaaataaataaataaataaataaagtctgactcagaagaaaataagctttacaacttgccatctttgccctttattcccagcggccttttgtgggacagatatgtatctatgtctctaaccggtgcagagttctagcttacagcattgttggcttatttttatttttattttttaacatttcaaacctttagtcagacaggaactgacttgtgtgaagtgtctatcttgttttctcagcttctatagcagtatcaactatgtatagattatgctaagaaagtatgtaattaaatactgtcaatgtacatttgaaagcaagtttgcagtgaatcacctatccagggaataatcctgggttgtcctgtaagagtacttagaaatgcaacagatgtacactgcgttgcccagcttcccctttgtttatatgctgctttttaaaaaattgaggaataagttgtttggcatattcttttcgtagacctctttgtgatcgggtttttttcaagggtaaaaatctgattgcttttttaattcattgaaatgctggattttgttgttttattggtgtcctttggcttggcatacttactgatagtcctgttatttttatttggagacatagctttctgtttattagtggaaatatatagtgaaaatctttggaggcctgtatgtatgtatgtatgtgtgtgtacatgtatgtgtatatatttatatatatatttttggaggaagatacatatttttcaaaaattaaggattagttcattcccttcaattctaataggccataaatcactctgaattgttatgcatctgtcccaccattatattcacatttcctggtggacatgatctttataaataaataaaacatttcaatccagcctctccctccccatcttcatgttcctttcccactgctactttccctacttctttcatagttggaaaaagagaaatcccctagaagtgggagtggagcagacaggatgggctagcagtttctgccttcctt

SEQ ID NO: 42878 - DNA, 1025 bp, Homo sapiens
tccttctggtccctaacaggcagtcactaaaaatgttttgagtaaatgagcaaatgaattgaaggtaaaagtgatgggggcagttttaaatgtataaggcaaattggatggatattgaatattctttcagtatgtctacagtacctttcattgtaattcttgaatattaaaagatactttttaaatctctacactgtcctgagcacacatatatatatagatacacacacatacatatacgtacatacaaacacacacactcattgccttcactttagctagttgattattagaatatattctgtacagtcacatttgttccagccactttgtttttgaagttttagtacatctgcagcctctcctggtggctgccagtatcgctgtcacctgcaatgctttgccaaccacctgaagctctcttactctgtccagtgtgctgaaggtgctggcatccatcaatatcttttttgcatattctatttagttttgctttttgcatctgtgaaaaatagtagaacatcttctcaatgtaagagtggaaataagaatagtaaagaaaattgtacaaaaataggccactaaattcattctttagcatgaaattagaaatgctgaacaggttcgatagaggtgcatcaatgctcagaaatgcatctaagtgaatctacagctctttcttactttgaagcttttaagaaaattgatacgaggatttcactgaagattaaaaagaaaccaacatccttctctgaacgttggaggtctgtctgctttataagcctcaactcattatattttcttttttacatgtttttgattgacatgttgattttaaaaatgcaacttcaacattcagtgggagttgacagtatttaaactgaattttggggcaaaattcttcaatatagtcatatttttctgttatttttaattcattcttttttttccagcaaatactcgctgagtgcttactatataccagacactgtccttggctttgtggaagctgtgttcctaatgag

SEQ ID NO: 42879 - DNA, 1049 bp, Homo sapiens
agggatggaatggtgtaccccatcagagtgtttctcttggctttcctgtatgtaaacctcactaatactttcagtcaccaccttctgtgtcattccttttaagcaaaaggagaagaagtggaattgggttcaaggccatgctttgcttttcacaagagagtgctctcagaagcgctggtgtagttccaacaccttatttctactgctgcctgatagtggcttgaagtggttatttagagggagagggtggcttggtaggaatgtacttcattcagtatttttgttgatgctgtcattggaatgaacctcagtgaatgattttaagagcatagttcttagaagttatgatgataaatgactgaatgagaacctatttaatattatgtcactactttggggaaaaataattttagctgagtatttcaggagtaagagaaagtttatattcctaagatttagttattttctaggtttttatccttttataaatatacaaaactactcaaaacagacttggttaatactctgaaccagcttggaatacattcttttgtttgatcatttttcctctatttttcagtttggtaatttaattttacggtcatatgtatgtaccctggtctggagagttctctcacatggcatgattagcaattgtgtgtgaaatgattatgtggcaacattactagtgaattacagctagtctaaatactttgtgttttcacttgagaacattggctctggaatgtatatctggcaccgagaaggaaaaaggaaaaaaggcttgacgataaaatgcagccagagtgtaaattgtgaaatggagctctaggctcaattgatcctccactgctagcaacttgagattgtgcatttcctttctagaatgaaaattatgcccttttaagaatacttagtcaatttttaatcttcaaattggtgggtttttttaaataaaaaaagccagaagtttacatggtgtgtgtttatgtctgtatattattatacaaaggatctaaattataagccctaattcatgccacttcaaa

SEQ ID NO: 42880 - DNA, 1046 bp, Homo sapiens
gatgtgtggggtggatgtgtgatcaactgaagaggtttcctaggaaggtagaaatcaaatgagatcttgagtaaaggtaacagaaaggaatactgttgcaataaggagtaaagatgtggtgtttaataatcctgtttaatctcaatgcatagtttatggagagactagtgtacctggaacagtggctgcatgttgatattgttgcaaatgatattgcataggaaagaaatgatcttttggtttagtttcaggtaaaacaaaaacaaaagaagtaaccttagccaatcattgatttggtgaagacttcagagaagctttttttttttttttttttttttttttttgtggttcatataaatgggaaaaggggctggtttctccaagacagaagtagctgtggtatctcctctcaggtaaaatgccctcaaagcattagtcattgaccatccataggtaatagagacatagactgtgatgtgagggcagtttagttccatgatttcttggctgtatgatatagggttggttgtttaatctatcttcatctttctaatgtggatagtagtagtggcagcaccaccagcagctatttcatagagttgctgaagattatttaagtatccgataagtggtaactatggtgacagttgtctgcctgtgtttgctaatgatgaacgtattcattccctcactcattgattcactgagcaaatatatactaaggatgctctaagggccttgtcccatgcctgcgttctggggaaaaattactggttttatattgttatttgcatttcttccctttttttggcaaaagcaaatgttttcttattttggtttcatttatacttttgcagtgtttgtcaaagtgtgttctaaaaactgcctgcatcaaaatcagcaggggttcttattgtaagtgtggattcctggtccttacgttggacctactgaatcagaacctctgggaagggcatggagaatcagcattttgagcaggctcttaggtgatttctatacatattgaagtttacaacctgttaggg

SEQ ID NO: 42881 - DNA, 1100 bp, Homo sapiens
aacatacccgtattaagggtgagagaagtgttgaggtagcacatgatgagatagcaaaggacacagaaagaaagccagtttcgggaaaccatgcaagggtattatttagagaagaagagagttattaaaaactacaaagaactcaaggagaatgggagggaaattatcagatatagagattatgtgtctttagggactttgacaagaacagttttgagtagagcatttagtcatatctcaatatgccattcattttgaagctttggattagtttattccatgattatcctcacctatcacgtatggctagtttaagagcgttatttaatctagagtaacagttctgaatgttttttaacaacaacaacaacaacaaaatagcgcatgtgacacttcctttacttctttgtcccattcctcctcttttctaaaataaacaaatatgtgtataaaacaagaaaaaaaaagtgtgggatagtatctgctttactgagaacagcagaagtagctatttttctctattttgcctaggaagtattttgctaagaagcagtagatagaagatggcagtaggtaacggtaaatgtgttagtggactctcttgaaagtggaatttcctatactttttactaaggtactcaaaacatctcacagacctgcttcgtttttataagtatgtattgtgcaagtgatatggctgttaattttctttgttttcccttttgcagtggagaaagtgaaacagaaaggagtggtgtgggacaaatgcaacccccagttttccttttctgtgcagtgtctcctagtctgcatttttcctgctgatcagaacaaagtgtcaccaccattgtgaccagctattctgacttgttgctaaatccatctatagtatttgatgtggctcactggtatatcctctttgaaagactcccttcacttagctgccaggatacgcgctcttctaatttttctcctgcctcattgtctcctcccaactctgtcccctccatctccctgacctcttactagcctgtagtacccaggggttagtcattggccaccttttcttctttcatgtacactcacttccctggtaatct

SEQ ID NO: 42882 - DNA, 1049 bp, Homo sapiens
ccatgcacatattttatctgttatctggaaatagaatataagttccaaatgggcagggatttttgtctgttttgttcactgtagttttcgtaccacttagaatggttcctgacatacagtaggccctcaattaatgtttgttgaatgaatgaatgaagtttcagagcctaaaatagagtggttgagtcagggtatgtcagtgtatgttggtctgcgagtacgatttttctactgatctccaaactacagtctcaagacaacagttttccacctctgaacagaggtgcctctgaatacccagatctttatgtctgtgaacaagcactgcctattagagccaaacaagagaaacacatattaccatctccaattctttagaatccttttggcccagaatgacttcaaaatgctaacccataaaggcaaacaaatccagagacctttgtagtttcccttagcctctgctgcattagctgaagataaatctatgcagaattcacttaagggaacagacaactacattaagctgtgtaatgatgaacattaatggcctgtgacaaaatgggtctctgtaggctgagcaaccatgcaaggtggggatttttccctgtttttggtaaggtaatgaagaaggaaaaaaaaagtctcatccaaagatgcaaagaaacaatctgctggcccaggtcattttcatggtatctttttgtttctcctttctttgttttgtaagtacatgcattttggctgaaaaagatacaggcaccattttacagtggtgggggaatctctactttgttaaagaaaaatgcaatgctctttatttccaacctggtatagttcattcattccttttcctgtggtattcacatgtcttgcaaattgttatgttgaattttttagttccttgttatttttacttgtagacacttacaccatggtcacaggaatctatactgatttcttccactttccatgcatttgtttccattattaatttaagtgagaagcatgtgtgtcattccccttcccatttgacttttacatggtta

SEQ ID NO: 42883 - DNA, 1016 bp, Homo sapiens
attcagaatgtcactgtgacacacatactatattttcagtatttgcttctcagatattcagaacactttttaccctacagcagaattatttgacaacacatttccttcctgccctctgaatctccctggatgatctacaaaaatatagcatctccatttgtgacaatataaaaccctggtatgactcttttctataaattcagttttattgccttcttccaaagtaatttctgttaatccagccagaaccttcatttttgttttgtcattttcaagctagattctgaagtaacagaactgactacaattttagcctaagaacaaaagagtttcaaggcctatttcaagaccctggttttgctacctcatctactaaatttatacattctaggaatccatttactttttaaaacatttcttttcttattttcagtaccaatttgtttccttcagctttcccacatgcatgacttttatagcatggcataaagtagagtgctctgccatattgatttaatggtatgtttcaataaatttcccctgttacagttcttgctccataccaggcatccaagagggaaatagacggatgtgctggttaactaattttaaaagcgaaaaaattccattttctccatcctttaatgtcatagctgtcctgccaatgacctgatactgagatatattaggttcctctgacatatgttacaggaagtagtgacctgaccttttaaaaattttattaacatttataaatttgttttagtgtattatgttggaagcagtgatttttctccagaatggattggggtgactggtgtacagattgatagccatgtcatatattaaggtggtggacattttgtagagtccaccatctctatactcacaatatattgtagagtatagagatgctgtctttttttcccctccctcttctctcctgcctttaagggttatgctaatggggatggaaacattcaaaatcttactttaatgcagtttataagcaacta

SEQ ID NO: 42884 - DNA, 1037 bp, Homo sapiens
aggtgcataccaccctcagtagctatattaacttatctcaggttgcagagtctttggggttgtgcttgggttaaaattctagccatgcagctttgtgacagggaaagttctttaatcatttgaacttgtttcctcacttgtacgatggagcaaatacctagctcaccgtgttgttcaagtgtcaactcaaatgatattatgtgaaagattctggcatttcctagctgcctagccagtgtatggtttgtttcaatttgattccatgtgtgactgcatgctcttggcctattgctaacgagcaggcagagaaacagcagcagtacagtctggctagagggcgtctgttgagcctccaaacattgaaggctactttgcctctttgtcaggggcatgagcctccagaaactctttcctagatgcgctaattgtgtttcttcttcctcactgtgtaacatgttatactgggaatctctcctgaatgtttgtttgtgtctctatctctatattttctatgacagtatttgcctgactgaggtaatcccaactggagggctgaggtgacagatttggagaacattcttacaacatgctgttcaagcatttaccaccatgatgtaataagtgtttgtatttaacagtatttatttagttcctgttatgtatcaagtaatgaaaaaaacctgctttcatggagtggacattctaatgggaggggcagacaataagcaaatgtcaaatgcctcaggtgtgttaagtactgtgaagaaaaataaagcgggctaaggaggagtcagataggatgctgcttgccatagggtgctcagggtgcgtggtcaagcaaagacttgaatgaattcagggaacaaaccatgagatacctgggagagacgcattcctggtagaggacaacagccctgagacccgtatacctgaagacaagtgagcaaggaagggagtgtgtcgaagatgacatcagagagatgccagggcaagattatgaaaggtcatgtagatggtaataaggactttgaatttta

SEQ ID NO: 42885 - DNA, 1092 bp, Homo sapiens
gtagttctaatcactttatgacacccgttaaatatttcaatcacattagcctcaagtctagactgaatagcaccagttcttcttctaaatagtttggctgcccttctgtgagtcttttctagttgactcttgtctcttttcatgtgtaggaaccaggactgaagacagtaattgtgagaggatctagcatgtacaaagtggaagggagggtgttatgtttctgtgatttattactttcccaaaagatgttttatcagctaccaccctatccttttttccccaaggcattcttttctctctctaattaagtaaataaattaattaataggatatctatgtggtatctaactgtgtatacccttgagctatttattttcctatttttctggtcattttcattagttaaaagtctgttcttaagatctcttatttacagtaggagtttcttatgtatattatagaaagctattcaaaaagttatattcatttaatcaaaaaataaattattggggggtatgtagtaaactctgtgtgtgtgtgtgtgtgtgtgtgtgtgtatgtgtgtgtgtgtgtgtgtgttgagaacaaagtgatgaatcaccaaggcttcagagttcttgcctcctttattctgacagtcattcttatttatgctgataacatctgtcttatccttacaaggtattattctgttttattagagctccctgtttcatatacatgagaaaaaacttagtggtttagtaattcttagtgtctcccttgtctctaatgttttgagttttaggaaaaaagaacagaagattcttgttaacatctttgttaccgttaagatgtattgttgtttctaggaacaaatgacaaatcccatgtctttgtcattccataagccttctaccaaatccatgggtcaaagtgccgtatgcaggtgatttactgtgcttgatttgttccatgatttcatctttagacacttccatctttgtcaaggccatgctaatctcaccacagagaatgtatactagaatttctcaaatgtcaaatatattgtgtacacttaaaaaaaagattgtcatctaagtttatcaatca

SEQ ID NO: 42886 - DNA, 1034 bp, Homo sapiens
agttttccaacagcaccttaacctttctcctcctccttagaattagtatttctcaataatattgtcaatgaagtagaaattaattatttgccacatgttcggtactgtgctaagcgcttcacatgttattttattccatttgtaccttggtcctatgaagtatgtcctgttgtatcctcctccttgttttggatagggaaactgaggtccagagaatttaagtaccatgccccttgtattagggttctctagagggacagaactgataggatagatgtatatatgaaggggaatttagtaagaagtactgagtcacacgatcataaagtgaagttccacaataagctgtctgcaagctgaggagcaaggaagccagtccgactcccaaaacctcaaaagtagggaagccaacagtgcacccttcagtctgtggccaaaggtccgatagcccctggcaaaccactggtgtgagtccaagagtccaaaagctgaagaacttggaatctgatgttagagggcaggaagcatccagcatgggagagggatgtaggccggaagactcagcaagtcaaaattcttccaccttcctctgcctgctttattctagccctgctggcagctgattagatggtgcccaccctgcttgagggtgggtctgcctctcccagttcactgactcaaatgttaatctcctttggcgacaccttcacagacacacccaggaacaatactttgcatccttcaatccaatccggttgacacccaatattaacccatcacactcctaattacacagttagaaagtcgtgtagccacgattcaaacaaacccaggcaatctgattccagggcccactctcttgataatcacatggatttaaatcaataaaaaaaatataaaatgctgtctatattctcggcatgggtgatagaaaaatagccgtgtagataaacctagcctccgtagtccctggcagagaaaggctgtaaggaaagtgtcttttctgtaagaggaaggggaagcaggataggaag

SEQ ID NO: 42887 - DNA, 1398 bp, Homo sapiens
acaatatttgccctttattttttatttatttatttattttttttgagatggagcctcactccatcgcccaggttggagtgcagtgatacaatctcagctcactgcaacttccacctcctgggttcaagcaattctcttgcctcagcctcctgagtagctgggactacaggcgcacgccaccacgcctggctaatttttgtatttttagtagagacggagttttgccatgttgggcaggctggtcttgaactcctgacctcccaaaatgctgggattatgggcatgagtcactgtgcctggcctcatttttgtttttgatggaatggaattcctggattttgaaattctgaaactctggttatcatgagtgacagtgaacaattacttagataatggaatgataaaaataccagaaatttttaaggtgctctgtggttcatattatttataatgtgcttttttgaaatcttcaagatagaatctaataaaaactttcagactcagaagttggaagtaggagtactgacttcttagtataaggtgaagcagaagtatatgactccttgttacaaggagaaaaagacacaaaaaggaagaatatgtggtcaatacagaaaaataggaattcttcatacgtgacttgataaactaaaataaatgaagaatttgaggcatttattatcataatctcttgttgagtttgtgatgctgagtttgggaaagaacaaacattttagttggctagatggggaacattgatatgaaacaattcagtgggttacctagtcctaataaaagaattccattccacagcatggagaaagagagatcaacattaattgacattgaatggattggaagaagacaatcaacacatttattcatttatttattcaataaatatttattggacatttattatttgctgcagaacagacaagattccctgccgttgtagaggttaaattctgatgagagagaagtgtccattttgttgtgagcactgtgatgggttcttcccgttcattctctcatttaagtcctgcagcaacttatggcattatcattatttcccatttaaagatgaccaaactgagtctcagtaagttgctgaagattacacagcttgtaagtaactggaaaggtaattgatgtatacttattaacagattcatcaagttacatgcattaaatatgtacagcatcttgtttgtctgtcagtcatatcctaataaagtggtttcaaaaaacaaaaatctcagttggtctgaccccatggatccatagctccactactgtactgtctccttccatggtcacactttttataggaatcccttaccaaatgtccacatttaataattttagaacatgtgagtttgctcatcattcagttgc

SEQ ID NO: 42888 - DNA, 1061 bp, Homo sapiens
gttatcactaggctgtgtctgccaaggtggacattgatggaggtgctgtagaaacatatagattttgtggaggaataggacgtaggagatgacatcaaggaggaagaaaagataaaaaggaagcaagacagttccatgcacagaccagtcagctacagtgaagcatcctgcaaactggcaaactgattatcagcagtggctgtcaccaggctctgccccagcaggtgagagttgctacctgccaatttgtttagacaccttgtttgttattagattaaggttttgaatacatctgatccaagagaatggggcataatcatatttaatgtggatttggccagacctcagactacatagctggaagattatgtctattcattgcctaagtgagtttagcattgttttaaaacattctctgatggactcatcactatcataatctgttttctttttttttttttttttttttcaaagtggtatgtggtttcagtgtcgtcgtgaagactctgtggctttttagccaaatcatcttaatgccaatctcttactacttgtgaaaccttggataaatgacttaatctcttgtctcagtttcctcctctataaaatggggatagcaatagaacctacttgatagcatttttgtgagtaaagcactttgaagagtgcttggcacatggtaaatgctgtaggcattagctagactgctattactgtgattattgttattgctgtagttattattacacatatgttattacaccaaacttaaattggtcaccattatcctcttagcatcaaatgacagatgaacaagagcatttacttttagattcctggcactttgcctatgagtgttgtcatttttatcagccataaaataacttatgagtttaataaaatatcgtatgccatagtagccaggcatttagagaatacttgggaggaagtgcagcagaagcagcaatggtgatagtctgggcttctatcacagggtgggacagaccttggagatatgctgtctcctctgtacttgatctttcatgtgccatccggagtct

SEQ ID NO: 42889 - DNA, 1019 bp, Homo sapiens
cttaaagagtacatgctacaacactacattcaaaaaggtttattctagcatgatacttaagtattctttttctagatgcatttcattcatttaggcatccattcatcaaatgtttattgaatacttacaatgtgcagggcactacagagtgctgggcatgtagcaatgaaaagttgacatgggactctgtctttaagtggctttcactgtgttggagaaaacaaattgaaaaatgtaagggcttgttatagagctgaaatacttgtatatgggagcgagtcttgggtgaatgcaacctatgtatacagataaggatttagaaaaatgtaagagcaaaaatactgctttagaaggatctgtaagagacattctgcctattcacagaatagtgtatacttattacatctaatcttgcctgatagacttgaaaacataaaatggtttttaatatagattatgatatggtctcctgtcatgacatatagaaatggaaatgcccccaaaaaagagcttacttctagaatatgtttgtaattataggatttatttgttttacactacttagaaaatattctttggccgggcactgtggctcatgcctgtaatcccagcactttgggaggacaaggcaggcagatcaaaaggtcaggagattgagaccatcctggccaatatggtgaaacctcgtctttactaaaatacaaaaattagcaaggtgtggtggtgcgcacctgtattccaagctactcgggagtctgaggcagggaaatcactagaacctgggaggcagagattgtggtgagcccagatcacacccctgcactccagcctggctacagagcaagactccatcttaacaaaaagaaaaaaaataaaatattctttaaaagtacatttcttcaattggccataattcataccagtcctgtgttctttgagctcaactataaattaagaagcaagaaatttagtttttctttcatagttacattttttaaaaaaattggtatcccgaatag

SEQ ID NO: 42890 - DNA, 1052 bp, Homo sapiens
taagaaaggaaggggctacccaaacctaccccagagatagttatcaatagcatacttgggaccagaacaaggccctttctcccaataatcagaggcatctcctcatgctcatcttccctgcaatgttttagattttaaacaggctttgttaggatggctgaactccagtctcctttattaattgctgcccacatgttgtaggatatcctgtgttctgaatcaggatgaggattttaaattcttcttagcgtagggacgtgtagccaggcagaatcaattcctgtcactcacacacaaatacagaggaatgggattatggatcagggtgaagctgcagtgctttaatctcaaaatcaatacagaaaaggaagttgaacttctggggattctatagagactgtaatttggcttcctatgaggtttgccttatagaatatagctgctccttccttttcaccttctgattattttactggggtgggaaaaatgaggggaaggggaaagatgacaagaaacttctaccaccaaatcttcttgaataagcatgcaagtgtaactcgtaattcaagctaatccattgtgttgagaagagctatacacctttgtttattcttttagaaaataattagccaaaaccctgtaccccataatctgtatttaagcataataaaaatgcctttgatttattcatagttcactgtcaagactggaaaagtattttttaagcatacttttatggctaagcttaccatagcctatgtaattttatataaatacaaaatcaacaaaccagttattgaccgaaggattccaagctgctcagcctgtgattaatatttaccccagtgtatttctgcttcttttgaaagaggcatgaactaatggtttaaacaactcagtcttttcttaataaaaaatttagaatttgttgactatgcgtctttttcagatataacactgatttgctgcacagtgctgtcggcatctagctttaagatgggcttatttttcctttcagatagtttttttaattcagttttaaaatatgtctg

SEQ ID NO: 42891 - DNA, 1032 bp, Homo sapiens
tcttgcattcatgtggtgtatttgttataattgatgagctaatactgatacaatattaatgactaaagtctgtagtttacattaaggatcactcttcatattctaaatatatcggttttgacacatgtataaggaatacatccaccattatagtattatgcagaataataattttgctgccctaaaaacttcctgtgttcctcctattcatccctccctccctcaacagcctgaacccctggcaaccactgatctttttattgtctccatagtttcgtcttttgcagaatgttatatacttgaaatcatacagtatgtttcctcttgagaatgacttattttgcttagcaatgtgcatttaagtttcctccatggtttttttattttgtggtattattgctcatttcttttttatctctgaattatgttccatttcataggtgtaccactctattcactcatctattgaaggatatcttagttgctttcaagttttggcagttatgaacaaaggtgctgtaaataatttgtgtgctggtttttatgtggatgcaggtttttaactcatttgagtaaataccaaagaatgtgattgctggatcataagggcaaaatatgtttagttgtataagaaactgccaaaatgtattccaaagtggttgtatcatttcacattcctaccagcaaggaacaagagctcctgtttctccacattcttgccaacatttgatgctgtcagtgttttggattttagccattcttatgaatgtgtagagatatctcattgtattaatttgcaatttcctaatgacatgtgatgttgaacatcttttcatatgctatttgctgtctctatatctttggtgaagtgtttattcaaatcttttgcctacattttaattgggttatgggtgttcttgttcagttttaagagttatatgtatattttgggtagcagtccttcatctgataagtattttgcaaagattttctcccagcctgtagtttgccctttcattctcttcacgatgt

SEQ ID NO: 42892 - DNA, 1043 bp, Homo sapiens
tttttttgagatggattcatgcagtggcgcgatctcggctcactgcagcctctgcttcccaggttcaagcgattctcctgcctcagcctccctagtaactaggattacaggtgcccaccaccacgcctggctaatttttagtatttttagtagaggcagggtttcactacattgcccaggctggtctcgaactcctgatctcgtgatccgcccgcctcggcctcccaaagtgctgggattacaggcatgagccactgcgcctggccgaaaattattttcatagtagaatatctcttcagataggacagtaggagtctcatccacctgaacatttcatgtcaggtattacatttagaagaaagtagagaaaaaagttctacattttagttgcagagcatggctggctatacattgttcaggaggttaaaactaattatttttttcctaaggtaattttttcatctcttttagtgtttgcctaaatgtttctctatctcctttacacataaaagggtctcctggttgtatctagctcctgaccacaccaaaggtaccactcttgcatttcccctaccacacagtacacagttccctgttccttctcctctggtattctcccctcagtctttctgacactgtttctgcttaagattctttcagttgaaagtcacagacttaattgaaggaaaaagaatgcattgactcatacagcagataaatcaaaggacttcaagagtggctggatccagaggttcccaaaatatcgtcaggtcccaggcatgcttacagattctctctctctctctctctctctctctctcggatctaagtttctacatgttttcctgcattcatcacaatttcaaccttgtaataaaggcacaaataatgctggctctttgtaatgcctgctgtttgtaagatccctaaataaagactccaaaattgttatcattaagaaaattctcagaacaatatatgacctacataaaaattgttagactatttttcagtttaacagtagtgattttcttttgcatctt

SEQ ID NO: 42893 - DNA, 1044 bp, Homo sapiens
gtggacatgtagtgctacaaatttccctctaaacactgctttagctgtgtctgagagattctggtatgttgtgtctttgttctcattggtttcaaagaacgtatttatttctgccttcattttgttatttacccagttgtcattcaggagcaggttgtttagtttccatgaagttgtgtggttttgagtgtgtttcttaatcctgagttctaatttgattgcactgtggtcccagagacggtttgttatgatttccgttcttttgcatttgctgaggcatgttttacttccaattatgtggtcagtttttagaataagtgcagtgtggtactgagaataatgtatattctgttgacttgggatggagagttctgtagatgtctattaggtccacttggtccagagctgagttcaagtcctggatatccttgttaatattctgtctcgttgatctgtctgatactgatagtggggtgttaaagtctcccactattattgtgtgggagtctaagtccctttgtaggtctctaagaacttgctttatgaaatctgggtgctcctgtattgggtgcatatatatttaggatagttagctcttcttgttgcattaatccctttaaccattatgtaatgtccttctttgtctttcttgaattttgttggtttaaagtctgttttatctgagactatgattgcaaccactgcttttttttctctttttttgctttccatttgcttggtaaatattcctccatccctctattttgagcctatgtgtgtctttgcatgtgagatgggtctcctgaatacagcacaccaatgggtcttgactctatccaatttgccagtctgtgtcttttaaatggggcatttagcccagttacatttaaagttaacattgttatgtgtgaatttgatcctgtcattatgatgctagctggttattttgcccattagttgatgcagtttcttcatagtgtcaatggtctttacaatttggtatgtttttgcagtggctggtaccagcttttcttttccatattt

SEQ ID NO: 42894 - DNA, 1050 bp, Homo sapiens
attgtatatgcctgtggtcttctctgcttcccaattgtgtataaagaaaagcgggatttcctgtgtacttcaacagtttataataacctggcctcttctctaaggccttggcatggtggcagtaggtgtacatggcaatgctggagatgtggctattaccaggctttgccaccaacatgaagtccactcatttgtaactactaggacaatgtagaaataccctaaaattattgtcagatcagcagatgcaaccatcagaggtagattttctttggtcgtttaaatgtatagaggattagaagacagcaattctgtgtgcaagtttctgcaggaatgcctctaatctgtcatccgttttctttgccccgcactgtgctgacccctcaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggtaggagggaaaactgggtttagtttcttatgccaaagctaagacctcgttgcctgtgaagtcatttttaaaaatagactcttggtgcagaaaaagcttagtttaaaaaaagaaagaagcacagatagatgtttttaggtcctatagagaaaataattccacagaattctattgaattttgttactttggcagatagtttttcctgatgtctaacccaagttcttcttaactacaatacttgaataactctttttttctgcatgtaaaagtatacatgctcattgcataaaatatataagataagatacaaagaagaatataaacctttgatctagaggctaagatatttggtatattttctcctggcttttttgcatgtgctgtgttgtttatgtgacttttcacacatattcaagcatgtgattgccctttttccaaaactggaactgtgttaatgcaattttatattaatttaattttgttttcccctatcaataacgtt

SEQ ID NO: 42895 - DNA, 1029 bp, Homo sapiens
tctcaaagtttccttgttttgcttggtgaggtggaaacagaatgcaaactagagcttgaatcccacattttactagtagctgcttagcccccagtagtttttaaccttttaatacttcggttaccttacctataaaatagagatgatttctttacactttagggtggttgtagataaaatgaaactgcaagtaaaatgcccagtacaaatagaagggggagattagtgattatttattcattcttattcttcctattgtaatgtgtaagaggattctagcacttagtttcccagtttttatatttttgatagtagcttcatgttattgaaaagtgagtcaaattagggggcaaggcagaggaatttaattctcattttaaacagcaatatagtaacaagaggagagatgaaaggcagcaaggataaagaccgaaggtacaagatatcagtggttttgacgaagttttctcaatcaaagactgcaagctgctcccacgttgcccagatccggatcctacagagctccattgaaggggatttcagtggaatggtttcctcacagaaggagaccagggtgactttatttcttcactgaaacactttgattataaaaagaaatcagatgatcaaaaagcatgagatgatgggtgaaatatgttatatgattataattcaataataattgaatttctctagcatttttcccttgtgggaggctcagagaagttcagatgtattatctgaattcgtttcggcatacattggtggagaggggccctgtgttaggctttccattcttcacaccctacccaggccatgagaccggagcaatgttcctgtagctttggtacccgtggctttataaacatgaacgtgaacattttaggcacaatttagaaggggattatccgcatccctcctcagggagagtccttgagtagaagtgtcatctttccagttccttctgaatccccttcgagcaattgctctaggttcaaacagttcatgaaacagaatgccacaatgaaa

SEQ ID NO: 42896 - DNA, 1031 bp, Homo sapiens
cacttatcacaggagaacatggaactgcagcaaacatctcaattaatggatcaatcctcacaacagtattggctgcggacagatgtcttctgtatagttaagaagtcagggttccagtttataggatttgcatttttataacagctttatcaagatataatttacataccataaacattaacccttttaacgtatgcaattcattggttcttagtatagtcacagcgttgtacagccatcatcaccagctagttttggaacattttcatcaccccgaaaggaaaccccatatccattagcagtcactcctcatttcccccaaacgctacccctggcaaccatacatctactttctgtctctgtgggtttgcctcttctggatagatcatagaagtgaaattacacaatatttagtcttttgcggctagcttgtttcaattagcataatattttcaagatttataaaattagcacttgtcttaataacagggtatgagacagttaaaaatatactcaggtacacatcccaacacctggcctacagcctgctctctttttcatttcctttttctgtaggggtggggagaaggaagctaaagtgtttatatcgaagtatggcatacacacagtaaactgcacagatcttaagtacacagcttgattcctcttgacaaagagaatacacccttataaccatcactcctataaaaatacagaatgttaaaaccacctcagggccgggcacaatggctcatgcctataatcccaccacgttgggaggctgagacaggcggatcgcttgaggccaggagttcgagaccagcctggccaacatggtgaaaccccgtctctaataaaaatacaaaaattagtcaggcgtgggtagtcccagctacctgggaggctgaggcaggagaatcgcttgaacctgggaggcagaggttgcagtgagccaagatcgtaccactgcattctagccaggacgacagagtaagactatgtcttaaaaaaaaaaacaaaaaaagacggct

SEQ ID NO: 42897 - DNA, 1054 bp, Homo sapiens
acacctggcccctttaccatttcttgatggaactaatggattcccaccccacagcctttatgaatggactgaggccattgaattcaggattcttactttggtgtgtagctgtggctgcctccctaggaccagggcacagaaatttcacagtaaccaatgagagagaccaggggccagctccaagccagagtcatttcattcagggcagatgtgatcagaagaccagccaaggggctgtccctctagcaggatgtgaaaacaaggagagtcctggtcaacacaattttgcttggaaagcaaagtgggtgctgaaatacctacacctgagagcgattgtcttaatgtggcaggaatgtaaaacaaattggacataatttggagggagggtaatgaggtaccacgaacaagaaaacataaagaatcactaggctcggcaaggtgtcaaccctgtcctaattaggcacagttgttataagaagtacataattaataagcgtgtgaccagatgtgaaatacagcagaggtttttcctgaaatggagggtgtaatgaactgcgcagctggaagtagttgtcctaatttggcgcaggcggaaggcctgcctggaattttgaagaggtgtagtaagatgcacaccacaggtttacacctgaaaacaactaatcctattccaactggactggggtgtaatgagatagagctacttatcaagagtgtaatgagatgcaaaagccattggaactgagctggaaatttctttaaaagtgaactaagacgcaaacaccaggaaagaatttctgctaatggaggtaggtgtgagtgtgatgaaacgtacaccatgtgaggagaggctgctttaacatgtctgggccaaagacgcgtctgtaattaaaaatattgccaggacatttacacacctggagcaagagtccctgggaacctaagaacgcaatgacttgtaaaagccacatgcatactattaagatgtatgtgaccacttatgtgtgtacaaataactggaaaaaaaataaaaggaacttaggtgttttcgggt

SEQ ID NO: 42898 - DNA, 1012 bp, Homo sapiens
ctggtttacagtaagcaatgaataaatggaagtgattattgatgtttttgtactaatgagaagagtttagaataaatatttcctcccctcaccttctctccctctgtctaattctgtcttctctgcctgataaaataacttgttttatggatacaacgccttgtactttgatgcccagaatcccaaagtagggattctgttagtaaaagtccagcctagtgagcagtttggtgaactagcaagagtaaaaattgagcaacaagaggtctagacactaattcctgctctgctgctaacaagccaggcaatttggggcaagtcattagcccctgaaggctataatttcttctataaaaagaattgggataagatggacttgtaggttccttctgttttttatattttatggttctatatgaaaaggtttttctctgaatgaattcttttattgatacttaaaaaaccttggctgatgtattttttcttctgagacctcttattgcgtagctttatcttgcctcattttttttcacacgcaaaaggggtagttgaaggtgaactgtggagttgatcattctaggtttggatttcagtaccaccacttggcttttggccagttatttaacctctctgaggctcagtgttctcatctgtctaatgaggatggacagagggtagatgtgaagatgaaaggaggcagaattcttagactaacctcaaaggctatagtttgattgtcctgtaggacattaaccagttttgtctataacttggcaaacttatttcagaatgtcttttctcatggactctgaatgcctgattactatcttcctgatttcttcattaattagtgagtctaatagaatctttcacatgtgcttcattctattttttatataagaatcctgtttttaactttttgaaaattattctttgactgccttcagacactctcctcgatagactgacataggcgaaactcactagaaatgctgattaagttactgaaaaa

SEQ ID NO: 42899 - DNA, 1029 bp, Homo sapiens
ctcttctctcctcttctctttctttcacagggtcttactctgtcacccagactggaatacagtggtacagtcatgactcactgcagtctcgacctcctagtctcaagtaatcctcctgcctcagcctcctgagtagcagggactacaggtgtacaccaaagcacctggctagttcttgtaatttttgtaagagacgggggccttgccatattgcctaggctggtcttgatctcctgggctcaagaaatcaggccacctcaacctccctaagtgctggtgttacaggcatgagccactgtgcccagcctaggatattttcagtgctctcattctgtgatattcttctggtttcccctctttacatctttgcatctattcacagtcaccttttctctttgaggccaaacatatttctgtgttatgcctgttccctttcaccaactcctttcctcatttgtcttatttcttcttattctcccttctctaacctgcggtgtcttctgttactctgattcttctattaaccacttgggttccccttcctttgtaatgtccttctgttcactttcaacatttggcctgtttcttttttcccttcctcataccccattttgtctttcctctttttttacttccttctacatgagctagttcccattagttttgcttaaagttgaccatagaaagctattaattattctattcgttattacttcttttgtcttttgttggtttactttgctatctttaacagtgactgttgcaaaactatagcagtgtttttgcaactttgagatgtttgtatggtttccaccagcttccccccccccccagaggaattcacaaatgaaccaccagtgtactttgttattctaattaacacatagctctttggctatggggttcattagcaccattgttaatctgtcttcagtatgccattaacaaaccatagaaggggttgtcaagaactagctattcctttttggcttgtaagacacatgtggaacaggttcattatttcttcca

SEQ ID NO: 42900 - DNA, 1009 bp, Homo sapiens
ttctctcctaccaaagtcataagtttcttaagggcacaatatagctctcttccatcattgcatttctcatcatgccaagcacaatgccttgtaaatagtaaatattcagtaagtgtttatttattattactgttctagcggccttcattaaacaatcaccattattctatatgagaacgtgcttataatgactcttcattggtttgcttgttttctgactccgccatcacgacataaaacaatcatagaagtctttgttccactcaaccaaattcccctcaacctcatctgaagttgactagaatcaagatatcctggaaagaattttggacaaggattcaagagacttagatactgcttctctataactaacttgctgtgtgatttcaggctgttaacctacctctctgtacctcacatccctcatctctaaattgggaataagctgccctacagatttcacaggtgtgtttgatcagatgagattattgtgaaagagctttgaaaatgaaaaggtgaaagtgtaggtagtattgttattaatgatttcctgatgaggtgtgaattctctttaaaacttcatttaaattctagacatttttttcttctactaggtaaaggccttgtctttattgctattgtgtgatttattaaaagaaaaaaaagactctgttctaacggtctccatgaacactgctttaaattggcctttcatgttgtatttgtttttgctaacaacactaacgttattaagctattattttcttcaaaggaagggctttttttttatggcatctgttttgagatcctattagtagcaggcttcagattttgttctctctcttcttctatacttgtgaaagaaattctggatttctttccatcaagagttattgcaagaaggctgagtagtaacctgataaagcaacattaaagtcttttaccttttgttttctcagggttgtaatttaattgatgttagcattctctgtggatatgttcatctaca

SEQ ID NO: 42901 - DNA, 1031 bp, Homo sapiens
gtgagtgttaaaaaaataagaaaaaagtgggatttggagttatcttgaagaatgggtatggtttagaaaggagcaagaaaaagaaagttcttggtacattccagaactattgtgaaattgacctggcagaaatagggaattctcattggatgatgatgtggatgaaactggataaataagttttgtttatagtgaagggccttagatggcagagtgaggaatctggaattctatgagaattttttaattgaaacatgatattcaatcaatatttaaaaaaaattaatctgcctacagtgtgtagagtgactttagggcagaaagtaatggatatttgtgtaactattgatgttaaaggtgagttaagttggcagaggaatgaataaaaaggaaagaaatcattaaagagatattttaaggcaaaaaaatggcaggtcttggtgattggatgcctcacagattatgagtggctgagaaatggagatgtcatgggttacttgagaggaaaaactgagctttgatggggaaatgacattaaatcctggaaattggtcaaagagattgagaacagagagagctgaacagaattatgactttgaaattgtagtgttaggtgactacaagatggaacacagaaggtaagctaaaattttcacaataaatggaatttaacggatgaagaaagtaaggcagagtttaagcctcattgattttatgattgaatgattttatgacctcattgattgaatggaggtcaatgtagacggaaagaaagggctgttcctttctctaacagggtattggtctttggaccacccatttgctgcagatgacatctcccaggctcttagcccagttatgaggatgataatgcatggtgcatgttgcccctgcagggtgatctggtagtcagaagttctgcctgtgggaacacacatgagtttctcatggagacttaactgatcgagggaaaacacactgccaatgaggcagctatgagccacggtgatttttctttccgtactgattaa

SEQ ID NO: 42902 - DNA, 1066 bp, Homo sapiens
tgagtcactttggttgtttgaagcttgttttctagtattttccttaggaagggatatggcatcagtatcctctgaattcttgcatgttataacaatgtatgccctttatacttgaaagtcatttttgctaaatataaaattcatgatccacacctttttccttgaatatattaaaaatgttactccattgtcttttggcataaaacaaaatctgatgataatttaattttctttcccttatatgtaatgtgctttttttttttctaattggaagtttttttctttttctttaaagccaagtaattttactagactatgtcctggtttagttctgagctgatatttcaggtataatgtgtgccctttcaatgcgtagtgttttttgtttgtttgtttgtttgttttaatttcagggaaggtttttttgaagtatagcctctgttttctgttcctttggttttcatcttcaggaagaagctctcttttgcttattttcaatatttgtcactttctttttcttagttatttttttgaaaaaatatattttgaggtaattgtagattcacatgaagttgtaagaaataatacagagaaattccatataccagtcatccagttttcctcaatgttgatatcttgcatagctatagcagaacattaaaacaaggaaattgaccaggaaatccaccaaccttatcggatttcaccagttttgcatgtgctcttttgtctttagttctatttacctctgtgcaattttatcacatgtagattcatcttagcaccactacagtcaagatatagagcagttttatcacaaggatcccttgtaatactctataatagccatagcacctccctccctctcatcttccctaacccctggaaaccactaatctgtccctgtctctatctataatgctgttatttcaaacatgtaatataaatagaatcatacagtatatagcctcttgggattggctttttttcactcagactaattccctggaaatgcattcgagttgttgcatgaatcagtagttcattctttcttattgccacgtag

SEQ ID NO: 42903 - DNA, 1963 bp, Homo sapiens
aatcagtgctctctgatcgctaaacatgatgggcttctattagagagattacagtaaaaaataacaatcagctctctgatgatcctgtgaggagggaacgggttgggaggagtagatttggctgaggacaagcccagactttcgtcacagggacagaccaacgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccagtgagtcctcatttcgtctctttggttttttcctttcttttttttttttataaaaaacaaacgaattgttgtaaaaaaaaaaaaaaaaaaaaaaatgtgggagtgggaggggagaggaggagacaccaggcaggaaaggaatgcagtgagtgtgtgagtttcagacctgtctgaaactttctggtttccacttcatggttgctctgattcgctggcttttctcgtttccattttaatggtggtttgtggaccatttgccaggagtttatacctaggcacgggtttctccgtttcaaataccaatccataaagcattgtgtttctaaaggtctgctgttaatttagaccttagccctccgttcagaatgatccatttgcagggctcagagattttggctaaagcacacattgcccaatccttagagtaaacagccaaagccctcaatatactgaccatctgactaagacagaacaagacccagagcatatgctattgatcagggaattgttcagataacggactccaagggtttaggatcatgaaatcctggaatgttaaagccagaagggaggcctttagactctttggtgcaatgctgtctttcaataggcagggaaacagaaaccagaggggcaactcaacttaccccaaagcagacaacagtcggtagcaaagccatgtctttgtactctcatgcaaagggccgttttcacactggtgtttatgaggtttgaaaaacttactgggtcttgggaaaaggtaccgcacaagaattagaacaccaaatggcctttcagtaaatcttttccatttttgagagttttggcaccgattcagcatgacaattgttgttccagttgttccagcgtttgtgcaacagttaatcaaataaacagagaaactcatcagggtcctaaaaacaagacccatgtccattacattagcagatctcttggagagctagtttccgtaagtgtggttggttattcacgtgggagagctcaaagggactttagacgttatctgtatagtccagtgcttatcaaactttttaaaaaatcaaatttaatcttaaggggaacgctattgtataaaggagatgttctggttaaagaaaaggtttgggatctagagctcctcatcctcgctctactctgcagtcatagcccactgcacaattctacccctctcctcatccctcttctaccccacctccccaccctcttcatcaaaacttccttggaatcctaggtctccatggaatagttcagaaaccactgatctcattgaaagccttcatttcagatgaggaaactgaggcacaggaagggcttgcccagggtcacacagctgatcagcaatagagcgtgggatgctaggaaaagagcccagtctggctggctgtctctctctcaactcatggtcctgaggcttgtttccactccttcatgcctatgattctatcagtctcctttctctgtgtctctcttctctgtttactctgccatttcctggatttcaacagctattacctctcaccgggatggttgtcattgcctgccatctggtcctcggcctctgtctctctcccc

SEQ ID NO: 42904 - DNA, 1042 bp, Homo sapiens
gagagaagagtgagcgaaggaggaacttgccaaacacttataaaaaccttgagagaattcactcactgtcacgagcacagcatgagggaaccacccccatgatccagtcagctcccaccacattccttcctcaacacctgacacgggggattacaatgcaagatgagatttgggtggggacacaaagcctaaccctatcaatagggatgtcccatacggagttttatgcctcttgcttgtcttggaagaagaaggccccaagtaacagtcatgacctcatggctgatccagagatgtagaaaagcaaattgagacttcctgtttgattagtttaggaagcagttattaaggattgattctccctgttgcggttaaagctgtctaccaagaaataagccaaaggaacattaggccaagaatctgaagggtgaagccaaaccactgggaagggctttctacttcaactacaatgtgattgaattagaaaggaacattcgaatcctgtcatgtcacctcaaattcaacaagtctaaaattgaactcatttttcctcacgaagcggctccttaactgaactttcctaataacaggaagacactgcagtgtagaatgctttgccacaacatatctatctattatttcatttgattgtcacacacaagaaaatttaactctaaaatttaactttaaatttaactttaaaaggttaatcaaagggctgcaaattagtaagagaccaattctaaaacccaagttttctgaatcctaatctagtcatccattatcaactatatcacattgcccccccatatttgtgaaataaaccagcccattttatagaattactaagtgacattttatttgtattggcttttgaggattgcacatgagcagattttagtaaatatgaagtcagattttctcaagtagcaaagaagaaaccaaccaaccttcggaatcattaatcctgttttttatgagatacctcagtgaaaaaacattcatagcattcttattattgaagtcaaaagatgacacagat

SEQ ID NO: 42905 - DNA, 1034 bp, Homo sapiens
catgggtttgacgttgaattaaaaaaatgataaaagctggggtgggaaagagacatgaagaataatggtcagacatttcatcttaagaaggcaaaaacaggctgggtacagtggctcacacctgtaatcccagcactttgggaggctgaggtgggtggatcacaaggtcaggagatcgagaccatcctggccaacatggtgaaaccccatctctactaaaaatacaaaattagctgggtgtaccggcacatgtctgtaatcccagctactcaggaggctgaggcaggagaatcacttgaacctgggaggcagaggttgcaatgagctgagattgtgccactgcactccactgggcaacagggagagactccatctcaacaacaaaaacaacaacaacaacaaaaaggcaaaaacaaacccctggaaattaactggtaataaagagggggaaaggaactggttggaaactttccttaaaaaaaaaagtcaaaaccctgatttgccaacatgtagacctcagcttaatgtagacttgcagaaagccattaatttagggtagtattgatttatatttgactggtaattaagagcatacatgctgcttctttattatctgggtgacacaaattcatgtggcctgaggaagggtggaaatagtaggggggaaatgtttgtaagctttgagaaagattttttttctgtctgcaagactgcattgaaagcactgtacctaatcaccaccacaccaccaccaccactcctaaaaaaagaaaaaaagagatgctttcacattcacctttccagagcaaattctctgtcactaagcctgcattgcactgaaggtatctttaactcctgcttctgtacaagaggctcatgaacacagctaaaattgagaccatgagcaaagtgcaccaaaccacacacgaggtttgtaaacacacgaggagtgccacatcatgctagatttcagtgagcgcaatggcaggcacacgagaagatgttggggtgggaagaaaatatcccaccttgct

SEQ ID NO: 42906 - DNA, 1032 bp, Homo sapiens
gccccttctgtggataattcagatctcagttctgatctgtaagcctttgctatgcttatttggttctttcccatgccagtgtagttcaggggttttgagacttgtatagatggttcaaagtcctgtttagttctcttaagttttccttgtattggtttgggactatcttgcacatgtgtaattcagggattgagctgagacatttgtgtgtgggtggggggggggttggttaaaatttcagttaagttttcatagtctctgagagtgtgtctgcttgcatagctcagggattaggatgagacttttgtgcactcatacacaggattaggagatacctttctctggttgctttcttcccttcagattccctccacactgtaaggaccccttttcctgggtcttctgttaagaaagactgggtttctgatttggagaaggaattttttttgtttgttttcttgtatgtgtacatattgtcatttcttagtctaggccagaatttctcaacctctacactactgaccaccccaccatgttctcccatgacatcctgtatatgcctgcatggttgcccttgccatatcatatcacctaacccttccttctttctgtctgtactgagaacgccttgatctcagaggctgtcttatcaatgtttgtatctcttccaagcactgggtctggcacatagtaggtaatcactaaataggatattatcattgttagggtggtgtgactaaattattctgctcaagagaaaaagaaaaggctactctcaagcattttggaatcaaacatttataataaaaaataactccaaactttagtaaacagaaaaaaaaaaagactcagtttctatctgagatttagccatttgcaccaccacacttctctgtgcatgaggcctgccattcagcaggccagagcaaacaaggggctggactcaccttcctgtgggggtgcttctctaagtattaactctacagtctgctcttgtttacttttcaaattcttcagatagttatgtttttg

SEQ ID NO: 42907 - DNA, 1024 bp, Homo sapiens
ttgattgaggcacgcaaacatatgttattgccaggtggagatcttatggacactcattggtgaataaaaaaaaattacacatacatactttttataactacacttattgcagtgcctactaggagttcttaaaaactaaattttcttcatatatcatctggcatatagatagatagacatggggagaaaggacgggtggagagagagaaagaacactgatttttgttcatagaggacaaaggtaatttttctcaagaattccaaagttatagggttaaaaatatattaaagaattcatgcttaatagtactaaacagaatcacttccttacacatctcttcaaagctgggtatatatttatcttctgtagtataggacatctctctctctttttctcctttcagtccttctaccatcatccccacctctcctctgctaccaccccctccaacctcatttttcctacagcaccaggtcaggaaataaaaaagtccaacagagaaaacactgccatgctactgaatttaaaccttcccccaagcctttctttttgtactttggttctgtttcctagcctcctcatgacatatctgtgacagagggaatggataaggagcaataaaggaaaatccctactgctcctactgtgacttctgcctaatttctctccagtaacagtgacgagagaatgagagcagaagagacccaaaaggaagaggaaagcaagaccccgtcgggccactgcttctcagtgtcacttccagccgcatgtgctcattccactcaacttggttccacctcacctaactagaaaacccttctgtcacatctttgccacacctttctcttccttaaatttcctagccctcactttcagccgtcattttgccctcagtcacaggagtcaccatcagcagctcagagtggggagagtttctattttccttggttgcttggtaatcccccactgttactgctgaggttctttcagatgtgggcagctgtgtttctggcctcttctatt

SEQ ID NO: 42908 - DNA, 1025 bp, Homo sapiens
tctatatcttttaagtggggaatttaattcacttacatttaaggtttttattaataggtgaggacatactcctatattttgttgttttctggttgttttgtacatccattgatcctttccttctctcttattgtttatcattgtcatttaatggttttctatactgataaggtttaattcttttctctcttttgtgtatctgttctgccagtgagttttatacttttatatgttttaatgatagtgattattatctttttccttccaaatgtagtattccctagattatttcttgtaagaccagtctagtggtgataaattacttcagtttttgcttgtctatgacagactttatttatctgaaggatagctttgctgggtctcatattcttgactggcaattttttttcattctgcactttgaatttatcatcccattctcttctagcctgtaaagtttctgcaaagaaatctgctgttagtctaatgatgattcccttgtgtgtgacttgatgcttttctcttgctgtttgtagaattctttgttcttgacttttgacaatatgactgtaatgtgccttggtgaggacctttttccagttaagtctatttgggaaactttgagtttcctggatctggatctcatatgtctccccggacttgggaagttttcagctattatttcaagaaattggttttctatacctttcccttctcttctccttctctaactcccatgatatgaatatttgtttgcttaatggtgtcccatatgtcttgcaggttttcttcactgtttttcattctttttttttttcctcttactgagtatttcagactacctgtctttaagttcagagattctttcttctgcttaaatctgccatcaaagctctttattgtaatttttatttcattcattgaatgtttcagctgtgatatttcttttttattatatctatttatgttgaatttcttattcacattatgaactgttttcctaatttcactgaattatctgtctg

SEQ ID NO: 42909 - DNA, 1096 bp, Homo sapiens
ccacttgatatagtttggctgtgtccccacccaaatctcacctttaattgtaataatccccacgtgtcaaggcagggtcaggtggagataattgaatcacgggaacagtttccccatactcttctcgtggtactgaacaagtctcaggagatccgatggttttataaataggagttcccctgcataagctgtcttgcgtgccaccatgtaagacatgactttgctcctcctttgccttccgccaagattgcgaggcctccccagccatgtggaactgtgagtcaattaaacctttttcctttataaattacccagcattgggtatgtttttattagcagcgtgagaatagaataatacaccactctattgaacattgtgctagaagttctagccactgcaataaggcaataaaaaaataaaaagcatacaaatcagaaaggaaaaaataaaatgatccctactgtgaaagatgttattctctatgtagaaaatcctaataaatttaccaaaacacacacgcacgcatgcgtgcacacacacacacacacacacacacacacacaacctttagaattaataagttatgctaggcctcagaatacaagataaatgtacaaaattaattgctcttctataaataagcaatgaacatgtgaacaccaaaattacaaaatatctcaaaaaaaatacttggttttacagggtttctatgctgaaaagtatacaacatgaataagagaaattttaaaatatctaaatgagtggaaagatgtagcatgttcataaattgaaagcctcaataaagatgtcagttcttcccagcttaatatacaagtttaacacgatgcctatcaaaatcccagcaagatcttttgtatatatagacaagattattccagaatttatctgccgatgcattaaaatagcaaaaacaattttgacaaacaaggataaaatgggagagatcagtctatctgatttcaagaacttttatatagctagagtaatcaagacagtagtattagaggagaaataaacatacacatcagtggaactgaggcaaaaaccaagaaatagaccacataaatttgctcc

SEQ ID NO: 42910 - DNA, 1030 bp, Homo sapiens
ctctttttctcttttcccattttctatttgattgatttccattgctttattattttcttcctcactatatatatttatttatttattccttttttttttttttttttttttgagatggagtctctccctgttgccacactggagtgcagtggggcgatctcggctcactgcaatctccacctcccggattcaagcgattctcctgcctcagcctcctgaatagctgagattacaggtgcgcaccacaacgcccagctaatttttgtatttttagtagagacagggtttcaccatgttggccaggatggtctcgatctcctgacctcatgatctgcccgcctcagcctcccaaagtgctgagattacaggtgtgaaccaccatgcctggcctcactatatatttaatttgctttgcttttccaagacgaataatttttattcagtttaaaatattttctgattttgcctgtgattttttttttcttgaagccttttggatagttctttctcactcgatctcactctgtctcatgtaccaacttttttctcctgtaaatttttcattcaacaaataattgttgatcatctaccacaaggtgctaggtactgttctaggtacttgagtgacgtgagtgaataaaataatatccctgcccacatggatcatatgtgctactggtggttacaattttttcgtttggtctatatttatccctaaccaagggttctcttccatttgaagtcttgacatactcctttcttcctgtatctccactatgacttctagtacttatttgcaactataaaataccctaacaactgatacagatctcctgtctagtgtatctcctgaatttatagtcatctttttaagagagatggtatttattgggagatgtgttctcctctgtcatatttatgccttgtttggcttgaagtcagaaagactaattttcataagcatctttctagctttagctagctttagcatcactaagatttcctgacattatcaataaaaaaaaaatta

SEQ ID NO: 42911 - DNA, 1050 bp, Homo sapiens
ttttctgtgtacttgttccattgaatattgagagaggagtgttgatatttccaactgtaattgtggatttgtctagctatgttttttttttttttaacagaatttgtttcttatttttgttggcatttagttcacacaaatgttgtgaagcagtgattctcaactgaggtataatgttcttcagagtgtgtttgggaaatgagtggggccagttttgcttgttatgatgactctggtgttgttattgatagttggtaggtagttccaaggatgctaaatgtcctggaatattcaggataatccaacccagtgaagaaacattgtgcccaaatgtcagtaatgtccccactgagaaatactacagttaagttcaacttttctatagtggaaaatgcattcaagttttaagatattatacattatgggtagtaatattgcaaataagattcctggcatgtttcttcatgtcacctaaagtggaatagatatttaaaaaatatattcttgtatgtagtcactttaagacagttgcctgatttcattattattagcatgtacaatacatttacatattaaaactatatctaataaatttaataggtgaaacagctgaggaatcgggcagatgaagatgctcgaatgattcacatgagtatgcagatgggtaatgaaccccccatttcacttagaagggacctggaacacttaatgcttttggtaagccattatattagaaagcttgtcctctttccctcctttcattattttttcccctaactttggaaaatttcaggtgtaatactttaaatgtccttttttttattgaaagtaatttttcagtcatagacatttccctacagtctttgcttactctttgcagattggcgagctatataaaaagaacccttttcatctggagcttgctctagaatattggtgtcccacagagcctcttcagactccgactatcatgggctcttatctaggggtggctcatcagcggccccctcaacgccaggtgagtctttaggttttcctcttttatactct

SEQ ID NO: 42912 - DNA, 1047 bp, Homo sapiens
atttctcactgaattaaaatggaaatgggaggggaggatagggaaaggttggttaacatacaaagttacagatagagaagaagaaagttctagtgttctatagcactacagggtgaatataactagcagtaattcattgtgtatgttcaaaagccagaagagaggattttgaatgttcccaacacaaagaaatgagaaatgttagaggatggatatcctaattaccctgatttgatcattacatattgtatacatatatcaaaatatgactctgtaccctataaatatgtatagttattacatatcaactaaaaatgaaaaaaatgttgtgatacttgatactgtatatctctatatttttttttgagaaaaggacaaggtatttttttcatccatactttatattgcagtataatatattgttccagaaaggatttaagatgcctaggtaagatttatccaacccttgcggaccatttatctctgtttgtattatttctcatacttggaactgcaaaagtaattctacaaagtctatatctcctccagttttttacttcgaataaatgagtgatctgatttgatgtgttggtagacttcaaacataaatgataggcttatttttgttttagtatatattaagcccatgaggactcagtataaatgatagcaatttagatgattgctggtcattttaataacttttaaaaatggaaagtctcattctttttgtgtcaattcttagagtgaaaatgctcgcttggcactctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcaggtagggctctgaagtcccttatttatattatcccaatgtggaaagttgggcttgataataccatagaagcaagaacatgcaattggaacttatagtatatcatgaacatcccaactaga

SEQ ID NO: 42913 - DNA, 1056 bp, Homo sapiens
ttacccttttacgtttccataattatcaaatttaatgtatttttatttgaagggttttctgatcagtgttgaaatagagatgaaacttttaataaaaggaaccaaaatattttgtgtttcagagttggaaaaagatgttacatggcaaccatccaaatggaaaattcttgattttaactcaatttaattagattacttgagtcaacctgaaatgagagttaattattttcttttctctctaattctccctctcttttaaaagaaacattaaagatttctgttttaaattcaagtttggggacagtaagtgggaatttggagttcttccatctgactcatctggattcatataatacttttttatcttttcctctaaatgaaaaacagaaatatctgttatatcttttggtgtgagttagcactattaatatgttaatgtctgcataatactcttcacttcatagctaatagtttttattaccaagttttctttctttttctttggaaggttgaactaaatgaaatagaatcccggtgtgaagaatacccattgactcgggccttttgccagcttattagtactctggtggagagctcatttccttctaatttgggtgctggactgcggccccctggctttgacccttatttgcagttccttagagactctgtgtttctacgattccgtacaagagcttaccggagagcagctgaaaaggttatgttcagagaaaagcttttttctccttatgcatttactgctttttcttttatcaaaagtatatggtgctaaattcatgttagcttttgaaaggtagtaaaattcacagtctttgttttgaaatatctatgaagtggtctgattagtttatgtgcactaaaaaataagtttggtcattaaaacccaagcactgacattagtcatcagtaatctaattgataggagttcatatttcatatccttagtttaacaagttttgactaaaatggaacaaaaagtgtcacatttgttggaaacacactactactgcttattggaatggtttaggttaggga

SEQ ID NO: 42914 - DNA, 1049 bp, Homo sapiens
ggaaggagtattgtaatccattaggcatgtctgccatggatggaggctgagagagcactgatctttatgacacatttgctctggttgcaagacactaaccactgagcttatatatatcattttatataattccaatattaccacgtggcaggtactatttaatattcccattttacagatggaggcttagcaaggttaaggaacttgcctaaggtccaggaccaggatttgaacctaggactctgattccagatccaagctcatagccactaagctatgtaagagactcttccaggttctgatgtaattcacgttagtctataatactgtttattaaccttacagaatacccttggttgtatcttgtaggaatgtttctgctttattttggtagttggcgcagatcaagactccatctgaaaaaaacaagtgtatatatatatgaagaaattatatcatccttaattttgttgccaaaggaaggataactacttttagtctttttcctatgcctgtagacttaattaacaattgagataattagttatattactttgtatttcttttttgtcacttagcatcatggggatttttttcatgtcctaagatattctttgaaaatagtctttttagtgactgcataaaatctgttacttgtatctagcatagtttattcactgccctgtcattggatatagcttgttttttatatttagtcacaaataattgaagttctttttttttgtcaattgcattagaatttttgcttgccaggttgtaaaaataaacactgaggtggggtatacactttacttaggctctagaacttaacatgtatttcctgatgggaagaaaacaataacagcaaccatgcctcattaataaagtcatttcagatgaataatgagtgctgataattacagcactcatttcatcaaaatgttctgatacttttttacagttgttttaaatgtcttatatgctttttcttaaaaaggtcattgtgatctgagtgtttagagcattagttagccatattctctccagat

SEQ ID NO: 42915 - DNA, 1465 bp, Homo sapiens
tctttaagaataatgcattgaaaatattttaccttgaaaatgagccaattcattatcttttagcaaaataaagcaaaatgaattgggatttctatattgcttagcgtaagtgaataaagtggacaagaaacttcactcattttctggaaaaagaagtgggaagagtgaaaagccttgcaaggccaccaccttggtctgttttattgttattgacctatttatatctttctatagtgggaagttgctgaggtggttttggaggtgttttataaattgctcagagattatgagcctcagcttgaagattttgtagaccagtttgtggaactacaaggtaatttaattctgtcactttcaaacaagttgtcaactatttataatttataaattatggctatgttatatataaattaaaaattatacttttaaattagaatttaatcttttgtttcattgttttaatcattttaatttttctgttcaagagaaaaaattattgaatggaagatcaagaacactgcattacaatttctctaatgagttaatagaatagctgactaactgctttgtgcagatttgcccttaggagaattactgctgtgtctctaaattgaaacttgcctttatctatctagatgccatctaatttacaagtctcatacatttcatataaatcaagggtgtgacaaaaatactaacccatcatctcttggaatatgttatgttctatttaggagaagaaatcatagcctataagccacctggatttagtctgatgtatcatctgctgaatgagtcaccaatgttggagcttgctctcagtttactggaagaaggagttaagcagcttgacacctatgccccctttcctggtatatgcttaaaagccttcatgtcttgcaaacagctttgatgttttcatcttttgtaaactgagaatttgaaatagatgatctctgaagtcatttttcactgtaagattctctctctgtatctgaagtggtgttttcagtgaatcatttaaatgagagtattgtaagtaaaaacagactaaagtacagagagaatctcactgtcactgtgtttcactgcagggtcttttgtaggtaaagtgatctttctatcattttaacatctttaacatccctaactttaaagtacttttttgtccatcccccacctcataatatttttaaaaggacttactatagtgcttgatacatagtggtcaataaattttacttgttattattaccactaattattatttattgaatgcttactatgtatttggctcttttaaaagcacattgcatatattaatgcattcaatctattcaaaaatgtgttagatcttcttatttccatttaacaaataaagaagctgaaatacaacgaagttatactggctttccctatcaagtgtgggagctgggatttgaacctagtcatcttggctccagag

SEQ ID NO: 42916 - DNA, 1334 bp, Homo sapiens
atgtggctgtgatcaaaatgagaaaagagattctaaacatatgaacaataactgtatagtcagaatatacagataagacactataggaagaattaggccacaattttaaatttgattggtaagattataggtgatccttgtttctattttctgcgttattttccacagtgatttggtcttactttagatcagagtttctcaattttggcaccattgacagtttgagctgaataattctttgttgtggatgatgtcctgtgtattgtaagctggatgccagtagcacatttccagttaggacaactagaagtgtctccagacattgtcaaatgtgccctggggctcagccaccccattctgagaactgttgctctaaacaataagggaaaagataaagaagtgatttgagaatccattccatgggagttttctggattgcaaaataacgatgacttgcatagatgaatggttttgtgaagttggagctgaaattttgaaacaatgagagcataaatctctaggttttgctgctgaaagttggaaacaagagtctgaatctctagatctgaaaatctaaaacttgtcatttgtcttgttttcctaagaattgactgtgagtttttaagataaatttagaactttctaactttatttttggttgatagggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccaggtaagttacctttgtaggtagagaaatgaagtaaacagatagacattctagctttgattttcaaatctggttaggtatctagtgcatcacctttttttttatttttgcctcattttactttttttttttttttttttttgagatggagtctcgctctgtcgtccaggctagagtgcagtggtatgatctcagctcactgcaagctctgcctcctggattcaagcgattctcctgcctcagcctcctgagtagctgggattacaggtgagtgccaccatgctcagctatttttgtgtttttggtagagacggggtttcaccatgttggtgaggctggtcttgaactcctgacctcatgatctgcccgcctcagcctcccaaagtgctgggattataggcgtgaaccaccgcgcccagccttattttactgttgccttctttagctaccctgattttaattactctgaactttacaatttc

SEQ ID NO: 42917 - DNA, 1024 bp, Homo sapiens
ttattagggcctccttaatgacctcgtctgaactcgattgactatatgtacaaagaccctactttcagataaggtcactgggttagccagacttcacataaggattttgggggcagggatatgattcaacccctaacagactgcatctatttagaaggggacagctttttcttatttaccttgaagtgctgtatgggcaggggaagccctggttctaaattttctttattgagaatagtgagacaccaaaaattttatcactgttcctcaaatgttttcttttctttaaagatacctatatcatggcaatactaatccagaattggcttttgaaagtgccaagatcctctgttgtatctcttgcaactctaatattcagataaagttggttggagatttcacacatgaccaggtaactgattttgttgctcttgttattttttggtgcattttgcattttgactatatatggaagttctagtgtctatggaggaatcatattcttggttgtggaaaaattcattaagagtaagtatatttgtataggatgggtgaaaacctacccacgaacttggctatgacttatctttgaagataatgctattcacagtgatactgcataattatggtatgtggcacactgctactctgggtacatgaccactgctactctcagcacgttcaaaatgattaggtttgctgttaacttgtttgtttactgctcccgacctgtcagttgcctgtgttctaagtgagccctctgcaagttctgaatatttcgttgttgtaagttgtctacttcactggttttcttgtgatccacctgtgtgtcacttcatttgatgacactgtagagtgtttttaggagttcctctttttattcaagttataatagttctgttcactgaatacctacaattgcggaatctgcttttttttttctttatgaacatttcatcccattgtatctttatgttggaaatcactgctttagctagttgaagaatttttttttttcttcttt

SEQ ID NO: 42918 - DNA, 1050 bp, Homo sapiens
gtagctgggactacaggcgtgcccaccatgcccagctaatttttgtatttttagtagagacagggtttcatcatgttggccaggatggtctcaatctcttgactttgtgatccacctgcctcggtctcccaaagtgctgggattataggcatgagccaccgcgcctggccagaaagcactttttaataaccaaataaattaagaagtcctgtatacaactatgttaagtggtagaatgtcagattaacatttaaactataatgagggctgggcctgggcatggtggctcacgcccataaccccagcactttgggaggctgaggtggtctggatcacttgaggccaggagttggagaccagccggggaaacatggcaaaaccttgtctctgctgaaaatacaaaaattagctgggcgtggtggcacgtgcctgtaatcccagctacttgggaggctggggcatgagaattgcttgaacccaggaggtagaggttgcagtgagccaagatcatgccactgcactccagctgggtggcaaagtgagactctgtctcaaaaaaaataaaaataaatacataagtaaactataatgataatttataatttcgcttgttcacttttgtttattgttttattcattttataagtgttttaaaaactaggcttggccgcgtgcagtgactcacgcctttaatcccagcactttgggaggctaaggtgagcagatcacctgaggttaggagttagagaccagcctggccaacatggtggaaccccatctctactaaaaatacaaaaaaaattagctgggcctggttgtggacgcctgtaatcctagctcctcaggaggctgaggcaggagaattgcttctacccgggaggcagaggttgcagtgaacctagatcgtgccactgtactccagcctgggcaacaagagcaaaactccgtctcaaaaaaaaaaaaaaaaaaaagaaccaggctttataagctgtgactaatttctcaatttaagtgttaccctaaatttacatttttaggataagaaatggt

SEQ ID NO: 42919 - DNA, 1111 bp, Homo sapiens
tgtctcggattcctgacaagtgctccacctgcctctgcctccctaagtgttgggatacaggggtgagccactgtgcccaacctagttattatttttctgtgttttctgtaatgagcattataaaacttcacagtgagaaaaaacagctgttaaaaaaatttcttttctctaacaagcaatgttagagtctactaaaatacatctaatgccactagtttaacgtgttaggttttgttttggaaatacatctttacctgagagctttcctttattgataaattgaggttctggagccatagtttttaacttctcaaaaaaaaataaaaaggaaattttgttgcaagtaacattctctttatgaaaaacattcttcatatttcatatctgatgtcagataaattcagttactgttgttgattttggtagcatctacatgttttggactttaatttattcttccttcagatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggtaaggctttctagacatttgatgttagatcaagaagtcgttttctcttggctatagatgtattaaagaaaattaatgtggcatacattctgaatatttctatcataagctggaatccttttttaaggagttttaaactttggaatcttcctagtgtgcaaaagatgagtgaaatgatcctcaaagggatagctggataatgggactgctgcttccctcactcactcaggttgctcatgatggcaatatgacagccagtgctccgtgaggacagagcaaaattgtcctctcacaatacaatttagactatagtagttgcctattgaaaatttccatgtagatatgctagttctattctaaacacagcattttcaatatagtatataattcattgtttctttgcctgcaaatctgttttaatttctttttcctcctagttaaaaggatcacaaat

SEQ ID NO: 42920 - DNA, 1057 bp, Homo sapiens
cagctacttagttttagttgtatatttacatggattcactgcaaaacaccagttgtgttccccaccatggcgtcaccattcacgagttctttcttttgatttatctcttggtatttttttttttctttctttctttctttctttttttttttgagacggagtcttgctctgtcgcccaggctagagtgcagtggcgcgatctcggctcactgcaagctccgcctccccgattcacgccattctcctgcctcagcctcccgagcagctgggactacaggcgcccgccaccacgcctggctaattttttgtatttttagtagagacggggtttcaccgtgttagccaggtcttgatctcctgaccttgtaatctgcccgcctcggcctcccaaagtgctgggattgcaggcttgagccaccgcgcccggcctatctcttggtatttttaatttgtactgaggttccttccctcaagaaaaagcatgctgtctcatattcctgaaattctctaagaatgtctgaaggttgtctttgttctttaatgacaggacggccgattatgattttcttttgcttagaatatgtaatataaatgatagtagctggcatttattaagcatgtatgtgccaggtactgttttaaatacttgacatgttaattgattggaagacacagcagtcttatgaggtagaactgtcattatccacattttacagctgaggaggctgaggcacagggaggttaacttgtccaaagtcacacagataacactgcatagtatagagtttcccaggcagtacgtcttttgaatctatatatgtaactacgaggctacactacctccatttttatgttgctttggagatgtctgaggcaacctctgaatccaccctataatccccaataattttttttgtctgggctgtctcggtggctgagccctctgggttgagagacgttgagagttggccagggctgagtacagtgccagctgagttacttggagcctgtgcttcttccaaggagatcccagggtctattccacccagcctgtggt

SEQ ID NO: 42921 - DNA, 1077 bp, Homo sapiens
gcaggagaattgcttgaacccaagaggcagaggttgtagtgagccaagatcacgccactgcattccagcctgggcaacagagggagactccatctgaaaaaaaaaaaaaaaaaagaatacacagatgtgagtcattttacaaattgattgataaccttttcttcttcaaatctcgattttcatgctaattgagacatttcagggtcttaacatttttgttactgttttttgattatagatttgtgccaatgtaatggaatattgccagtcactcatgttacagagttcccctaccttccagcatgctgtgtgtctcttcactcctagcctttcagaaacagttaatagagatggaccgcggcaaggtgagcttagtttttcattctgtattgaaggaactaagttgctatggttatgacatagctctccagcttggctccagtaagatgcagtattttcttttaagtgtcattaatgggaaacattttaaataagttttaaagttgagcgggaggtattattattagacctatgtacaagactggagagaatagagaaattcaggatttactgagagtaaatctagaggaaccatgttttgaatagcacttgagggctcaaaggatctaaattggggagtcaggtggctgggtggaaaagatgaaaatacaacaaacagttttatatgttaaatcatgttaagctgaattcagtgtctaaactgggttttttattatagctccaaatttctataacataacgaaatacaatttagatactaattaggccaacttaccctataattctttaatgattcagtagggaatgtttgaatatggggcaggataatgggtaaagctgttatcctatggaacactcagaagaaaaagcccattagtatcttggtggggataatggaattgactgttggtgatttcaggaagtctttgtttgagatctgtgagaaaaattttgtcacattttcatcttcttcaagatcttactatccctgaaaattacttaatcacaaaaaatatgtgtttagtataataatagtataaaatgacattatgaaaa

SEQ ID NO: 42922 - DNA, 1044 bp, Homo sapiens
catagagatattattctgaatgccagattaaaggcatagtctgaaaattctaattttttcaccctttgtagctacattacactattaacaatattcagggttactaaaatatagccatgctcttatagaatagtgtactcaatactgtgaaaatgtctgaaaaagtcaagctttttcctaaaattatttaggttttccttttttttgtttttttcttttctgcacgtaagttgacaatacaattgtcccttggtatctggtgattactggttctagggctcccacggataccaaaacctatgttttggcatgcatgttccttatataaaatggcattgtgtttgcatataatatagatacatcttcttgtatactttaaatcatttctagattacttacaatacctaatataatatgaattctatataaatagtggttaatactacgtttttaaatttgtattattttttgctgttacactggttttttcccccccaaatatttgtgatctgtggttggttgaatctgcagattttgaacgtggggatatggagagctgactctacagtaatttgtgtttgttccttagaaatgattgtgaaatttctcaaattaatcatctgccaatatttctcatataattaatatgatggctatcactaggacaaaacatttacatgatcaccactctatttcttacccagttgttttcatgttcaagtaactacatcatccgaaactgcaaatttccttttccagacagcaattacttcagcctaatacataggagagactgctgagaggaagtctttgctttcatttagtaacagaataaacgctataacactatagaataaaattgataattattctatagtgtcatagtgtttttttgttttgttttgttttttgttttgtttttgagaaagagtcttgctctgtcaccaggctggagtacagtggcatgatctcgattcagcacaacctctgccttccaggttcaagcgattcttctgcctcagcctcccgagtagctgggactcc

SEQ ID NO: 42923 - DNA, 1102 bp, Homo sapiens
tctattacacaaaggttaaataggtagttgggatggagaactgtgtgagccttggggtaaaatggtaggaaatgatggggagtacaagcaggggggcagactcttcttagctatagcaatttgtcatgtgagtgcagggcaagtattgaaggatcttttatttatttaatgcaaattctgaatctggatttttgaacaaaatttttctagtattagatattgtcaactaattaaaaatgtgtgaatatttatacacataaatatatatacacacacacaattaatttatgggcccatgctataggccaaacaataggtttgttgaggccaaatatgttatatttcatacactttttagatttcaaaaactggagattttcaaactttaacaccactaaactttaacacctaaaaaaaatttagatttttaggcccctccctcctgaaaatctgattctacctaatctggcgtagttgcagaatgctagggtataatacagttacactctagaattgtttctttaatgcaagcagtattctaaaactgtttcagatctagtttccctttctataaaatacttttcatgctctctttgtcatcctaaatgaatttcatggggaaaaaaaatcctaacacatttttcttacaaaagtaaacataatgtttgaactgttttaaaggagaaataaaatgaagcaaataacagcagaaaagtataatttataaatgctcagatacaattacactggccaccaagctcccattgagaacatttgttttaaaacttcggtttaactgtccttttttctcaggctacatgttggaaggaatgagggtgaatgaccacaagttaaaattggatgactccttcagtcttgactgtcattttcttagtatgcagttatatctaggagagaggcaaaactttaggaaatggattttcttttacgtatgttaagaaaacaaactgatcttagagaaatgttataatattgtgtagtattttgtgttgttaacgtactgttcagctaatgagtagcaaactgggagtttgagagcagttttttcctctctacctaaaagacaatattgaagagctat

SEQ ID NO: 42924 - DNA, 1048 bp, Homo sapiens
cctcccaaagtgctgggattacaggtgtgagctgccgagccctttcttaattttactccagcattttgaatacacacttagaccagtagtctccaaaatggcatgactaagtgccattatattttattctgtaatgtggtgtggcacaccacatatgcaataaaatatccattcaggtgagggaagacattagaacttcttttcagaaattgagctttaaagtacttgatatatagtttgtcacagtcacatgaataagcatgtcaaatggctacatttcacatatgctgtatggagtatcctgagagaagggattaaggctgcctcaagcccaaatggtatttgtgtgagttagaaattaagagtcctcttgacatacaggaccaaaggatgtgtgccttaggaagtggaatgtggacccccatttgcctgtaagtctacatttcccctccagtcaggcagttccttgtactgtataacctatcttaactgtacacagctgccctagaggtcatgggatttcgatactgcagactctgttgtttgtttttgcctcctacaagtataattttttttttttttttttttttttttgagatggagtctctctctgtcaccaggctggagtgcagtggtgtgatcttggctcactgcaacctctgcctcctgggttcaggcgatcctcctgcctcagcctcccaagtagctgggagcataggcgtgtgccaccacacccagctagtttttgtgtttttagtagagacagggtttcactatgttggtcaggatggtctcaatctcttgatctgcccacctcggcctcccaaagtgctgggattacagatgcgagccatcgcgcccagtctttgtaacataattttatatgtacttgtaaaaataggtttatgggttttaatatctgtttttaactaaatgtctgtcaaaaaatagaagattatggtaggccattaccaggcctctggcataaaacccttaatctcatttcctagggaagtcccatatggaggctgctcacaaaagcccctta

SEQ ID NO: 42925 - DNA, 1045 bp, Homo sapiens
tggaataaactatggtatattactgtgccgatgtaaaaaaggaatgaaaaagatatgaatactgctgtggagtgaattccatgatgtactgttaagtagaaatcaaggtgcagaagaatgagtattatatgctaccctttgtgtctctgtgtgtgtgtgtgtttcttagctctatccactaaaaggatctaaagcaacagtatctccatgacaataagaaaaagagaaaatatgtgcttatatttacaaataaacaacggaggccaggcatggtggctcacacctgtaatcccacactttgggaggctgaggcaggagaactgcttgaacccaggaggcagaggttgcagtgagcggagatcaggccactgcactccagcctgggagacaaacagagactccacctcaaaaaacaaacaacagaagaataaataattaaaaatgactgctagcgaggcaagaaaaagttgggaaggaattagagaagaaaattagacctctgtaaatgtaactggttcacagtattgactttggaactatgtaaatgttttatgaaactgaacaaatataagtaactctccctgcttccccagcaaacaaaacaaatgaacgttgttctgtatcaaccagatagttttacctacatagtaaaggatttttgaaactgatttttaaatcacaatattgattgtgcattcctagtatgctatattgtaagcacaaaaaaacttatattgcattcagtggtgtgtttttagtggttatgttggtattttgaaactattcaggtttcatgtgaggtaaagcaagcagatacttgtggtaatatcattaggcatagaaattctcaggataatgatgaaggaaagctccaggatggcagcttgcagcaggcttgaaaaggtttggagctggatgaaggacttcatatttcagagaaggatacatttgagggcacaaatgtaaaactgtttgattagctgatatatttgaacatattgaaaagggtttgcagttctgtcggaaagtttgctgctgatttagt

SEQ ID NO: 42926 - DNA, 1782 bp, Homo sapiens
gtttgaattttctaaatgcaacttcatcattctgcaagtcaacaaagactcactgcaaacacataacccttgagaccatcagatgcaatttttgttccttggttttggtgattagtgtctttctgatatttcttggacatagcaggagctttcacatcataccaatctttctaagaaaatggatcaactacctttttggctccctttgctgcctttcataaggtgcttgttcttgacaactgctatcgtgctgctcctctttccttctgtccttgggagtttgcctattctagaacctcataaaaatagaattatgcaatatttgtccttttctggtctgacttatttcctttagcatagtattttcaagttttatccatagcatagcacatatcagacatcacttcttatgggtgaataatactccattgtaagggtatagcacattttatttacacattgatcttttagtggatatttaggctgcccactctttagctcttacgaataatactgctacgaacattggtgtccaaatatctgttagtccctgttcttcagttctttttgggtgtataggagtagaatggctgttagctttttggtgaactacaaaactgttaccacagcagctccaccattttgcatcgtgtcagcagtgcacaagagttatagcttctccacatcctggacaacatgtatttttccttttatttatttaattttttggatgagagccatccctagtgggtgtgaagtggtaatctcattgtggttttgatttgcatttcccaaatgatgttgaaaatcatttcatgtgcttgttggttgctgttttttttttgatcttctttggagaaatgtcagataggcacagtggctgaacacttataatcccagctatttgggagtctgtggtggcagggtcacttgagcccaggagttcgagaccagactgagcaacaaagggagaccctgtctctacaacaatgtaagtaaaaaaatttagccaggcatggtggtacatgactgtagtcccagctactcaggaggctgaggcaagaggaacacttgagcctaggaggtggaggctgcagtgagctgtgattgttatcactgtcctctagcctgggcaacaggataatactctgtctccaaaaaaaaaaaaaaaaaaaaaaaaagggaaagaaaataaatgtctattcaagttctttacctatttttgaatttttgttgtaaaagtttatatatcctggatactaagcacttacaagatacatgatgtgcaaatatattctcccattctgtcggttgtcttttttaccgtcttgataatgtcctttgatgtactgtagttttaattttggtgaaggggacatcctgcaaagtagcagagtaggaatttctaggagttaatccttacattgaaacaaccagtaaactggaaaaaatgaccagaatcaacttgcagtctgtggtgccaggggagtgcttgatgaagggagaggctactgctcttgcagaatagtttggggaaagtctcaaatggactgtgccagccatcaacaagcaaaaataagccatcccttagacgttggaaaattatagttgtaaagttaccgcagtaacaagatctgagtttatcctgcttggagcttattgagcatcttacatgcatggattcatgttcttcatcaaatttaggaagtttttaggtattaattattccatatgttttttgcctctttctcttctaggacttgttcaatggtgttccacagg

SEQ ID NO: 42927 - DNA, 1023 bp, Homo sapiens
gcaaataggttttgtttggccagcactatgctggcctgtactggggtttgtcacttttgacactattgatgttttgggctaggtaattctttattgttgaggactgatctgtgcattatatggtggtcagcatccttgacctctaccaactagttaccagtagcaaccctctaaccctccccagttgtgacaacaaaatgtggctccagacattggcaacgtcctatggagcaaaatcatcctgagttgagaacactggccaacacactgttttaaaatatatagaactagttgccagcattgtaaaatggggagattttacattttttaaatatctagatttctggcttttttgagaaaacggaagctgttctagccctgggtctgtatacttcatgtcaacatttgaggcatgccttttccagttcattatagttcctagcaaagctcacttttaaatctgatctcaacagtcattcaaaggtcagcaacagatgatttagacagtaagattcggattgatacaaatataattgcttatgatggtctaggctcccgataatggcagactagataatttggatcaacagtgagaatgactagaaaacctgcacaaaatacagaaattgtctatatgaaatgctagagcaaatagtaaagcattattggacaggattgggttggagttggggctaagaatggtgggggcctttttctccccttgaggtatttgcccagagattgaggagtaattttgataggctcacagggctgagaaatcacagcttagagtgcaaggatcatgcatggtgaatgtgtctccttgtcttgagttgggaccctgaaagtctgcactattatagtaaagataaattagctagtaagttgttcctcacagggactaaagctcagcaactaaaattggattaaagtgaaatcatatcgctggctcctcaagtttccttgtagaatcaaatgtaaatccttgctagaaagaaaaagaaaacatctaggcctccaact

SEQ ID NO: 42928 - DNA, 1068 bp, Homo sapiens
atccaggcccgcccaggcatgtctcatgactttcactgagctgcttagataaaacaatgcttgaagttactagttatagaaaacaagaatctataaactcataagtttactcataccataggagaaagaaaaataaagaaaatttgtttttttcttctccccatgttgggggagtgctgggagagtcttcagagcacattcctttgagccctagcttcttagataatattatcaagactttcctgggtctgggctgtgcctgtttctgcctctgggataagtcagcctaatacatgaaagcttgtttttcaaacttgcttttctctttttaattttatttttctttttttttctttaatttcccacctcaagagaagtatgtggttgataaaacatagttatttggctgctaattttgcaaagaatgggttaagtagcaaactactatttttgtctttttctatttaggtgtatgaatactgtagcagttaagaatactaagaaaagagtgtcacatatacacttttctagctttcggttgcaattaatatagtagaacatgttcagaatcatcatggtttataaatcctttttggtccacccccacccccccccccatccttttaggtagagcattgattttcctgggtgttctcataatttttccaaaccatattttcttaaaatgtactcattctcttctaattttatatatatttttaagattcaagacttaattttaagattgagtggtgatatctttcagaagaattatatttctgctgtctcatcttcaagacagtcaatttaaagtgaaggactcagaaatagagcttctaagggctgaaaacattttggtctaatttagacattaaaacgtcaattttaaatattatacaaaaaaactgccttatgtttttccccgttttaattttcagaattattgaagtaaatcaaaatcaaaagcaggtggaacaggatattaaagttgctatatttacactgatggtagaaataaataaaaaaggaaaagctctactgcatcagttagaggtaagtgactgccca

SEQ ID NO: 42929 - DNA, 1049 bp, Homo sapiens
gtataagtaacttattgccacacctgactctaccaccacacattcatctgaactctgaacccatcacaagatataaatccaaacaagtggtcatatgtgctatgtacttatatcacaataggtaaatacacccacatatagacataagtacatttaagaattatatttaaaactgtacacacataaatggatatagtttcagataaatctagtttagccaaaacaaaaacaggatctcctagtctaatagtttgtgaaaccgacataatgaagttaatatattttactgtaggatttcttagagctgtcatttacagcactgtaaattcatatacaatgagatttgcattgtaaatctctaaagaaggagacaagtttcctaaacttgttacccatggcttctgagaaacatataaaagcgctaggggaaaatattgatctagatgaatattttgttactgtcttgagtgactttagataagttttacaacctctctaaaccttagatcccttatgtgtaaaagagaatgttattgtttcttctaaacatacacatataccttcttgtcatagtgaattacacacagtaaacatttaatgaataactgtatatttttagaatgcatatgattggtaaatcataaacatttaagtttctactgttgaaatcaagcttgattcaggcctttcaagggcaccgttaaactcttaaaactagttttaagccagtcaatgtattctgtatcaaaaagttaacatagtatgcattgtaaaggtataggaaacttgagagatcacaacttgttaatagtaaagattcagaaatactttttgggattgtttttagagccaatgttaggttcgcttgttttgatatatgacagcagttctcaaagtatagtctggtactctttcaggggaccacaaaggccacccttttccagctacacgtctggatgagtgttgtgccagacctctgttgacttcagtagggataggaccatgtttgagaggcccaagaagagacctggagccagtgaatgagacac

SEQ ID NO: 42930 - DNA, 1050 bp, Homo sapiens
cattaagtgtcatttttttggttgtcaatatgtaaacattagtctggatgaaggtggcaaaagacttctatgactacctttattctcccttaaggaccattttgggctaagaaaaattatcccttagataaatttaaaagcttttccatgtaatttcctaagtatgttctgcttgtatttctatgatataaaacccttcaattcataaaattttcatagaaaaataaaaacattgctatggcttttaggtttatacttttttaaagtttcgagattttcttatttttctctaatattatttttctactctttacctacagaatttcacttgcttagaatcagcttctaaatgtatttttcactgggtctgtaattgctggccactcttgaaagttaatgagaggtaaacccagtgccaactaatttttaagagagaagcagttgacccaggtgaggatagtaaattccaaaaataggaagaataaaaataataaagaggataggactgtactttatagctgtctgccttcacagtgtcaaagtttcaggtgttgctgcttcaaccttaaaagattatttatttgtcccctgtgaatgtagggggaaataggctcctctttgagaagttgtgatcatacagttaagatatactaaaaagaatatttattttgcaatacattcccaactgtagagaatcagtcaagaggagactggcatataaggttacctttttcttctaggactggtctcaatttccagggctagtatttatgagcccacagagcaggcttgctttctagcctttgccttgttgcaggaatcagaggaccagagagaccaatggatggaacaggaggattttatttaagtggccactggcccaacagattcacatccaaaggctaggtcccaaacaaagacagggcttgacttttatacacacttctgaaagggtgttggctaatttaaatggcacaaaactcgtggtacaggcaaggaggcttacagaggcagaacaaaggcagtttgaatcaaacagtgacagatttt

SEQ ID NO: 42931 - DNA, 1025 bp, Homo sapiens
tatctgaaatcattttccatttgaggaatttcctttaatatttcctttagtggtgatgaattctctcagtttttgtctaaacatatttttatttgactatggttttttaaaggatttttttctcagtgtagagttctaggtaggtaattatttttgcttagcattttgaagatgttgctttattgcttcctaggtccttgtctctactgagatgttagccatcagtctaattgttgctcctatgaagattttttttctgatcatgtttaagatttatacattggtttttgttattagcacttttcctataatattcccagatatggttttctttgtattacactacatcaggttcatagtgcttgctcgaggtcttttctttttttaattaaaagaatccttggtcattgttacttcaaattttgcttctgctctatactctcttctttccttctaggctcccagtaatatgtatgtatgtatgtatgtagaccttttgtttgtatcgcatgtaaacactttgtcacattttctgtatatttccacagaaatttattttactaatcatcattcttcagctgtgtctaaccagctattccatttatctatttcgttcttaatttcagttattgtatttatttttagaatttacattttattactttttaaatttctaatttccagttaaaatttcctaatttttaatttaatttcttaaatatattgataataagttatttttaaagtccatgtctagtaattccaatagtgtatctctggacagctgtttcctggttttcagtcaaatgttcttatctcctggtttgcttggcaatattgtgtttaatgctggctattgtatattaaaatatagagagataattcgagtctctggatgcttttgtcttcttccagagaggatttagaatttacttttacttctggcaggcacatagaaaaggggcaaatcaactgatacctgtcagagattgcaacaatttaaagctggtctatttccattttac

SEQ ID NO: 42932 - DNA, 1028 bp, Homo sapiens
gatgcagaacagctgctctcaattcagatacctgggagcactgggcaaatcatctaatactactgagattcttcatccagaagtggcaataataataactatgctttttccttctgatttctctattcctttttgtagtaccaattcttccagtaaaccacagctgttttagactccccttctctttatctccaatctctattcagttactaaatcctattctcttcttgttggcagtatcttatatttactccatttcttatctaattcaggcttccatcacagatacagttttatttggatagttactactatgagtttctgcatctaatcttttaacttcaaatttagtttctaaattgaaacccgattaatttttctggataattatgggttacataatagtctggaatttaagcttggagaaagataaagacttgagaatagatttaggagttattgtaagagtcttgacagattaatatggaaggttttcaatcgctgaagtgaaataaatattgtagaatggattaaaaatagaaaaatatggttccaaaacagcatctgtatttatgggacaggaagaaggagtatcaacaaatgaaacaagaaagggcaaacaagaagaagcatctagataatgtaatgtcatttacaactgcacattttagtcacctgggaggcttttgaaattaatgatgcatgggccccatccccagggaatcttatttaatggttggtctggagcccagctatcagtattttttttaaagcatcccaggtggatacaatatacagctaaggtaaagaaccactatataaatatatgactgaaaggaacatatgaaatagggataattcttagagagtgggattagaaagagaagtaacaatatggaaatttttctttcataatactttatttttttccagtgaacacatattacttttattttttttttaaacctgaaaaatatcagggcaatataagtggttgttaaaaaacatcaacttttgaagttagattt

SEQ ID NO: 42933 - DNA, 1051 bp, Homo sapiens
gattagagcataggaaaagagacacagccttagattctattcaaaatagtcagtgtagaggccaggcacagtggcttatgcctgtaatcccagcactttgggaggccaaggcaggtggatcacctgaggtcgggagttcaagaccagcctgaccaacatgaagaaaccttgtctctactaaaaatacaaaattagccaggcgtggtggcgcatgcctgttatcccagctactagggaggctgagacaggagaatcgcttgaaccccagaggtggaggttgtggtgagccgagattgcaccattgcactccagcctgggcaacaagagcgaaactccgtctcaaaaaaaaaaaaaagaaaaagaaaaaagaaaatagtcagtgtaggccaggtgcagtggttcacacctgtaatctcagcactttggaaggccaaggtgggaggatcactttgagccccaggaatctgagaccagtctcaaaaaataagtaaataaataagaaaatattcagtgtagagagatatctcaagaaacaaagagtcgctctgtttaaagtctcaagggttaagaatgtggcccgttgcggtggctcacacctgtaatagcagcactttgggaggccgaggctggtggatcacctgaggtccggagttcaagaccagcctggccagcatggtgaaaccctgtatctactaaaaatacaaaaattagctgggcatggtggtgggcacctgtaatcccagctacccaggaggctgaggcaggaaaatcacttgaacccgggaggcagaggttacagtgagccgagattgcaccattgcactccacctgggcaacaagagcaaaactctgtctcaaaaaaaaaaaaaaaaaaaaaagtcgctgggcacggtggctcacgcctgtaatcccagcactttgggaggccaaggagggtggatcacgaggtcaggagattgagaccatcctggctaacacggtgaaaccccgtctctactaaaaatagaaaaaattagccgggcatggtggcgggcacctgtagtcccagcta

SEQ ID NO: 42934 - DNA, 1047 bp, Homo sapiens
tttttaaataataataaatggaaaagtcttgattttatcaattttataaaaaattggggagttatttctggaattaaaaattcatttttattttcatttgcttcattttctttgaacttaagattaaatctttcttcatcctttgtcatctctacagtctgtcagttctattttgttcccagagatcttcctgtatttcattattgattgcaaaagaacccctatactgtctaacaaataattggtttgtcagcatgaaggctacttggcaaagtatgagtttctgaagactaactactccctcctggttttcttcctctcccaaatggctttatgatttggagactgaagtgttcctgccttcatatctgatcttttttttttttttttctgtcttactggtttgactgaagaaaagattaataattgaataaggtcatttctaccctttggcgaaagtaaggttctttttgttttaacatagcgtctcaataaagtcttaccagctatcttgtggcctctagaacctgtctatagctctccaacactgaaaacagagttcctatctatgcctgtaaagcattcaccttctgtctgaaaggcatctgtgggtgtctgctcatttgcagagtgaaaatgacaggtcctttaacaaatggcaaaagttaaactccttctgggttcaggttgttagctctgcttgctttctgtttaataactttccacacaggggtttcctcctctttcttacccttcaacttactgattttctgtgaatcctgtctttgccactttataattccaaacatcattcattcattaagcaaatgtttattgagtgtttactatgtgccaggcactcttctaggtgctggggatatagggatgaacagcatactcacacatatagtctaggtaggaagacaaggaaaaatacaagttttttcaaaatgtggtaaatgctgtgaaaaaattgtaggataatatgataaaagtgattgctgctaacgtaaaaaaggttaagaaggtttgaggaggtaatgtttg

SEQ ID NO: 42935 - DNA, 1038 bp, Homo sapiens
ggttgaaaacaacttattggacatgatttttaacccaggatatttttttcccaaagcagatctaaattgtttactacccagggttggaaagggcaggcacctctaatctagtctttgtcctctggttgccctctcccacacccctttccacctatacttggttcaagacattttctgaaacgaaaattctgctgttgttcaaactgccattggttatgagaactctgcgtcctttgggatcatctcttagaactccagtgatctatcatatttgctgctacatttgtaaaatgaactttgcctgtattggttgactttaatttacagttctttatttctaggatgttttgtcctctagtttgactcatgtatagaattaggatactttattttaggagtgtaccgtaaaagcacactggtccctttgttgtttttattatttaggtttggaatttgtttgctttttttttgtttgttttttgttttgtttctgtttttgtttttttttaaagttggaaatagaagaatgagaaaaatctataatcaggccaaacttgagaactttcctgtgcttcagcactgtaattctgctgacctaatgttctcaaaagaggcacttttactttctattgtgcatgtatgattgttgttttttgcttttgagggggcttttgtgtttgtaataatgaagcagaagaaaagtgcagtagtagataaatgatcacaacatgttatgcaattttattttataaaattttaaggggaaaagtttaactctttgtaaatcatttcttagctctggtaaaatgcttatattactcctctaaaacatgctcaattcaggcctttgtctttgttaagtgccttttttctttcttttttcctctcttttgaaactgttgtcacattatcttaaagtacagactgataagtcaggggattcaggaggaagaatctcacacttgtcaacatcatgtcatgctgtgtaaccctcttcctttgctttctatgtatatggatatatgtgtaagatacata

SEQ ID NO: 42936 - DNA, 1382 bp, Homo sapiens
ctcaaacttaaaagaagaaaatagatctccagctggtgaaaattttgtgccccaaataatatattaatccaagtctaccaaggtaactaagtaatggatgttttctctcttttattacaagcaagaaagttcatttgcagttgtaaaaatgattaccgaactccagacctatttgctataactgattggaaataatgattctgatttttagtctgggtaaacacatacttcggtgtgaattttgataagggaaagacttgtttggtagcccaaggaaaaacaggatgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttttttgtattttagtaaaaaaaaaaaaaaataaatttaaataaaagggggtggtgatgacatgtgaatgggtgcgggtatgtgtgcgtgtgtgtttgtataaggctcttttgagatgaactggtgcttgtttaatttccagctcaaatcggagcaggaatatggacaaactgctgctactgaaccctgcactgagccgaggtatttccatttggttaactaaacgctagctaccaggaaatgacgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaaaaaatcacacatttcataaaaccctgatgaattttggatatgtgagagggcataaacattcctaaatatggacctgtgaatttagtaaattacccccatgaatatactccttcagtgcagggatttttgtgttttttttttttttttaatttttttgcaacagccttgctcatattccaggtgtagctagcaaacccctgtttttgaagcaagagccttatttgattcagtgtagatgtttcctgtctatcctttgtga

SEQ ID NO: 42937 - DNA, 1089 bp, Homo sapiens
tcaacgcttcaaccggaagcagaaattgaccgcggcaggcgccatctaacggccgctggagcaaagctcctcctggaaattcgcaacaccggaaaaggtccggctgcttccggtaaaaacccaccagagctgacgttcagagggcgagtctcgaagatccggccaatttgcccagcgcgctgtgctccgcgacggcgcatgcccgcttttgcgcaggcgcggggactacggcgcaggcgcggagactattgcgcaggcaagcgcgtacgcagaagcgtgcgcgcgcccgttcaacgtccggagcatcggtgcagtttcgagggtaaagcctttggcgcggtgatgtggacttttgttctctaactacaactcccagcatacgtcacccctcacgtgggcgctaggtgtggtttcgtgggatagggtaaggcgaaaatgaagtgacgatgacgtaccaaagaggaaaatagttgaatatgttgtgtgagcgcgtcgtttgcagaagccccagtggcctaatggataaggcattggcctcctaagccagggattgtgggttcgagtcccatctggggtggcctgtgacttttgtccttttttcccctttctaaacaaagcgaaatatgccaactttactttttttttttttaaatgggaagtgtgtgtgtgtttttactagctggtgggctgcaattttcgagaatctgcacacacccatgtcctttgtctgagccgcaggtcccctgggatttggggagacgtcaatacgttgaattttgatatcccttttataaatcatttaaaaatgtcttctcagcgtgttccatatcaaatccacacccacaccccccgccgggcccgcttctcctgagactcagcggttggtcggctaacgggcatcttcaatgacgcagtgaagaaaagcccctgtttccccaaacccttgttctgggttagaggtcctggtaccttcagttaacagtcgggtttcgtttgattttgttacggcgcccctgggccttcgattaataaggttcggtcaacggacaagtgagcggttccactgctcgtcagtcgatagggggagtc

SEQ ID NO: 42938 - DNA, 1048 bp, Homo sapiens
ccggctaatttttttttttttttttggatttttagcagagacagggtttcaccgtgttagccaggatggtctcgatcccctgaccttgtgatctgcccgcctcggcctcccaaagtgctgggattacaggtgtgagccaccgcgcccggccaagttttcaattttcattgtaatgaaaggtatatgccacattaatcaaagtcacagaaatataaataaagcagtcctttatttgcttgaaagggagaaagttctacataatattctttaggtgacattaatgatgagtgacctaattataatttccatatctaccattaaccaacctctgagcatctctggactttagtttcctcatctgtaaaattaaggaattgaaactagatgacttcttgcagtactgactgaatacagggacattcaatgcaactccttttaaaaatccgaactagaggtcagctttactaataactatagagtgcctctatagatgtattaagtatacatgtatatacatacatgtctgtatttcctctgtgcaatttactttcactctagtgaatgcttatttattaaatctttctctgtggacctgtatctctagctgggttaagaatttctgacttgctgcttctctaggtcaccagtgaaaagttgtgcagagcccaacatgagcttcatttccaagctgccacctatctctgcctcctgcgtagcatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaattttttttaagtttaaggtttttctctgtaattttgtttactagttcttaggggaattaactggacatttcatctttactctcagtgaatttactgaactttttgcactagactgatgttgtttttctac

SEQ ID NO: 42939 - DNA, 1562 bp, Homo sapiens
ggaactgctgccaatggggtgaggcggggcctggaggcagaaaggagagtttgtgcttttaatgttgacttggctgagacgggagagcccgcgtctctgttgcgtagttggggggcccgttttgtcgctggttaggtacctgcggaaagctaaggcctccacccccgatataattccttaacccagagctttgggatcatccctcgccgccgtcctccagagtacctagagagaagcttccccctcctcttcctgggtcaggaggaaacctttattactaacccagtctcagagatgcaccctcgagccccacagaaacaaccatttttatggaaaatctgacccaaaccatggtttcttaagtgggtgtgtttggccccattttgtgagaaggaacatgttatggcctgtttttccgagagacctccattttgttagacaatttaatagaggctttgttcagtaaatattgacaaatgttgcatgtccctaacagaacgattttgaaaatttggtacccagtgaagtagaatagaggagaacaaagatcctttcaggcgtttagtttagaatctgtatagagagcccttaattgctggattatcctttgtcataaagagaatttctaaataaaatgatgaaatgctgttgcttttttggtgatgttaattagtaatgtactctcaaattcaacttaaatacattcaaatatgtaggaaaggtctagttcattactttcttaacacagcaaaatccttggtagtttttatgtgttgcttctttaggcagatagtttcttagccactaaggaaatgctttttttcttgagaagttatttaagtgtattgatttaagagaaaaggcacgtcttaaatttagtttttaagttactcttttaatttacatgagtgctttacagcaaaatatgagtaaattttaaaaattttattgcattcaaatctttcagcagtgcgtagagtggcttttcagtgttcacattttcagttttaataaaaacccatattgggaacttttatttgtagaatatatagacaaataggtgtagatggcaaacctacttgtggttgtgtagagaggaaagattgggaaggaaatgagttttgtatggaaagttaacattaacttaaaatgccactggagaaacttttaactgttatcatttctcacgtttagataagaatggttactttatcactgcagcatgtcttaacattcctccttttccaacatgagagagggtattgggaacgggtttcattggatcctagctaacagaataactaatctgtgtaataaaattaagttatttaagacgtgctttacatgatccttttaatccttgatggataccatttttgggatcttcttcatggattggatttcttagttttactgggagggtagttggatcaaggtaaaccatctcctgataagtttctgaattaggcagcccgtctagtattgcaaagctaaatttaaatatatatatttctgtgtgtgtagtcagcagaaacatggatttcttaaaatccactttgtgt

SEQ ID NO: 42940 - DNA, 1050 bp, Homo sapiens
tttttaaataataacaggatatttcttagtctagagcttgtaaattctttaatataaggagttttataggattaaacagtagtttctctgcgtttcagttaactatttaactttatcagagtttcaggcatatccaaaacactgaaagcacctgcatagtgaatcaatgaaaaaagaaaagttttcctcattttgcattttgaactctgaataatatttctatctacacagcagcccagaaaacaataaaagtatcacttcatataacattgcatcgttcctggattctctacagttgtttagttctcctcaagtaagcatatgcttctgagacattcttttacttcaggtaaatataagcaaaacaaagaaaaatcattttgtctatttctgcatcagttctataaggagcaagtaaattcttttattttcgtttaggttggatgttgtcatataaggatagatggtagtgttcaacgtgttcaagatgggtagtaggaattcaatggccatgaggtgtcatggatcaaggtcaggtttagtgaatcaggtactcttcagtaacaggtggttcatacaaagcattgaagcttaaagttgctgtgagttcagcaagcaggagggttgagaagacaggcagatggtttaaaactaaaggtcaataagtgggcaagactagttaaatgaggcagatactccccaaagatggaattccagaaaggtgcttgaaaaggactgaattcttaaagcctactgctgttagtatgtagagttcttgaggaaacaagcagtttggcataacttaatctactaagaaactataagaaggtgaaggaagttggaacatcttactggaaaaagaatgagggagtgaagagggaatcttgtgaattcaaaacttgcagaaaagctattctgtttcctttttgtttaggttctcatgcactagcagctgctagaatagatattggaaggcagggccaaaataggtcagttgttcagttttgcaagattattgaggatatagagaaattaatttgtgaaaactct

SEQ ID NO: 42941 - DNA, 1045 bp, Homo sapiens
actcaacatgaaaggaatttaaccagctgcccttgctgaatcttgtctcctgaatatggtaaatggtttttgtttttaatcttaataccttagatttctgcagaccccagttttctcttttagagttaactgataattattggatagtatctataatatacctggctgttctgttctgtactgtgctctagtattagtttaaatggtagacttttctcttaaagtaactttaatagtttaatagttaaagttacttgaaggtatgttttagatcagggactggcactatggcctcctgcttttggtaaataaagttttattggaacacatccatgccgattcatatacatgatgtctatggctgctttggcttacgacagcagagctgaatggttgcaacagagtcatatggcccgcaaaccgaaaacatttaccatttgactctaacaaaagcttgttgatcaccattctggtttagttattctaaaccaagtgtggtccttggagcagcaattcagcatcacctcagcatcacgtcgtattgttagaaatataaattcttggacccacctactgagtcagaaattctggatatgggccccagcaatccatgtttttagaaaccttccaggtgattctgatacacattaaaagtttgagaaaccctcttctagatcagtgtttcccaaatgtttgtcacacttattgcctttattattatttatttttattttttattttttggagacagagtctctgtctcccaggcgtgaaatgcagtggcctgatcttggctcactgcaacctccgcctctcgagttcaggcgattaccctagcttcccgagtggctgagatgacaggcatgcactgtcatgccctgctaatttttgtatttttagtagagatgaggttttgccatgttggccaggctggtctcaaactcctgacctcaagtgatctacctgccttggcctcccaaagtgctggtattacaggcgtgaaccaccatgcctggccttgcctttattattatttactgttttc

SEQ ID NO: 42942 - DNA, 1791 bp, Homo sapiens
gaaatacagaggtatttatatctcttttggcaccaatagttcttgcttcagtaattcaccagtaggttttcattcatcgataatatatcagtttaaggctaaaataaaacacctacatttcttagggcttatcattctatatagaaagaggaaacatcctaatgagttttttcttttgtttttccaaagagattctaagcaaaaaaattttaactaacatctatattttgttattggagctagttacctttctttttcttagattctttaacgttttgagtagatagccatatttgataagcaggttggatgcttctgttgcttaggaggtaggtgtattgtgttatatgaagacagaatgaatttaaatatacccagtttggcagtatgaaaaagctcagactacataaaacttggaggtatggaacctttggacgcattaaagttaacgtttcattaggcaatgtgcctttgtttgactggtgtgtaagtccttcttccaggtttgtacgctcttaaacgcgttattctaccctctctaactcctcccagcagcaaaagggagacacttcagctggaacaaaatagtggaagaaatggcgtctggggttcagtggggattcgcagtgtgtatgcaatgtttgcaagattattttttatgtttttcaattactgtaaataaaaatatatcaatgcttagtgtcaagaagggaacattgtataccagtataaactctcttagtgggtctgcaagttgcttaacctctcggggcctcagttttctcatctgcaatatgaaggagttggactcgataatctttaaagtccattcctgctctaaaatcctatgcttttctgaagtactctatttaacagaatgcattgctttctcactttgactatttgaattatgtatgcagtacacttactgcaactgcatgttgtctaaaatagtttttctataggatgtatataaaaactaatccctcttgagctgatttataatgtgtgtatatagccacacataaaaagctagtaatagtagggctctcagaaaatactttccagttgtctaaccttgaatgttattaactcttctatattacaggagatacaactcgtcaacgaatcaaattcagtgatgacagagtatgcaagagtcaccttctcaactgttgtcctcatgatgtcctttctggaactgtatgtatttactaaatgtattgttagattactgatatgctgcagtaatgaactacttgataaagtcttaattctgtgtcaaaagaattgacttgtgaggggagatttgcatcctttattgtttgtttattcaggatgattacttaaatcttcagtaatgggtttcctcacaaaagtggttgatacgttttgttttataattttttccattcttcagagcagttttttaaaagcatgttttatttggaatacagaagtagttatatagcatttgtacttttagttcagaaataaaataatttatttttaaagttccttttactgttaaacagagtagacttttatctagtacggtatacatttttgttaagatttgtacacatttgtggaatcagtggggaaatatattagtaaatacttatatccacacagcttaatttgggagtattgtcacttaaaatattgctcctgctaataatgtaaagctcaatttagattctatgtctgcagagatgttgatcttagagtatcatcgttttaatttggaagataaactgcatgatgatggacctgttggaatgtggaaca

SEQ ID NO: 42943 - DNA, 1029 bp, Homo sapiens
taagaaaattacaaaaaggtagaaaaatatcatgatttatctttactttgggaaaaataggtttggagctggaacatatacaagtgggaagaggcagttaagaaattgggaagtggtagaaaagcagcagcgttatgtatgcacaatgtgccccatttctcttcaccctatactcatgtctaaggtatacttgttaacatgggggtcagactccgtgttcttgtgtaattcgttagagcatcttctggaaaaatgcttgagctgtaactatggggaggaatatgtataactttcatcctggaaaacttggataaagaaagcctgtagtgaatgtagtcatatatctgtatcatactagatgctgctacttagatttcctgttattacatcaaaatcatcttgtccagaacaagacattttccctcatagatcagttttcccatttgatttagtcagttctcttggtggcatcattgttttctcatgtttgaaatacttgaaaccctgaagagactcctgacttttttctttccacacttaatttccatttagctaatacctgtaggttgaaagttattgtgttattgaaagaatattgagctatattaaagacctgttgagatttttactctgctgccattagcttatgatcttaggcaaatattgatctgtctgagtcttgatttccatatttgtaagaaggtgtgatgggattcattattccagagacacttcacattttttaaatgattttttttttttttaattcttcggcactctggtttacctctgtcacctcctttcttttttctcttctaatttgaccccagtggctttattcctaggttcttgtaatatcttttcttgccctttgtctctttcttctggtcaatccatctagtgttaatggttctgaaacatggattttattgtgtcgtatttctgcctgagtagtcaagcattcttctttgcctacagaataaattctgcattttttttgactcattttcagactctttcaccatctag

SEQ ID NO: 42944 - DNA, 1049 bp, Homo sapiens
agtctttgggaggtaggaattgggactgttttttaaaagcttccatcaatattatgtaaaagttccccaggtctaagttgagaaccacagtggatcaaaaagtctttccaactgtgacatcttgcattttatgaaataaaatagaatgtagcatcatgtgaacagctatagcttgtggaaataaaatattaaggaagttgttggcgtgattgatgtttagaaattgttaatttcagaaacgtactgcctggcatatcaaagacaatgacagcatccttctgccattagcttctttcattcctgttatattttctggaattctttcttaggaatatttaagtttttctgcattttcttaataattgtttaatgagcaccttttaaatttgaatttctacacatcatagaaagctttactttttgtttattgtcactgaaaaactccttagcttgttaaaccagactaatgaatcggggggtaaggattggagcctggaaaaatctcagcatgctcagtaacagtacagtactttaataccattaagcatgatgaggacttttataacagtgatgagtcctcattatttcccaaaggataactgggggcagaatttatacgttcccattcattccattatataattaagaactgaaggtaatatagttttacagaaaaacattttctgtttgtttttacttttgagacagggtctagctctgtcacccaggctggaatgcagtggcatgatcacagcttactgcagctttgacctccagagctcaagtgatccccctgcctctgtctcctcaggagctgggaccacaagcatgggccaccatgcctggataatttttttcttttttactttttgtagagacggggttttcttatgttacccaggccggtctggaactcctgggcttaagtgatcctcccaccttggccccccgaagtgctgggattataggcattagccactgtggccagaaacattgtgtgttttttactttttttaatagtcacaacatctaagagtccgaaggaagaa

SEQ ID NO: 42945 - DNA, 1036 bp, Homo sapiens
aatgtgtgttttggagagcagtggtttgcttttaaaaccagccttcagtagagagttcctactttgtttatactgtgtcctctttgagttagttttagacaatatagatttttctcagttgtgccatgctgtaactgttactcttgactacttacatttttaaaatgtctgattctctgctcatacctacttatttgtaaatttattgtcttggatatgtaactataggacttcatatttatttcttttaaattttatctggtctattaatacttttgaatcttgatctcgtgcattagctatcctttttagttgggatattttataaaattaattatcatacgtttgttttatacatatttaggttgttgacaagttaaataggcatactcatttttagatactgtatacaaagctaaggctcagacctgtgtgccatactctattcctgttccctgttaccataaacttccctgtgattaatagtggcatataaataaataaatattttaaagatctgccttctaaatcttctgtacaacctggaacattactttttgccttttcctaagattcatttgcttctccctctttagatccagtttaattgtatcctcttcagaaaggtcttctctgaccaactcatcccaagtaggcccccataataatggggaacattgctattttattacatcatctgactttgttcatagacatgattcttgttatttgtttcccctcaaatagaatgtaagctccatgaagtcagactgtctgtgtcacttaagtctatatccctagcacctaaagtagtgcttaccacaagtgggaacttaatagtcaaaggaaggagaatgacttgtactccctttttaccaaccctccagagattttgaggtattccaagggtggtcacacctccagttggaaaatctccgccttgctttcatcaccgattaatcatacctgtaatgatccttgcatcttgccaattttttctcatattttcccccaaaaaagtttcatgaaagatctt

SEQ ID NO: 42946 - DNA, 1150 bp, Homo sapiens
gggaggtggaggttgcagtgagctgagattgtgccactgcactccaacctgggcgacagagcgagactctgtctcaaaaaaaaaaaaaaaaagtcatggagctgggtatggtggcttatgcctgtaatcccagcactttgggatgccaaggtggccagatcacttgaggccaggagttggagaccagcctgggcaacatggtgaaaccccatctccactaaaaaatattaatagaaaaattagctgggtgtggtgatgcacgcctgtaatcccagctcctcaggtggctgaggctggcaggtggaggttgcagtgagccgagatggtgctactgcactccagtctgggcaacagagtaagactgtctctaaaaaaaaaataataagatcataggccagtctcagtggctcgcacctgttaattccaacactttgggaggctgaggtgggaggatcactggagcccaggagttgtagacccatctgggcaacatagcgagattctgtctctattttaaaataatttgttttcacttaaaaaaaaaaacaaaaaaaaaaaccaagtagaaatcatggagaaaggtgaaattttacacattttccacaaaatggggaaagattatggaaagaagacttgtaggcctaatgattatttctggcagtacttcaaattgaattattaaacagattttgacagcagttgtactgtattagaaaccagataatataaagtttaggataaagctgtttaagaatggactcagtaaatattctcctcatttattactgtttttaagagagtcgtagctgagaagcaggagaaaagaaaccaggaacggctgaaacgaagagaagagagagagagagaagaaagggagaagctgaggaggtatggagtaatgggccaagtaattgaagttgaatctctgtggttctaaaaagagatataattgattttaaattttagatggtgataaatctgttatgggacgtgggaaacttctgcttactttaaaaaatattactgtgcgaattatataaatgtttaattatacaagtatcgtaactcttggccatttaacggaatgtgatttcctttaaaatgtgtggaagagtgaataaagaatgcttcgtatcttgtaagatttata

SEQ ID NO: 42947 - DNA, 1031 bp, Homo sapiens
taatcccagctacttgagaggctgaggcaggagaatcacttgaacccaggaggtggaggttacagtaagccgagattgtgccactgcattccagcttgggtgacagagtaagactgtctcaaaaaaagaaaaacaaaaaccttacagttctgttagcaacatctatcaatgatatttctgcctaaaacactaaaaaaactaaagaacattaataagtggggccagttgtgtcagctaatttatattattggtgaatttctctgatctagcatgataagtagaaacattaaactgtgatactgttattgtttactgtttgattaatataagctggtccctttgttgaaaacataaagtattgcacatagaacatctttagatatttgggccagaaatttaatttctattcctctagtcctgttacctagataatatgtttgccttgtaactgggctccttagttctctgtgcttgcccaccccccttcttcacctcattctatttttcacacgtcagccaggatgagcctttaaataaatgaaatacatcacatcagccctctgattctccaaaggtttttcatctcattcatatgagaagttaacatctttaccaaagcttttacatagggtgacggtgtggcctggggtgtccaatcttttggcttacctgggccacacatcagatacactaatgataactgatgagctggaaaaaaaattgcaaagaaatctcataatattttaagaaagtttacaaatttgtgttgggctgtattcaaagccatcctgggcagcatgcggcttggaggccgcaggttggacaagcttggcatagcccaaactgccctgggatagttctggtttatgtcttttatcccagaatatgtattaatagcttctcattacattcagtaacttattcagagccttctagtttgaatgataaagtacctggtcatcctgcctgtaagaccctgatattacttccttttgctcacttcattccagccacactggtcttttccttca

SEQ ID NO: 42948 - DNA, 1028 bp, Homo sapiens
taatatagcccctggcatatagtagtggttcaaaagttgctttcacttgaaaaactatttctgataataaatttatacattactgattgctctctgagaattatcaatcagtgtcttgtttttgagacagaatttcactcttttgcccaggctggactgcagcgatgtgatcaccaggtcattgcagcagccttgacctccctggctcaagagattctctcacctcagcttcctgagtagctgggactacaggcatgtgcctctgtgtccagctaatttttgtatgttttatagagacagagtttcgccatgttgcctaggctggtcttgaaatcctgagctcaagcgatcctcctgcctcagactcccaaagtgttgggattacaggtgtgagccacggcgcctggctgagaattattaatgttttattttgaattctagtatgtagttattaacacaccagcaattcagtgtagatttagctgacttggaatataattgacattaagactactgaaaaaaagtttctctttaaagaaaaggctttaataaatgagaaatatagtaattacaaaggtagaaacaaaatcaaatcttgtctggtagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggaggtattgatgtgtcaatcagaggatatggagctaccttaatgttttagagttgtttatgtttacttatgttacttatgtttagagttcagattattggtttgaaacttttgcatctggtaatatgtacacatttatgtgtgggtgtacaacatttttctgtgattatatgggtagttttgaaagaatatacttatgagccagagcaagaaattggaaccaatatgtgtaga

SEQ ID NO: 42949 - DNA, 1354 bp, Homo sapiens
ctcctcaaattaatatttttcagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaacataatgagacttaagtttctgccttgaagagttgtata

SEQ ID NO: 42950 - DNA, 1095 bp, Homo sapiens
acacccgggcttctgcttacagctggaggcactggccacctaccttccttccttggctgggagcatcaacagccaagcccctttacacggcagtcatcttgatgagttgctggggccaaagcctgccctccctccctctgtaagcagtatggattccttgtggccttctgagccttctccttgctactcaagagtttccaaatcaaaagacttgcagcctgttcctgttttttaaaagtatttataaaagctgaatgtcaattttctacttagagttataaatagaagcagatgctctggtttgttgatcagcacgctgtgttcttacaggggaagtcaaagaatccgaagtgtgcttggagcatagaactagcgcaagagggcgctagtgaggcggtgcggcgcgggcggccaggagctagggtttgaaaacagacttcggtttgagccctgaatctgccacttagaagctgtgtgcccttgggaagcgataataatacatttaccaaagtcagactagataaccccagcactgaggagttatccacatcatctcttcgtccttcacaacaataaatctataagctagaagttaccatctccagacttacagatgagattgctgaggcttaaaaaagtcaaaaaggtactcaaggtatcatgatagggcctgggggagttgaatgtagtttagattaaccccaggacctactactttatttttattgcgtttattcaaaggcaaaacctgtaagagatgcctaaaaatgataatggctacctttcttaaaaaaactttattgagatttaattttcccacaataaaattcaccaatttcggctgggcgcagtggctcacgcctgtaatcccagcactttgggaggccgaggggagtggatcacttgaggtcaggagttcgagaccagcctggccaacatggtgaagccccatctctaccaaaaacacaaaaaattagccggcatggtggcaggcacctgtaatcccagctattcgggagggtgaggcaggagaatcgcttgaaccctgaaggtagaggttgcagtgagccaagattgtgccactgcactccagcc

SEQ ID NO: 42951 - DNA, 1027 bp, Homo sapiens
catgtgccaccacacccggctaattttgtatttttagtagagacggtatttctccacattggtcaggctggtctcaaactcccaacctcagatgatcccctccccccccccaccccgccccgcctcggcctcccaaagtgctgggattacaggcgtgagccaccatgccccgcgtggcaatttcttaaaaggtgaactatatacttagcacctgacccagtgatctaatccccaggaatccgggagaaatgaaaacacttccatacaagtacttgtactgacatgttcataacagcttaattcataaccaccccagactggagacaagactaatgtctatcaactggtgaatggataaacacattgtagtactgtgtgcccatacaacagaatgagctgctcatatgtgcaacatgaatttccagaagcattatgctgcatgcaatgcacatgctgtgtgactccgcttctacgaactctacaacagggaagatggacgtggtggaacacatcaggacagtgtctgtctctggagtggatgtggggtcatggggaagggccttgagggagctttctggggggctgtcaaggggaaacagttcaggtggttggagcagggagagaccagggcgtgcagttagaggcgaggtttgaaaggtgggtgaggccaagtggcaagggccttgtgtgcatgatctgcttcggctgttatcctgagcagagcagccgacactcatgagggttccaggctgggccagagactcagtcttcctctttttgcccaagctgccatccctcaagacacttagtagttccctgcttcctccccaatttctggcacgtgatgctctggaaacgtaaagcttgcagggtaacatgaacctcctggacccctgcctcagcacaggaggggatgcagatgttggttgggaatagcggacacaaaggtgatgggttggtttcccaggactatcgtaacaaagtatctcagactgggtggcttaaacaacagaactttttttcacca

SEQ ID NO: 42952 - DNA, 1050 bp, Homo sapiens
tcgggtaattgctacagattcttcctctcaattttggcacttatatcatgatggacaagtaacagtttacagacaaacattgagctgcagaggcactgttttcatctatgatttatgtataacattgactaaaaaaacactttcaaagtgggggcacaacaatgtaactgtacttaactgtgcactcaatggttaagatggtaaaaaaaaatccaaacaaaattgtaaagggaattcacacctgctaggagggctgtaatcaaaacaatgcaaaccaacaagtattggtgagaggatgtggagaaactggaacccttgtctgttgctggtgagaatgtaaaattatgcaaccaatgatggagttagtctttcctcagaaagaactaccggtagcagcggtggtgtcggcagcggctgtagcaaagagtttggcgcgatgtctcacaccattttgctgatacagactaccaagaggccagaaggcagaacttatgctgactacgaatctgtgaatgaatgcatggaaggcgtttgtaaaatgtatgaagacatgtgaaaagaatgaatcccaacagtccctctatcaaatatgacatcagtcagttgtttgatttcatcaatgatctggcagacctcagctgcctggtttaccgagctgatacccagacataccagccttataaaaaaagactggattaaagagaagatctacatgcttcttcatcggcaggctcaacaggctgataaataattgtattggaagcattaggggggttgggggtgggcttggaacacaggtgagtacggtgtgctgtagcggaagttttgtatcatagtaatcctgtttccactttgttatactctagccaagattggctgtattagatgaaatgtgaagttctttttccatttggaaacccccgttgccccctctttttttcttttcttcctttttttttacttaaacatttttatgatgatttagatggaagttgttcttcctcaattaatgttggttccagtccttccactgtttatatctgctttata

SEQ ID NO: 42953 - DNA, 1050 bp, Homo sapiens
caggagaatcgctggaacctgggaggcagaggttgcagtgagttgagatcgcacaccaccgcactccaccctgggcgacagagaaagactccatctcaaaaaaaaaaaaaaaaaaaaaaaagatcacattcagtcagcatttattgagtgctgctgtgtgttaagctctgggctaagtgctaaggttaaaaaaaaaaagacgaatatgacactgtctcctctgtccaggggtaagtgcaataatagaggtattactgcccagtggcttcccagaaggaaaaaacatgtgcactgaaccctggagaatgaataggagttatccagagattaggaggtagagagtgctagggaggaaaaacttttcctgtgccctcttaagttcagtgtctgggggcctgtaaattgaactatcaaagacaaattagcaggagaaaaggtaaccaatgtttattaatatttatgttcatgggagttcacagataataagtgaaactcaaagaagaatttagactcaggggcttatatacctttttaacaaatgaaagagggtttgggtttcaagggctggtgaattgagggaagtgactaggaaacatatagaggaacaatgggagataaaggctattttggtaaggtttgcttgtgcaaactaatcctggtgttgattccttggcatgtttgatgatgagtcactcttccctccctggtttagggtgggcagtgggggtatgagaggggatggggtgagggatggggagtagggcagcaccctccccaaagggaaatttatgccctacttttagggagatgagagggcagagaacccttcctgttgattctgaattgccttcggcttaaaatgatccatatgtcaaagtggcatattttagggtggcatattctggaccccatcaaggaaatagaacatgctaagtggaagaggcctgagaaacatagagtgtgtgtggaactgaaagggttggataaatgaaaaaggtagaaactgcaactaagaacatgtgaggctatatgaacagggaatctgattac

SEQ ID NO: 42954 - DNA, 1073 bp, Homo sapiens
ctctggaagaacctcctgacagttcctgctcccctctggccccgtcaatccattttctacacagtggcccagaatgtttaaaaatgcaaatcaggttgtatcatgcctccagtggcttctcattgcacctagggtaaaatccaagatccttatagtagcttccaaggtcctgcatggcttatcctctccctccctcctcgaagacctcaatgcacctgactgaactgatctcagcacgtttccacctctggccaggctctctacctaatgaccctcctccctgctttttgatccattccacctctcatctcctaggtcttggcttaaatatcttcagagaagcccttctggacttccttcagtagtgtcattcccacttcccgccactattcttattacctgtttatttccttcatacctttttatcatttgcaatgattgtgtttgtttcctcatcttttttctgcctcccccagacctgaagctccgaaagaccccggagtgtttgtcttgttaaccatcgtttctccagctgtccacgcaatggtcaatatgttagctattataattactattttaatattactgtttcttgatgatttcagactctttggatagaatattctcccttctatctgagagtgtttgtgaccttctcatatttcctcatgtcctctggaatcctgacctaaatttttagtcttttcctatcagttatcaattgcttacttgttgttttcatgtttaaaaactcattcaactccatccaaactttcttcttcttcttacaaaatagtttatagctaactatatttccttactctcatttgttccttccctgtattcagtgtctccccatcaatatcttttattactccagaataatttcagaaacagtttgagacagttttaaaaataatgccgctggcattttactagggatgacattaaccttatcagttagtttgagggaaatcagtatctttgcaatatcaaaactcttcctaatcaaggacagaccacatttttccatttatgtgtttttaaataaaataatgttttctttgtattgg

SEQ ID NO: 42955 - DNA, 1028 bp, Homo sapiens
atcacagtcttaaacatatatgcacctaaaactggagcttccaaatttacaaaacaattaaaataggcctaagaaatgtggtagacagcaacacaataatagtggcagatttcaatattccaccgacagcaccagacaggttagcaagacagaaagtcagcaaagaaacaatggatttaaactataccttggaacaaatggacctaacagatatatacagaacatttcatccaataaccgcagaatacacattctattcaacatcatatggaactttctccaagatcgaccatatgataggccataaaacaagcctcaataaatttaagaaaattgaaattgtatcaagcactctctcagaccacaacagaataaaactggaaatcatctccaaaaggaactttcaaaaccatgcaaacacatggaaattgttaaataacctgcttctgaatgagcattgggtaaaaaacaaaatcaagatggaaattaaaaaattcttctaactgaatgacaataatgacaaaacctatcaaaacctctgggatatagctaaggcagtgctaagaggaaagttcatagccctaaacacctacatcaaaaagtctgaaagagcacaaacggacaatctaaggtcacacctcaaggaactagagaaatagaaacaaactgaacccaaacccagtagaagaaaggaaataaccaagatcagagcagaactaaatgaaattgaaacacatacacacacacaaaataaaagataaattaaacaaaaaactggttctttgaaaagataaataaaattgatagaccattagcaagattaaccaagaaaggaagagagaaaacccaaataacgtcactgagaaatgcaacaggaggtattacaactgacaccactaaaatacaaaagatcattcaaggctactatgaacacctttacgcacataaactaaaaaacctagttgagatggataaattcctggaaaaatacaatcctcctagcttaaatcaggaagcattagataccc

SEQ ID NO: 42956 - DNA, 1033 bp, Homo sapiens
agcgcctggcttcctcctcctccccagtggataaaatgctggaactccgtcaggcaggactgccataattagaagaggcccctttccagcagctgaagctgactaggcagatagagcccaaatttgtttttagccaccacatgcccctgagctgacccctcgagctgtggacacatctcacaacctcacccggaggccattctctcaggccagtcacactctcccacagagagagcgaagatgatgtcaaatctatggccaccttctaccagcagagggaatgaatgaaaactgacatgtagaagagtaagaccactactgttttcatttttggtattttttttttacattttaatttttttatactctatttttagtaaaagggacacctttactatttcaaaccaccaaaatataagccctatttggttcaaatctttgtacagccagatagcaatagatataaattgacaatggcctcaagtatagaatttggggttatacaagtgacagaattcttgagtctcagttgattataatataatgaggggacagtgccaggtctttcacgtctccaggtgggaaggggacaagttgcacgatggctgtcctcatctgtgcctggttgtgtgagaattagaaacaacgtttgtaacagtggtacctagtctttgtgaccgtggtcctctttttgatattaatatttttgcagactagttggcataaacaagttggctctctgtactcacattacaaccactgaggtataacactatctcttggagtccttagaagcacctcgctctgttcagctggcctctcagccttgtgtggctgtttcagaactgttgatcatctgtcaagtcatcccagagatcatctagatcttgagtccatttcttgcatgttccagaacacaagaaaacatttgtggctatagcttcatattctatcatgcctttcatccctttctcccgataatacatgaacccggttacagcagaaatgcattccatgcatttgcaacactctg

SEQ ID NO: 42957 - DNA, 1073 bp, Homo sapiens
ctgaggccaccaacctcatctccgtggcagtgaaagtaagtgttgtgagagctcacagctcacctacccactgagctatcccagatcagaaacaaccgccatgcaaatcgcccccacgtttatttctatttgcctgaccaatatctgagtgcttatttcatgcaagctgtttcatttattggcttgaagtggcggtgtgaatagtctgatagaggaaaatgaactgagtctggagtgaactaactgcttgggtgtcgggaccacatcctcttttctttgataagaagccacctggctcttgcttggatggtgggacccagccctggctgggtaaaatgtgtccagcaggtttctcctgtctcacggttcctctttctgacaggtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacaggtgagttctcctcccctcagctgtaaatagcacctaacatagttcttgccattagctgctacttagtaaatgttgaatgaataattttctggtatgtcataactcatgtgatgtgttagagctggtaacactagctgataaagaacatccaaatctcagtggcttaatgcaacaaattaattttttgcttatatcaaagttctggccgggcgtggtggctcatgtgtgtaatcctaggactttgggaggctcaggcaggtggatcacttgaggccaggagttcgagatcagcctggccaacatggtgtaaccctgtctctactgaaaatacaaaaattagctgggcgtggtgctgcatgcctgtaatcccagctactcaggaagctgaggcatgagaattgcttgaacccaagatggaggttgcagtgagatgacatcatgccactgcactccagcctggcgacagagtgagactccatctcaaaagaaaaataaaaacaaaaaacaaagttctatgcaggtgaactgaggcagagaaagggag

SEQ ID NO: 42958 - DNA, 1076 bp, Homo sapiens
tggggtgagctactgcatggtgctcttggagagacgaaagcacttagtatggcttggaagagagtttgaaggagggggcagtgattgctgaggctgaggaggtgagaggaggctgaggaggtgagaggggcctgaccacaaagggtctagtaaatctgtgaaagagtttggactttaatccaagggcagataagttcattttgaagatttttgcccttaactttaaaaaattgaattccaataatatttaaatataaagtgctcagatcttaaatgatgcttagtgaatttttaaaaagcatcccagtgcccagattaaaacataggagagttttggctgggtgcagtggctcacacctataatcccagcacttcaggaggctgaggcggggagattgcttgagcccaggggtttgagaccagcctgagcaagatgccaaaaccctgtcactacaaaaaaaaaaaaaaaaaaatacaaaaattggccacgtttggtggcagcatgcctttagtcccagctacctgggaggctgaggtgggatcacctgagcccaggagatggaggttgtagtgagctaaaatcatgccactgcactccaacctcagatacaatgagactctgtctcaaaaaaaaaaaaaaaaaaaaaaagccaggcgcagtggctcatgcctgtaatcccagcactttgggaggccgaggcaggtggatcacgaggtcaggagatcgagaccatcctggccaacatggtgaaaccctgtctctactaaaatacaaaaaattagccagacgtggtggtgcatgcctgtagtcccagctactcggaattgcttgaacccaggaggcagagattgcagtgagccgagatcacagcactgcactccagcctggcgacagagcgagactccgtctaaacaaacaaacaaacaaacaaacataaagagacataggaggtttttatgctgaggaatgccctaatgtcacaacctcatgtccactgtgtggagttggagtgggagggtgagacgagaggcaggggagtcagaaggtggattttgattcttggacatttaaacat

SEQ ID NO: 42959 - DNA, 1127 bp, Homo sapiens
tgtctctgattttttttatttttttgagatggagtttcactctgttgcccaggctggagtgcagtggagccatcctggctcactgcaagctctgcctcccgagttcaggccattctcctgcctcagcctcccgagtagctgagaccacaggcgcctgccaccatgcccggctgattttttgtatttttagtagaggcagggtttcactgtgtcagccaggatggtctcgatctcctgacctcatgatccgcccgcctcggtctcccaaagggctgggattacaggagtgagccaccacgcccggcctgtgtgttgtctcttaaaaaggctattgtagaccagctgacatggctcctgcctataatcccagcacttggggcagccaaggtgggaggattgcttggggccaggagttcgagatcagcctcgtcaacattgcaagaccctctgtttacaaaaaagagtcccagtctcaggaggctgaggcagaaggatccctgaagtccaggagctcaaggctgcagtgagctatgatcttgccattgcactccagcctaggtgacagagtgagaccctgtctctaaaataaataaataaatacatacatacataaaggttactgtaggtttcgaagaattacctgtatttaaatgtatagtttctgggatgtgtgtgaaagatttatttggtcattcattcatacacacatggacacaaacctagaaaagtatattccgcacccctagatttttccttagtgtgtccagtagatgggaggctgggcgagtaggtgagatggttggggagatgacgcggtagagaagagaatgtcaggtagatggtaaacatcccgtgggcaggtctgagggaggctgagagtggacagcaaggtgattatccagaacacacgtccctgtatcagcatgttctgagatgaactgttctgtttttctgttccaggtaaagcttgagagcaactttgcctccattgtgtttgccatcatggtgttggaggggcttggccgctcactggaccccaaactggacatcctggaggcagcgaggcccttcctcctcacgggcccagtgtgccccccgtgatggggcagtggcctctgtgggccctt

SEQ ID NO: 42960 - DNA, 1050 bp, Homo sapiens
tggattctgtttagtgtgtggaatacttcgtagccaaggctcttcattcattcagcagaatttttttttttttttgagacagagtctcgctcttgttgcccaggctatgtagctgggattacaggcacatgccgccatgcctggctaattttcgtatttttagtagagatggggctttgccattttggccaggctggtctcgaactcctgacctcaggtgatatgcctgcctcggcctccaaaagtgctgggattacaggtataagccaccacgcccagcctattcagcacatttattgagcacctactatgtattaggcacaaccaaagtatgcttgggatgcagaagttagtaaaacatgaaattcctgccctcgtagggcttacagctaaacatttttgagccttagattttttttgctttttctgaacagagcttttaaggagtaccaatatataaaacaaggaaaactaatgaatacatcccttgggccatttaaaaatcattgaatggtgaagaacatttcactgaacttatttaaaaaatgtctattaagcaccaacaatgccaggcacattacttgaggtgaaagattttgagtgaaatctgttgtttctgtcctcatggagctaaaaagtgaggagataggtaaactcacaagtacaagccccctggttggttctatgggagatttctgtgctgggagcctggatggctgggccccatctgggagccgtcagcgcatgttttgcagaaaagcggacatgtgatcctaagatgttcttagagagagatttgtggattgataaggtggaatctcagcctcccttaaaagttatgagccccgactaggtaatgcttgtctagtctccctgccacccctgcttgtcccccagatgcctgtccttctcctaaaaggcagccattgctgcccaaattttataaatcatatcatatcagagatcgtatattcatgatgtttaaaaacagcaagtataaatataagccgggcagcaaacaggtgattcaaagatgaaaaaagtgtattg

SEQ ID NO: 42961 - DNA, 1030 bp, Homo sapiens
ttttagtagagacaaggtttcaccatgttggccagactggcctcgaactcctgacctcaagtgatccacccacctcagcctcccaaagtgctgggattataagtgtgagctaccacaccccacctaatgtactttaacatgctaaagatacattccaggaggtcttgtgtccactgttatagctgaattccatacaaattcagcttctgttaatggaagaattcccagaccgagaaagacaggattagttcccttggcctcaaatatttcttgattatagtaattcttggttaccctaccaatttaaaaaaatcttgtaatctgaacactgatttttaagagacttgggtgggcttggatatagcatcagtgaggaactaggaaaagtaaacgccctggaaataaagtgatatagatggaagtggagggtaatggaaacctgcagaagatagcatgaacctccttggctgagtttcttgacttgaaggctggggacacttacagtctacctgtgcaaaatgtacttatgtacaggtgaggtcctaggtccatatgaactgagggaggatggtgactttttccagtggggtaacaatttctactttatgcttctccttcatgatgcatgggtaaattatatagattatatattcgcttgttcaacaaatatttgatgaatacttacatgtcataatttgtacagggggcttaggatgcagtagttcactaaataggcaaaatcttttgcctatatggagctcatattccactgagaaaatggacaataatcagataaataagtaaaacatataatacattagataaagcttagtgctaaggagaagaaaacaaagcatggaaaagggataggaagtgtgaggtggtgagttgaaattgcagatgggatggccagagaagagtgcaccaagaagctgacatttgagtcaaggtctgaaggacatgaggaactagctatggggctctctgaggaagaggatttcaagtggagggaataacaagggcagtgact

SEQ ID NO: 42962 - DNA, 1063 bp, Homo sapiens
tgtttgcccactgaacagacagtgcctttccttatgggtgtacagccaggctattttactcagcattctctgcagttagagttaggtgtggctatgtgactgggttctggacagtgatatgtgagtataagtggtatattccacttccatgtctgtcccataaaataattctgtgtgattgcctattttcttctatcttctctctggatgctaatattctgggtgacgttagaaggcaaggactgaagatggcaaagccttgagaagcctgagtcctcgaatgtcagaaaacagtgacctcccctgtgttggtggccaattggactttagtgaacaagaaataatcttctggagcttctggatagctgaccatgtggaggttcctagaaggcggtgtaaccagggagggcagggaagctccataccccttcccttatactgcactctatagtctcttctgtatcttttgtaatatcccttataataaactacaaaatgtaagtaagtgtttctctgaattctgtgagctgcctcagcaaattaatcaaacccaaaaggggatcatgggaaccttaacttcaaggtagtcagacagaagttccagagaggctgggtgggtggctcacacctgttatcccagcacttggggaagcagaaggatcactcgagcccaggagtgtgagaccagcctgggcaacatagcgagatctcatctctacaaaaaattttaaaaagttaactgggcatggtggcacgtgcctgtagtcccagctactcaggaggctgaggtgggaggatcatctgagtccagaagatcaaggctgcagtgagctatgattgcacagctgcactccagcttgggtgacagagtgagaagttgtctcaaaaaaaaaaaaaaattcttagcgaagttacagagattttaaagtttatctgttacagtagctagtattccattagttatacatgtatataataatgcatcccctttcaactgtaatatgaatcctatatcgcagctaacattgtggcgggcgcctgtagtcccagctactcgggaggc

SEQ ID NO: 42963 - DNA, 1040 bp, Homo sapiens
cgaaaaaaccattcatgcattttcagagtgaccagttattttagttgaacctgagccaggtcagaaattttatgagttttgaatgtaaaacaaacatgatttgcttttccccgacctcctgagatgcaggagcttcatcctgggcagctagtaaggcctttacctcacttggagactgacggcatgtgggctgtcctggcccctgctgtagaggtgaaggatcctctgttttcagcctgtatttcgagcacagtgacctatggaaggctgaggtgggcctcctgtggagctctagaaaacattctactgccagcaagagagatgacactcctctccaggtgcaagaatatattagaagatgtgaggagggaactactgcagggcaaagccgggattctttctagggctaaaaatgcaatttggcattcagagttttatcctccctctatctgctgctctgtctctgccctctcagccctgtcatcagctacctctgctgctttctactctctcgctcattgagactgaatcatgtctcttatttatgggctatattagtttgcttggactgctgtaccacagactgggtggcttaaacacaaaaatgtattttctcacaattttggaggctaggagtctgagatcaaggtgttggcagggccggtttctccagaggcctctctcctgggcttgtagatgctgtcttccccctgtgccttcacgtggtctttcctctgcacctgtgtggtcttcatctcctcttataaggacaccagttgtattggattagtgctcctttaatgacctggttttaccttaactacctctgtaaagacccaaatacagtcagatcctgaggtctctgggggtaggggttcaacatgggagttttaggagaatacaatttggtcataacatggcctgaaagtcagaactgtttgtgaactttgaagacagttgcattgaatgagagtcacagatctgacttaagtcagagaattaccccaaccccagggtggcctttcatcccaaagttgaca

SEQ ID NO: 42964 - DNA, 1057 bp, Homo sapiens
aaaaggagtaagacaaattaatgccgttgtgaattgtgtttatatttacttttctattgccagaaatgagtgtttgcctatatcaatattttcattctgattatacccctcaataaactgaagtgtgtgtattaatttacagtagttgaagttaacaatcttggcatttcctgacaaaggcagaaacatttgtctctagaagtattaaggatacacaatttacaaagtcaataattatttttcctgctatttgcttatatttgatctttagtttttgcctgtatgtatgtgtatattagcctgttcgctggtagtcatgaagaacgaacacacataggccattttcatgctttttgggctaattttaatctgagagatttattcacctcaaagtggtttattttcataaactacctcatgaactcatgaagtctattttttaattttttaagtttttattttttaaccttttttaaaggcagagtcttgctctgtcatcatgctagagtgcaatggcatgaccacggctcactgtagccttgatttcctgggctcaagcaatcctctcacctcagcctcctgagtagctgggacaacaggtgttagccaccacagcctggctaatttttgtattttttgcagagatggagtcttgctaggtggctcaggttggtctcaaacttgtggactcaagtgatcctcctgccttggcttcccaaagttctgagataacaggcatgagccaccacgcctaaccgaagtcttttattactggattagaatttaacaatctgttaatagtctcaggccaaagtatcagtaatttcttctcttccttgctttgctgccctacatattttgcaaggatacctctccatcatctccaggcatgtgactctaggaaatctaagagggtaagtattgctgatcacagcaaagagtggcgctctctcttttttatcagagagaggagaactcacctggacacctctcaaaaccatgcattttgttctgcaaatagccactcatccacttggccagggtgataaatggcttt

SEQ ID NO: 42965 - DNA, 1072 bp, Homo sapiens
tcctcagactagagtgacttagtgtgattttacagcatgtgtactctctctgcctaatgtcgattgctcactacacagagacggttcaagcctgtgttctgtgtaacatctacacctcagggtggcactcagcgcatctttatgaacatgctttgatgtattttgcaggtatatttgttaattgtcttcagtggggaatccctgtcttttttgtttggttcagcctcagaaatagggagggtaagggtgagatggaggaaaggctggagaagggagccggggttatgtcggttgagagaaggcaatgaggcccttggaatgtgagagggctttggattggataccctctggtgcagctctcagtgaggcagaatgagacctcagagggcattgcgggctctcttttcctcctagtgtttggaggcctggagcagggcagagctctgccatcaccatgggattaaaagtgttatcatcaaggcatagtctgcttttattggatagtccaactgtaatgagaaagtggccagatcttagataagaatggaagggtgaggtgaggtggagatgtatcttgtaaccatagctttgggaagggcaatgtttttctccatatctgtaggcaaaatttggtgacttagcattgagggatctggcttagaatagtgaggcgatatcaacagtgcgtgccatgtggacctgaagtcagaagccctgcatggagtctcaactcttccctttagaagtcttgtaaccttgggcaagttcaaccttcctttctttttatctgcagaaggaaggaaatggtaatatgcaatttatcaggttgttgtgagaaaatatatctgtttgtgaatggatagcattcatatccatgttagttttttaaaaaatggtggactattttaaaagtttctattcaataaaatgcttttagtaacataatgcaataccatacaattgtgcaagattatacaagataatcgtagcttttataaaatgttaattcagaatatatattaataggacacaagcttttaaatctagttttatttttattaataccttttaa

SEQ ID NO: 42966 - DNA, 1029 bp, Homo sapiens
ttctttttgttgcagtacatcctgtagtagcctctttaaaaagggtgtgcatttttgagtcctgtttgcctgaaaatgctcttattctctcagtcttgcctgacggtttgattgggaagagagttcgaaattaattatgcctcagtttgaaagcacaaatctctgggtaatgagagatgcgatgactcttagattgtttctttttatgagacctgatcttttcctccccatgaacctggtatcattgtcttaggctttccttgggtctctggagatgaatctcccttctttttagcaccccctttttgacttgctgagcttgttaactttctttgctctcttcagtcagctactctcacctgttctcttccttccaaaagtttgttgcaatctttcatctgttgaagtctcctttcccattctttgtctttgtgggttgcaggcatttcccccacttaaaccctttccttccattggtagatttcgtgagggtaggagaaaaacaagtgttattggatttgctctgtccaattagaagtctgttattattagaaataaatgaaaatggcctgaatatttcactggaaaactggaacataatatattcaaggtcttctatttaataaataaataagacttttgctggataagcaaagagagaacagtgaaaaggaaaaaaggaatggaaaaaggaagggagagagctcagtagaaaaaatatgccttgaggagggacttcataaagacttttcaaaaggggaaaaaagcggaaatctaggccagttctgtctaatgcaggctattcagacactgtagattagggaattattattgataatggatttatcaatggacaattattgtagcatctttttcaagggctgtcacatgtaagaattttatgcttgtcagtctcagagcgtcttaaggacacaagattgtgaaacaaagggatgttgattctgcaaaacaaattccatcctgtcctaggaatggtggttcacctctatcagagagagaccaccagca

SEQ ID NO: 42967 - DNA, 1059 bp, Homo sapiens
gccttcctccatgattgtgaggcctccccagccatgtgaaaaagagacaaagaaggtcattatataatgatgaaggtatcaattcagcaagaagatataacgattttaaatatatatgcactcaacactgggtgcacccaaatatataaagcaaatattattaaatttaaagggagagagaggcttcaatacaatcacagtaggagacttaaacaccccactctcagcattggatagatcatctagacagaaaatcaacaaagaaacactggacttaaattggactttagaccaaatggatgtgacagacatttacagaacattttatccaatagctgctgaatacacattcttctcatcagtacatagaacgttctccagaataggctgtattttaggccacaaaccaagtctcaataaattttaaaaactcaaaatcatatcaagtatcttctcagatcaccgtggaataaaagtagaaatcaataacaagaggaactttggaaactgtacaaatgcatggaaattaaacaacatgtccctgaacaaccattggaccagtgaagatcttaagaaggaagttaagaaaaaatcttgaaacaaatgaaaattgaaacacagcatacccaaacctatgggttacagcaaaagcagttctaagagggaagcttatagcaataaatgcctatatcgaaaaagtggaatgatttcaaataacctaatgatgcacctcaggaaactagaaacgcaggaataaaccaaatcccaaattagtaaaaggaaataaatacctaagtgaaatagagactaaaaaaatacaaaggatcagtgaaatgagaggttttttttgaaaagataaataaaattgataaactgctagctagactaaccaaggaaaaggaagagaagacccatataaataaaatcagaaatgaaaaaggagatgtcctagaattcatatggaaccacaaaaggccccaaatagacaaaatgatactgagcaaaaagaacaaagctggaggcttcatagtacctgtcttcaaaatatactacaaaact

SEQ ID NO: 42968 - DNA, 1041 bp, Homo sapiens
tatttttagtagagatggggtttcactgtgttagccaggatggtctcgatctcctgacctcatgatccacccgcctcagcctcccaaagtgctgggattacaggcgtgagccaccacccccggccgaacaatttattttcatttggatgtattcccagtaatgggattgctaggtcaaatggtagctctcttttaagttctttgagaaatctccgaattgctttccacagtggctgaactaatttatattcccaccaataatgtataagcattgtcttttctctgcagcctctccagcatctgttgctttttgactttttaatagtagccattctgagtggtgtgagatagcatctcattgtggttttgatttgcatttctttgatgattagttatgtggagcattttttcatgtttgtttgttggctgcaaatatgtctctttttgagaagtgtctgtttatgttttttgcctattttaaaatgggattatttgttttttgcttgatgaattaagttccttatagattttcgattttagacatttgttggatgcatagtttgcaaatattcttccattctgtaggttgtttacaccgttgatagtttattttgctgtgcagaagctttttagtttaattaggtcccacttgtgaatatttgtttttgtagcaattgcttttgaggacttagtcatacattctttctcaaggccaatgtccagaatggtgttttctaggttttcttctagaattttcataatttgaagtcttacatttaaatctttcatctatattgaggtaattttttgtatacggtgaaaggtagtggtccagttttatttttctgcctatggctagccagctatcccagcaccacttattgaaccaggagtcctttccccattgcttatttttgttgactttgtcaaagatcagatggttgtaggtgtgtggctctatttctggtttctctattctgttcccttggtctgtgtgtctgattttgtactggtaccatgctgttttggttgctgtaggct

SEQ ID NO: 42969 - DNA, 1274 bp, Homo sapiens
attgtaaatgggattgcgttcttgatttggctctcagcttgaatgttattggtgtctagaaatgacatggatttttatacattgattttgtatcctgaaagtttactacacttgtttagcagttccaggagccttttggcagaatcttaggattttctaggtatagaatcatagcgtcagtaaagacaatttgactccttcttttcctatttggatgccttttatttctttctctttcctgatggctctggttagggcttccataacttgttaattaagctttatgatcagaaaaggtatctgtgaattctagctgagtattgctttctgtaggtgagatatctggctggtatttattttattttatttgctgttaggtataataaagactaaagttttttcttatgccaaaaataaaataaaaagaatagctgagggcaaagaagtacaaatagaggctcaataaatgtgctaattattttttctctgttgaaggtaacattttggaacaaagctagagatgtgacatggtagagcacagagggctggatggggctgatggagtgctctccttacagtgctgaacccagacacaaacgatgctgggaggcctgagcactgggggtcggaagtgtttctaaaggatactggcttgcagagagcaggactctaaattcaggcaagggacacaggaatagtcctttatttaaggatgggggcagaggtagggtaagctgggctcagagatttgggcacaaaggaggtaggagctcctttcccagacatgcagttcaaggtgggagcaagagtgaagggcacaatgccaggactggaccctgcaagccagacccgaggctgaattctcagttggcccacaacaccgacgttgctttttttcactgaccaggctcagggtggctgaggctgcaggggctccaacttgggtggggaggatggtcatgtcatcctagctctaggttgaggggaaatgctgagtctgatgttggagtctttagttgctatctgacctttagctctggcataattacttttctgaggaaattattctaaggtcacttttggttgcatactgagtcagtcggcaagacttgccccaggcctgtgactcaaagctctgttcctgtgcagcataaatacctacatcctaccaggcctggtggaccctcggttgccccttggctctgctccctcaggccttgggccatgctgctgccctcggtcagtccctggctcctgaggagggcttgaagagg

SEQ ID NO: 42970 - DNA, 1060 bp, Homo sapiens
cgtcattctccattaattcttttgttctccttgttaaatcctgattaaattattccttatagtattgtacagatgagatctgcacagatgtattgtggtgtgtgtgactatgtgtgtgcatgaatatcagaatatcactgttgaagtccagattctacgtctgaacagggtgaccagctaagtctcccagagactgctgagtattatacttggctctggggatccaggaatccatcactagaattaatgtggtattgagaaaagtgagtaggtacttgaaaaattggttagttttggggtctgagtctatataccacattgagaattctatgatggatcgtgtaacgaatggtgcaactggaatgaacattatagagaagtagtctagtttgaagctgagtgagagtttgcctttccccttaaggaacttgaaacagaggtaaatactgcaaggtagactgtaagctcctcgaaggcaagaacaatgtcatgtgtaaatttatatccccagtacctagtaccatgcctgacacaaagtagatgctcagtaaatgttttctgattgagctgaatcaataatatacaaaatgttatggaaacagagttgaacgagtcagttactccctgaccacgctgcctccaaggaaggcttcactgaggcgggagtatttgagtcaagactgaaagattggcctgcagtcacaactaaggatgtgaagatatcaaagaagatagcctatctcacatgagaaacttgcaaccctgacaatatataaatcaaatttaaggtcattgaataataacttatgcctgggatcatttccttctgaatgtcaacctcaatcaatcataatgtttgtctgaatttgtgttgagggaaggattctgaagtcttatactagttttggattggttggccaagtttgccatgggtgggggaggattacttgtgtcatacattagccattgccatattaagtctctggactcttcaaagtaaccccttctcctttcttttgactcaactccatatatagacttaataggggccagcattgtg

SEQ ID NO: 42971 - DNA, 1028 bp, Homo sapiens
ccagctacttgggaggctgaggcacaagaatggtgtgaacccaggaggcggagcttgcagtgagctgagatagtgtcactgcaccccagcctgggcaacagagtgagactctgtctcaaaaaaaaaatttgtagacaggatctctctatgttgcccaggctggtcttgaacccctgggctcaagtgattctcccgcctcggcttgccaaagtcttaggatggtgggtgtgagccactgtgcctggcccatttttatttcttagttggaatgctgaccaccagatgatgtggaagcataggtagaggtggctttctagtgggcctgtcctggttgccgggggagacaggatggcttaagggagctgtggaatgcaacggtgatttttctagtgggctgtcctggttgtaggggacatggtttttcagaggtggtttttctagtggggctgagaggtggtttttttagtgggtctgtcctggttgcggggggagacaggatggcttgaaggagctgtggaatgaaaagtgctgtgagcctggaggcaggtgaccggtgtctagattttcaatgaaagagagcactatcaggggattccgtgaatatggacaagcagcccagttagagggagccctggaaagctgtccaaaaggcttattaaacagatggtgggtgagcacacagtgagaaagtggtgatgccggcagagtgaacaagccatgccaagctgacctcattccctttttggatacggttcttagacatactgataggggtgaacagtgtgggcaaggtctctcatgacatccaggtggccaaaagaggaacgtacggaggcagatcagggagggagctgagttcctggcagcggaatgatggcacccaaagtgctttctcctaactgcttgattttgggtcatgacaaggctttgtgtgtgtgtttgggtagagttctgcctccagcaccgccctgtggaaagattttagcaatggcttggcgaggatggggatggcctgctgatgcagcatg

SEQ ID NO: 42972 - DNA, 1104 bp, Homo sapiens
tccagacattgtcaccgtggaaaggtgagcaacatataggacatggacgatgtcccttcctccctttctttctttcctcatcagtggatgtattgagttccttccatgtacaaggcactgtggctgcaaaaataacccttgttcccagcaaatcttccacccaacagtgaatccttgtagccgtggtgtctgaaactgctgcactcacactggaaagcacatacctgggttagtaaggccagactctgcatcccagcttttcccctggctggcacagatgaaggcctggaagcctcttttgtgaaacagggctggtcctagaataccccttcctgaggttgtcatggggacagcatgagataatacgggagcctctggcatgtggtcggcattgaatagatttttgtttgttttaaaaaaaggaactctgggatggaggaaacacacggactctcagaagtggtccagtagtgtgtcctggactaatagagtctatccctttgcctgtagatgggtgaataccaagagaggaaagggccttgggagaaccaaaaaggaagagaaagcctgcctcatccaacagtgctgataggacccttcaaagtaaccgcaagactaaattgtaccagttcgtttttcaagcatgtaaacctgtctgctacactcctctaagtcattgttcttagtttgggttcttccaaaagtagagcttgtgacagggactctgagggaagcaggtgggcaggagctggaagcgtgagactggaaagaggggaagccagtcaagaaggtgaggttgagccagtgactactgtgagcgtcaggttcaattccagggggaccctctgagggactgtgagaaagcatctcataattactctcccaaaggacggggctgttgctctccatctgccacccctgtcacccccttagttgagagctgctttcccatagttgctcagcgtgggctcagtggacttgggaagggagtggaggtagggagggctgctgggtgcttgctgtgggcactatcagctttcccaggagcgtccactgcagcttcagccggaatcggaggtgaacggaggggatgtggcacaggac

SEQ ID NO: 42973 - DNA, 1021 bp, Homo sapiens
aggaaagcccagcagctacttaaatgggttcaggaacatttgggatttttctctcttgaagttcttttacagcttggggaactcccaagaggactgagacattgtcctgtttgcctctgcatttccagcgcctagaacagagctggtgcatacagaaggcaagcagctcagtgcatatttattgaatgaacaaacaaagccttctcaaagttcaggtttctttgccatgctttggggctcctgacctagagctcaagagaagaaaaaaaaaaaacacgacaaggctgccaaggaagtttgaaattaatctacattttgcaatttgtacaaaaatgtaattagattccttctccagaggcaatccattaatgtaatcaatgattgcagttactcagtatgtaacctgaaaaaaaaattgctgatgcctcagaaaaataaacacttgcttagtaaaataattccgcacccagtgccagccatttcctgttttctttttctatttgacatggtatctcctctgcagcattcctatttagagacggaagcaaagcctgctccctgggggctggaagggccctctctgccactgcatctgcaaggtggagacttgctgctgcttggtggaaactgcacagtggcatggctccctccactggcagttctcccacggtcaactagctgggcttcagataactgaccacatgatctagcctaggcagcattgctttttctttctttcctttttcccatcaacttttattttaagttccggggcacatgtgcacgatgtgcaggtttgttacataggtaaacatgtgccgtggtggtttgccaaaccgatcaacccctcacctaggtattaagcccaacatctattagctattcttcctgatgctgtccctccccttgccacccccaaccctacaggccctggtgtgtgatgttccccacccatgtttccatgtgttctcatcgttcagctcccacttataagtgagaacatgcggtgtttggttttctg

SEQ ID NO: 42974 - DNA, 1030 bp, Homo sapiens
aatgaggacaagaatttctgtgattacaaattttacttttaagaatatttctgggtaaaactatttaattgattagattgcattttaataccgaagagaacagtattataaatgagttagatctcctttgcctttggcaaacaccaggatggattttctaggtataaacacacagctgtgtgcactgttttgctattatttatatgaagccaattgctttctcatcctctactgctctgagtttgtgtgtgttccttttgcttttccatgtctctgtttctttcctcctccttgtgatttggtatctgctagcttttgttaagttttctgaaaggtgggtgctgggaaggttgcacttctggacttcctgccttgtgactccacctggtgggaagcccccatgagtggaggttccatgaattgagaacattgtcatgtcctctgggatccctttttttttttttttaaatttatttcatagcttttggggtacaagcgtttttttttgttctgttacatggatgaattctgtagtggtgaactctgggattttagtgcacccgtcacccgagtagtgtacattgtacctaatgtgtagtttttttttttaatccctagccccctcccatcctcccccttctgagtctctgaagtccattatatcactctgtatgcctttttttggttgaagaagtttcctgctttcctggttcatctcatcctaggcaccaacattacagattatttagaatttatcaggttctggcctggcgcggtggctcacgcctgtaatcccagcactttgggaggctgaggtgggcggatcacctgaggtcaggagctcaagaccagcctggccaacatggtgaaaacccgtctctactaaaaatacaaaaattagctgggcgtggtggcaggcctataatcccagctactcgggaggctgaggcaggagaatcacttgaacccaggaggcagagtttgcagtgatctgagatcccgctgttgcactccagcctggggaacaaga

SEQ ID NO: 42975 - DNA, 1300 bp, Homo sapiens
tacttacagagtaatgacccatttccccatgtggatgcaagtggcaaatcttttcattcatgatttcagcatgtatttatcaggttcagtacgatgtttctgagactacgaaagggtatttggagtaacgtccatcctctagggggttgtaacataggtagagagacaagaagatcttcaataaaatgatttaaaagtaatttggctaaatatgtaagacactttgtagcctatatgctaagaattcaaaataagtatttttttaaggggtagagaaaccagagatggcttcctggaggaggcggatcaagaactggatcatgtagagttaaaactggaaaaaatttgtggaggctggaaaagagtgtgtgcaggtaagcaaaggcgtagaggtgggaacaagagacatggtgtaggtgaagaatttgtgttgtagagaaacgaaggatgagatttggtaaaggggccggggtcagagtacagaagggcctgagtgccagactcgtaaatgctgtgcacaccttaggggctacggggctgctgtaggatctgaataagggagcatgtccagccacccccagcactcttttccccattaccaagcattccttctttaaagagcttattgctctctaaaataaacgtctggttatctgtttgcttctttgtagatcatctctgcagctagaatgtgagcaccatggggtcagggaacatgtgtctctgattcgcgataggacttttcccagtatctagaacaatcctgacagaattatatatgtatgtgtgtacatatgtataaatctttcgctctctctttctatgtatatatagagagagaactttgtggaaatagatatttatctttatacatagatatctctctatatataggtttctctctacacacacacacacacacacacacaattcaaatcaagatatatggctatgtagatatagatatttatatatacacagatatagatgtagataattctttatatacatggatatatctctctgtaggtctctctgtctctctatctatataagcttcctggaaaataatgcacacttagaattttttgcctacggttttagactggttacctccctatcacagtagtccatccccagacccatgagggaccctgaaatgggcttaagatcacaggttctgctcgagatgtttgaattcagctgcctccaagcgacatccatagcttctccctctgtcacgtgggaaagggattttctttgggctttcattctttttggcagtagggaaagggaaaga

SEQ ID NO: 42976 - DNA, 1042 bp, Homo sapiens
tggaggtgaaaaatagttggatttgggatacattgtcaagatgttgctgacgtgattggatgtaggatgtgagagaatggaattatcaatttctgaaatgtgcaacactaagaaatgcctatttgacatccacattgggatgctgagttggacagtacaatatttgtatctggagttgaggggaacaggatcagtgtgcatgatattgacagttgtggtgctggacgagatcaccttcaaaggaagcgtacagatgagagcagcccaacaactcgtattgagacatcccaacatagagtcatggaaattggaaggatccaagaaaggagactaaaaaggaatgtccagtgatgtggaaggaaacccaagagattgatgttgcagaagcaggtaaataagatatttcaagaaagacgaagtgctcaactctttcaaatgtagtgaaagcctggatgaggtgaaaattcagaaccagggaaactagctggttgttggtgatcctctaataatggaagaagtaagtccctcactttcttctttctctggttctaacttcaggttcagtccaagctgtcctcctaatagctcttgctgttgagagttatattttcaagatgttgacacaaaaaatctgtaggatctatgtttctgaatactcaaattcaagttatgtcatgtttttcaggaatatgactgttggaatatgtggggattccacagttcgcagctttttaagagctgaatgaccattgaagttttaaaatccagtcctcagatcacagactgctttctaggtattcccactctgactgcaaaaactcccctctgacagtttccactttcagctcctcagctcttgatatgtgtgctgtaagaacagtgaagccagaagatggagcggggaggcaaggcagctaggcaagaagctctacggcatatagtggggtctttttatcttttatttttaaatttttatttatttatttattttcttttaaatctagatggacagtctctgccttttgattggaatgtttcatcc

SEQ ID NO: 42977 - DNA, 1026 bp, Homo sapiens
caaaagtaattgtaccaacctaataatgcttcctctaatctatgagggagggactattactatccccgttttggcactgaagaacttgaaggccagttggtcacaagtctggttccatggatgtcaccatcccaactgggcaggcctggctgtgtcctaagagcatagactcagctctttcccaaatgcactggctctcagcttatttgtcagcaaagggaggttggttcaaaatgcctctaacgtgctctctggctgtaacattcaaccaacttcttcctcctgtggttgcctttgcctctggccccaggaatccagcaaatgtgctttagcccaagctgagagtgaccagtgggaatgaagatatcagtcttccagactggggaagcagacggtgaatttcaagtgcaccagaggaatatgggagtcccagcagtggcttccttcttaaacatttaccatcctgtgtcctgcagcaaggggatggcattccccctggatggactctgatttgcttttaagtgtgcatttctctagaaatctttttttcttattcttcaccttttaattttgtatgtttcacttttcacgtgtcttattgcaaagacaaatgtttgaagtgtttgttgagatttcctgttgttcttcctgaggcagccacagcataagctctttgaccctctacttctcagcacataagctttcttaccatctatcactggagtcaggggtgaggggaggaccgcatgacagttggttaatatacacttattttttggcaaaaacgttttctctgggaccagaatgatcttgatactgaaaaaatttctagtgctagatcctctttctaagtgtgaaaggacttatctggaatgctccagaatgatcccaagtgttgagctgagagggacctggcagcagaatctgattattgaaaagtggcaattgttgatttattgaagacagaataataactcagcagaactgttatgttgagctgaacccgacctccttcagccgaatcat

SEQ ID NO: 42978 - DNA, 2800 bp, Homo sapiens
ggatgtgccttccccctctcctcccaccagatctagacaaaatctgagccttttcaggtctctggcatctctttgaaaatgtccccagacatggacctgtgagccccaccttcagtgctgggcagtgctttatcggggcctgaatagttgaactcatttaaagaagccaactgttctcctattatcctttcactctcttgtgcttcacttatttctttatggtgtttattctaccttgcttcctctcaagatcattttcctaaggaaaggcaaacaaactaagagttttgccttcttattgccatctgtgagcattaaattatcttctctgagcagtggattcatcatttcttgcttgtttttttcccccccaatacgtagctcaaaaattcttttaaaaatgttctagcactttttgagcctgcagccctgctgacagatgccctgacccctgtggcagagctgtgtgcccgtgcggttggggacccctcctccccacatttgtccctgtcacttcaatgctccaactctggcagacagctggtgactgtgtggccctctttagatgcctctactctttttttttttccccctctgggattgtttgtgattgtcgcgctgaaacttgacctttcatgatctttcttgcttgaagggcttaccctgttggcctgcctagccatgggattctacctatttttctccccaataatgttttccattcatttttttctcaagtccaggtgcctacccagtgcctcgctccatcctttattcctcatctgttgcagcttcagtttttcctgctggctccttagcttctacctacaaagataagcagagcatccctgtccggaaaaaaatgaaaaaaaaaaaagatttaaaataagaaaagaaaaaatgatagaaagaaaaaccctctttgattgtgttatcccctctggcatctctcttacatcttccttttgcatttgcacccacattccttgacagtcccgctgccctatcatttgctcccacccactctttccttggtcctttgcagacggactgctggtctcctgatgctttgaaactatgagctccagtgcggttgtccgaagagccgttcccacacaggcagcgaataccaggctctacagtaaagagtgacgttcctcactgtgtgctggttgactgcatttcttggcttgttccttaccttgcgttctgctccagtgctttttcttaccttgctgctgacctagcagttcattcaacctctctgtcctcacctgccctatcagactgacaggttctcatccctctgggctaacagccttggctttcctcccagttttgttttcatttctttcccaattaggctcaatgcattcaaagataaccctggaaaaaattttctcctgctggtctgacccccaggatcttcctgcctatggactattccctgcttgcatgtatcattccctgcttaaaaatcttcaactacttttatgatataaaggatgaagtccagcatcatttgccataagctctggtcgcggaacacatgcctttgccaagacatgggggaaaatagtaatagggtcgagagcaccagctccaaatcactgtctgggctccagctctggctctgctgtcatcctagaagctaaatagccttatgcaggttacttacagtccacaatatgtacctacaggtttattgcaataactctgtaaagtgctcagttcggtgcctggcatatattatcatgacctttgggtgcagtctcagaacccatgcaatccagcttgacttgaaaaggagaatgcggctgggtgtggtggttcatgcctataatcccagcattttgggagaccgaggcaggcagatcacatgaggtcaggagtttgaggccagcctggcaaacatggcaaaaccctgtctctactaaaaataaaaaattagctgggcatgatggcatgtgcctgtaatcccaactattcgggaggctgaggcaggagaatcacttgaacccaggaggtggaggttgcagtgaaccaagattgaaccactgcactccagcatgggtgacagagagagaccctgtctcaaaaaaaaaaaaaaaaagaaaaaagaaaaagaaagaaaaggagaatgcatcaaggtgcagggctttcatggggctcccacacaaggagagcagcctgaccccagagaactcagatcaggatggaaatggaacaaagttggccaggcatggtagctcatgcctataatcccagtgctttgggaggctgaagcgggaggatcatttaaggccaagaattagaggccagagaccagcctgggcaacatagtgagaccttgtctctcctccccgcaacaaaaaaagaagaaagaagaagaaatggaacaaggcaggggctagtatggtcccttctgtcctgatagctcatctctgcctgtctgcatttgtctgcttcattctactcattctgcagactgtctttcacttcttttggttcttaggagcagatggtctccttgtagctcctgagtttctgcacccatagagcagcagaccagcagataatccaaatcctaaactcttgggagaaagcatctgtttggttcagtttttgtcatgtgttcaccccaattcaaacagctgtgctggggtgaagtgtgaatggtcacttagaacaaatatggttgcaggaactgattctgaggacagagaaggaggtgtggcttactaacacttaaaagacatttactaccttctgtcttcaatctcatggcttagtgtgtcct

SEQ ID NO: 42979 - DNA, 1397 bp, Homo sapiens
tgcaccaccatgcccggctaatttttgtatttttagtagagatggtgtttcaccacgatggccaggctggtctcaaactcctgacttcagatgatctgcccgcatcagcctcccaaagtggtgggcttacaagtgtgagccaccgcacccggccagatcttctttttattgaattctctgactactgctctgtggaagtgttgagcctgcaatagtgagattgccagggtcatggcaaaagggtcctgtgaaataaaaatgttacagagacctataggtccaccgcaatcccagagattgttctatttttggaggcaagactagggagaaaccaaatcactcttatctggacaggaggactcatctggggtttggagatgaaacacacttgaaatggcctcaaagatacaagacctgactttagtctatcatactggggacccctagaaaaggacccacctgggggctcctctgcttttcccagacatggccagacctgagcatcttccaggtagtcacctgtttccagctcttcctctctccctggaaggcctgcaattcactaggagtatggtctttggcattcctttcatttagaatgatatacttggctgttaagacccctgacttgtgcctttttgtttgcttgctttttctgggtaaaaagtgacttttggaattggaagtactaaggagcttatgcatgacagctgtatctgcaggcccctaatgatgagggggaagtggaatggtggctaagagtgggatgcaggcagaggaaatggaaaaaagaaaaggaagttgagaccatgggagagctaagaatcaagaatgtcagcttcactcaattcagtcttctgttggacattcaccaggaactgcttgatgttgttctgcatgatgaacaacagaggttctctttgcttctctctaatttgttattgggagggcagaggagaaagttttgtctatagcagaaaggctttatgtgtaatgcttgtcaggtttacgaacctgtaaccagcaccatgcctggcatgtagagagtgagtaggaagtctttataaacctataataatagaaggcatctcattgtcccatcaaaaacgtaggaaacccaaaagaatatgaagttgttatgttgttatttccttcttaagcttttaatttgaaaggtagcaaaggttctgctgtttgacatttctaccccctgcaattctgtcaggagaaataggtcacatcatggtgggaagagcagagaatttgaatggggagacaagggtttgagtcccaagtttgccacttggtggtaagggatgttgggccagtttgctactctctctaaactgtgggtaatggttcttgctcactcccaaagtgctgtaagataaaataaa

SEQ ID NO: 42980 - DNA, 1064 bp, Homo sapiens
tctataacattctgtggtagagatttgatttgtatccccttttgaagatgaagaagccggggaaggagggatgaataacttgccccaagtcacacatcaaataaatgtcaggggcagaaacaagactcagattctctggttctaagacccaaactcttaccatctgcctactatgaagtggaactccagctgaaagagataattctgagtcatcagacttgtagttcagtggtcagatgagatagaaccagtctgctgacaggtggggcgggaagctctgtgggaaacattggaaatgtgttgtacatttttcacctgtagtttcaaaaaattttttaaaagcagaaccatttgtgtgtaattttttttagagacagggtctcactctgtgccccaggctggagtacagtggtgcaagcatagctcactgcatcctcaaactcctggactcaaaagatcctcccaccttagcctcccaaagtgctgggattacaggcatgagccactgtgcccggtctcaacacatttttctgtagaaccccaatatgtaaaacagatacatgtggggctgctttggttgagagtggggttcagggcctgaaatcccaccccagttggtctcctatcaccgtagagtagctccccaaagaacacagcatgaaaaccatgcatccggcccaaccttcttgttttaaagatgacaaaactgagttccaaagaggctgtgcaacctgcccgacgctgggccatgagctgggtggggaggggccaggaccccggctcctgaatccccagcctttgttgtaattggccacctttgtcatatttgtgtttcccaatttaacattacagactgacccaaaaacacagaagtcaaacaaacatggtataaagccatgctgattactgagtactccaggggaggactcaggaagtggattaagtgaattttttagaggaaaggagcccagagcttcagcttgaactacaagaggctttattttgttgtcaggaagagtaaaacacttcaacaaacacattttattttttatgattgcaacaat

SEQ ID NO: 42981 - DNA, 1065 bp, Homo sapiens
acaggccctggtgtgtgatgttcccttcctggaacggtgattattaagaagttaagaaacaacagaagctggcgaggctgtggacaaataacgcttttacactgttgctgggaatgtaaattagttcaaccattgtggaaggcagtgtagcaattactcaaagacctagaaccagaaataccatttgacccagcaatccattactggatatatacccaaaggaatataaatcattctattataaagatacatgcacgcgtatgttcattgcaacactattcacaatagcaaagacatggaatcaacccaaatgcccatcaatcatagaccagataaagaaaatgtggtacatatacacatggaatactatgcagccataaaaaggaatgagatcatgtcctttgcagggacatagatgaagctgaaagccattatcctcagcaaactcacacaggaacagaaaaacaaacactgcatgttctcacttatgagcgggagctgaacaatgagaacacatggacacagggaagggaataacacacaccttggcctgttgggggatggtgggagggagagcatcgggataactagccaatgcatgtggggttgaatacctaggcgatgggttgatgggtgcagcaaaccaccatggcacacatttacctatgtaacaaacaggcacatcctgcacatgtatcctggaacctaaaataaagttttaaaaatgtcccatttaataagtgaaaaatggcctcttgttttaattttaaattagtagaaaggttaattttttcatatttgatcatctatttacatgagtgcttttatactggctaatatgctttgctcttttttcaattagattgctggttttctaactaatttattagagtttcaaaaatataaattctgaatattaacattgtaatatttgctacaaatttgtttctcatcttgtactatgaattttatattagatttagtgttatttgctattttattttgtatggttaaatctaccaattctcttctctgattttctaccatttgtctttatgcttagac

SEQ ID NO: 42982 - DNA, 1041 bp, Homo sapiens
aagattggctggctggtggggctgggcctatttctctgcttggcaaattcagaagcttgatttaattgctcacatttttctgagggggaaattgatattcatcaaacctataaatgctggttataaaagcagcattccgttgtattaactcacagttaacttacaaactttaggaatttgtatgtttatatccatttcctaggattgtatgtggaaggtatcaaggcatctaggcaaacgaattctaagtcagagagttgatttatgatgattataagtgaatcagagcagtgatctagggggagtctttcaaactctgggacagcctggaaaaattgcctctggactgctgtgtgtgtgtgtgtgtcatccacacacttacacacatacacgaatacaacacacatttcccacacgtttacctctgacatttgcaagtatctattgagtacctactaagggctgaggacacaggcactattcctgctccatggggttcatagacaggtgtctgttttcgatgtcattgagtaaatagtagcaaactcttattcatcaagatgtttttcctaactccctgcagctggacattttccttgtcttaaaactcatttcttaagttggtatgtttataaaactggctgttctcatcaattttgtgtcactttatttttgtgacacacaactgcctctcctgcagttttggatgctgctggccttgcatgcaggtacaaacactccagtaatgggaatgatggttaggcatttgccacagttccccagttctggctttggtgctggatatccttgttcaactcagatatatcaaggaagatgacccaaactttccaatctaaatatttccttttttttcctttagtagacatagaccatgtgactgtgagtttatcctacatctgtcttgaaactttgctgtattgcatacagaagcaagaagaagctcctgttaaagcagccatggtcaaggcaggaagtgccattgtattcaaaagcagcatctagtagcacagctgtttttgg

SEQ ID NO: 42983 - DNA, 1049 bp, Homo sapiens
aatgttgagcctgtaaagataaagtatgatgatggctggccattctttcttataacccattttgagagtgggaatggggctgcgaaatcaataattgggtgttttaatgctacaaagcttggttgttcacatatccaagctggcttgaattaatctagtggggggaaaacccaagtgtttggtttcaggaaactgttcaagtttttatttagctttcatttctttgaatacgtgttttatctgattttaaaacttttcactcacactaaggtaaataccatttgtcactcaatgagaaataaagatgtattggagactaaaatattcctcatctcttcaaacccgtgctgtgttgcccagttgtttgatagctaaacctatgccaccccttcagaagcctgtaccaagacacttagaattttgctgctttaagtctgtctgattcacagctcatcttgatcttacaatatctgctaccttatagagagcaacaacagttctatcacatgtgctaagaataatactgtcgaatattgttaaactgctaggaatcaacttttggaaaagagctaaatgaatgtgtgtttcccatgttgtctcaattcagttaaagagatctttttttaaccatatgtgccagaaatgcttaccttggatccaagcttgaatatgagatatttctgccaaaaaaaaatgaacaatttttaccaagtttcaagtgattgaaaaaaatagtgactgtgatggttggagagaattgtcaaaaactgcaaaatgtgattctagctgatctccaaaaaagcaaagtacaaagcagaaggcttagaagtagcataaaatcaagagatttggcaatcctagtggaccactgtatttagaacaagagtataggagagtcactctagaaataaattggcttttaacgacctgtctcaaaaagcagtgatttacattaggtttcctgtaggaagatagtgcctcattgacagactgcacagccctggccagaaccttctggccatttgtagcactgagcttgggcccacagg

SEQ ID NO: 42984 - DNA, 1150 bp, Homo sapiens
atataggtcagtgcatactttgtcattttgacagtgaggcccatggggctcttataaagccttttagtccactgcaaacaaaaaaaggtggaaaatattcaaaagagatccagcagatagcataaaatggtttgatttttttttttttgagacggagtctcgctctgtcacccaagctggagtgcagtgacacaatctcggctcactgcaagctctgcctcccgggttcacaccattctcctgcctcagcctcccaagtagctggtactacaggcacccgtcaccacgcccggctaattttttgtatttttagtagagatggggtttcaccaggttagccaggatggtctcgatctcctgacctcgtgatgcacccacctcggcctcccaaagtgctgggattacaggcgtgagccaccgtgcccggccgatttgatattttttaaagcgaagttatttttgaaaatctgtgatagaaattagagcaatagaggtataacaaagggaaggaaagtagaattttggtcatgatgtagttaaagcctttattaataagtctattttgtttaaaagtttattataatcagcggagaaatgctgtagattagtcaattatgtaattgagcattctctgaacttttatttattctcaactttgttttcttccctgtcaatcaaagcagcatataaaagcaatctttggggttcgagctggagggcactcttattctggccagaaacatcttattaaaatagttaagaatgaaaacgcctggaaccctagagtgcctgccctctatttgatattggatggggatgggagaaaggcaggggtgatgtctattttcttaccttatttagaacaaaagaaaaagaaaactccctttttagtgatttcagacatcagtaccacaatggatggcttaactgtgagtgagtttgggacactgtatgcagtatgaatttgcagggagggcagtgaccaaactgtccccctggccagccactggcctatgcagcagtgtggtgggtggggtatgcagagggtatggcagctgacttgataattccacctctcactgtcaaaaccacttcaagctggccaatgatgacatctctgcataaaaagtcacattattttatattttag

SEQ ID NO: 42985 - DNA, 1052 bp, Homo sapiens
tctctttctttgccaagctacagtaaagatggcaccgttgtagtgaatgatagagttatcacacagcaagctgtgttgtgtgcctcagggtcatgttatccttgttatgttcaagtattaggtgattttgtcattctctttaccctgcaatgggcttggtacagatggttcgtgtttcacagaaaatgcaaaaggagatctcatgtgaaaacgaacacttatctctcgaagaaaaaagttaaagaggttagtttaactactaactcaaattataagtatttactaaaaaatgcttactgattgttttatactaactaccatttttaacattagactggcatttttaacttttaaactttaagagagttgttaactaaatgagacctgcaatttgggcatgccgtcaccagttcttatcttccaccaccttataagggacttataaaaccttataaaacttttgttttgtggcatatgattcagatcttatctatgaaatttatatttatttaatcctagtactttgggaggctgaggcgggcggatcacgagagaccatcctggctaacacagtgaaaccctgtctctactaaaaatacaaaaaattagccgggcgtggtggcgggtgcctgtagtcccagctactcgggaggctgaggcaggagaatagcgagaacccaggaagtggagcttgcagtgagccaagatcatgccactgccctccagcctgggcaacagagcgactccatctcaagaacaaacaaacaaaaaaaaccaaaaaacaaacaaaaaaacctctttacccaaatagatgaatataaaaaacagtaaatcatgctatagaaaattggatagagaaatactaaaaaataaagacctaggtgtaattttggactattttcaacaacttttacttcaaccctgatgttatcaccagacttccttctttcctaatttatctaaatgttacctggaaaaattagcccctcttaggacagtacctaccttcagggcttgacttatagtcagctttgtgtaagatttgttaggac

SEQ ID NO: 42986 - DNA, 1050 bp, Homo sapiens
ccagtggttggatcactgattttcttaaagaggggaagaagctataataacagtgtcaaggccttttaattcttgggtgaggtagggtgggcatgtgctggataggaagaacaaggcagagccagggcagaatgtagtgttaaactgcatggtcagggtaagcctcatggagaaggcagccccctcgttgtttatttactgagttctcactatttgctgaaaccctgaggaagaatccatgcatccatccatgcatccatgcatccatccatccatccatccatccatccatccatccatccatgcatgcatccatccatgcatctatctgtccatccatccatctatccatccatctagtaagattgagtgcctcctatatgcctgacactgtgctgggcttgaagttacagagatgaataagacacagtatctaccttccagatgtcacaatgaaccgaaaaaacacaagaaaaccagttgattacattgtagagctctgtcttctagtgtcctttcattcaggcccagctgaactcttccttccttcaccaatgaggccttctttgaccatcccatcgagaaaagccctctccatgcctttctaatccttgaccagggttaatttcactctatggtatatatcactcctggcatcgtaacatgtttatttgtattttatcttcccccactagaatgtaaggtctgagaggagggacattgttttgttcagggctgtatcattattgtccgaaacgatacctagtatggagaagataattaatatttgttgaaaacatgaataaataaatgaagtgctataaaagagggatatattaaatatggtgctgctgaccttgtatctcctaacatagcagtgagcagaaaaagcaatattcacatagaatctcctgggaacagtgtaagggagatgattaaagtaatgttattatagtaagaaaatgtaatatatgtttaccaggttaaattttttaattttaaattacaaaatatttcagacaaacagaaaagtgcatcaaatggtcatat

SEQ ID NO: 42987 - DNA, 1202 bp, Homo sapiens
cctgtggcctgacacttgtcttccatctccacatgtctcacccacaactgttctgtttctgggcctctcatccacccactcttgctctgttcttctgtcacagaacccagaactcctgcagattcctcctcgccttggtggtcatcctgtcggccactccccctttcccgcaggcagcccactccctcactctctccccacctgcactgaaacctgccttcgtccacttacctgctgtcacctgctctggctgccaagccgcacaccctttgagctttcatcagcagattctggggtgtgtgtgtcttcctgggtgtgaggttgtgaccgcagatgacattatacgacatgtctgtcagtgaagcagctttctttactcaaatagtattatttcagcttgagcatggtatcaggtggctgtaaagttcctggaggttaggaggaggaagcccaggtgtgtctttggctcctccagacttgccagaatgccaggctcatcgtagggtctccgtaagaactcgccctggaccaccccactcatgtcactaatagtcaggcttcgaatggagacatctgcctgagataaagcatgtgcacgctttctactcaaagaagacggtctctaataataccgcctgttttgctgtgcatatcactgtgaactcactaaagattgatctactttcctctaggtaaaaaatattcttgtcactttaattgattcatgctgaattcttctaaacaatgagaaagtagattaattctttcttcctcctgaggttgttttgctcccctccctcagcctccacacccattcctgcccgtcagaagactcaggttgtgatctccaaaacctaatcctagaaatggttaaagagctaattgaaaagtactagagtaataactactccgggttggcattaattttttcccaccaatcactgcaacataagtggtgagcactggctttcacatgttcaactcctttgccatttggaagttacatgatgctggatgttttatacacagtttggggctgatttatatagggtcagaagacttactctcatttccaaagatctacatacataaacaaacaaaaatgagttaaatcaaataacctggagcttcctgaaatttttattaaggaaggtgcaatgttaccactttggcaaactcatctgcatgagtagtatcctggg

SEQ ID NO: 42988 - DNA, 1031 bp, Homo sapiens
caagcttttagtactgagggtcccaggtaaatctgctttcttggggacatgcaatctattttttaagtggcaaaaccatcctgtaagatacagtgttagcatcacagaaagatctggggaagctgctgttctaaaagctgcctcttgctgactgcggcaccttccaggatggagcaaattcatctcatccacagatcaggtcgccttcttatttgtcctggtgcgttgttacttgtgtccataggtaaagccatgtcttcctgaaagagtctggggaaaaaacggatgtccacataccttgtgagtaccattaggcactaacagaaggggctggagaacaaagccactaagagctggtccctcgaagtgtggtctttcttgaagatgactctctcaggggtgggagggcactccctttcttctctagttagggttctttccaactgggttagacacagctatgggagtccagaagtcccaggcagctgccatctgctgactgtgagctagggactagggaaggagcagactagaacagaagctgcacttcccgcctctttgctcagcagatagagcaaactgagagcctggggcatcaacccaaaaatgatgccttgacctctagaaccctgtatgtcagagagacatgtcagcaccacccctctcagaacctggccagtccctgctctctaggagttaatctttaggggttggcctgttgaagaatttggagagtaagccacctgtgacagccatctcatagatagagcagagcaatcagccactcgaaccatagagagttatcacaaagtgggacagaaaggccccgtggccttagctttcacccaggctcaggttgctcacccaggctcaggttgcaggcatctataaccgagcaccgacaggagcctgagggttaaaatggggctacaagtgagaagggtggggggacaacatcagcagtgcctggagctggccaggcctggatgtggagcaggtacagcaggaagaggcagcaagaatgaagaagg

SEQ ID NO: 42989 - DNA, 1031 bp, Homo sapiens
tgcccaggctcgtgtgcaatggcgtgatctcggctcactgcaacctccgcctccggggttcaagcaattctcctgcctcagcctcccgagtagctgggattacaggcatgcgccaccactcctggctaattttgtatttttagtagagacagggtttcttcatgttggtcaggctggtctcgaactcccgacttcaggtgatccaccgcctcggcctcccaaagtgctgggattacaggtgtgagccaccacgcccggccaatgttcatatttttagttataagctgcacagcctagaaatcccatttgtccaagtgacatggattgaatgctcagtgctgtgtgggataccaaaggagacaccaccacgccagttcttgagaaattcacaggctggctgagcacaagctcaaacagaggataggaggtgcaattaattggtagcttgctgtttcggaccataaaaattttaaagattcagaaaaagtgtggataatctcgtgctaggcatacttggggaagatgtcttgggagattcaggactaggattagaacataatgggtaatttcaaagactgtgtagactgcatggaggatgagaatttcagactccagtctaggagacaggacaatggcactttgaccttagtaaattcccattgtaatgaaaccctttgaacacgctgccaatgtccccttccatttgctcagtccttgggatggcttcagaagtttgtaaaggctctagcttcagtgtagagtcttccagggccactgatcttgtgatccaatctaaacttacacccaaaagaacaaatggattgaagggagctgagtgggagtgagcataattacctgggtgagggagaatagatggagaaaaaaaaaaaaaaaagaacacaagatgcctaacaggtattattttctgtggctatgtcagatgcatgttctggctagaggatggccacaaggtctggccacacagatattcttatttcatcctgtgttgcaaagtaatattaataagccaa

SEQ ID NO: 42990 - DNA, 1027 bp, Homo sapiens
atttttcaagggcaaaattcctgtgtttccatggccatccgtagatgtgtaaaaaccaagggagaagactccaggttctaggataggaatctggatgtattctctttggaagtgaggccagcctctatggatggaccagtccctgtagtcgcttgagttgggatgctgtgttgctgtggaaagctcacacctgggtgcagagcagtcgtgtcgtgtatagacacagcctcaggaacacaaaccctgcttgccccagaggcttgactcccgagttccactcctggcagagtcctcctggagtctttgcacagcttgcagaatgatcagtgatttttgccccaactcagagccccatcccactcagcatgttatctttctgaacacatccaccctcccctgcctcatcccgacaaatccctaaggcgcctttgatgtaaaaccctgtgacctgcctgttgagtgctgatgatgcaatcgtgtataattcagcagtaatttatattccgtgcaggtctgaacaaagctgtaaaatgctctcgagagctaaatgcggctgaagcatttaatctaagcaaaggcagggttttgtatcatctacttcccaggacggatgtgccactgttgaaggaggaggccctctccttctgtttgctgatttggttcttgttggttttaaagattggagagggaatagagggaggtgtctcatggaggacttggctgcttcttctctgacctccctgatacacagccacgtgggtgtttctgcagagcctgccttgcagcgacctgtagggctccagtcagaacataggccctctctccacatagcaacaagagaggaagccaggattggggatccgcagacaccgttccacattcctgggagcagaaaatgtcacacagatggatatctggatctagaaacctgtagaaattgtgcaccagtgaagttgtgggcataacttggtcacataaggattagatatttgggcaaatgcctgtgcacacaatgtgtaactgccct

SEQ ID NO: 42991 - DNA, 1093 bp, Homo sapiens
ccctactctactaccttgagattcaggaaagtgaggtattctacctagagagaggtcccatatctttttctccttattttgggagttacggtttcttcttctgtttccgtttcctctctctctactcactcctactttctcctgcatcaactttggtcaattaacatagacaagtgattcatctgtagagaggctcctagactccaagcagcccccttccttgttcattgtggctgtaggttttataaggaggtctgtggctccctggcatcaaaatatgaaaaataaaatctgtgcctgttccagcttcaatcctcctccaagccttagcttttcaacaaccctaccctttcaacttcagggatcatggagtcacagagactggacaactcctccaaatctagacaaagactttcttaagcgccctgagcccaggtgcatatcttcccatcagggatgagtggtcccacctagcaatgcttgcctctcctgtgacaagagggtaggatatcctaggactctgagactgggccctatatctcaatattcatccacactcatgataagatgccggaaatgaatgcactgtgtgtagctgtcttgatttagtgggaggatgtgctgcttaggtctccaaagatgcccacctgggtcaaattcagaataatgaactcaggtacatcacccagaggcatttagaatggactctctcttcacctggattatgtgctgagtgttaagtgatttttcaaatatctgggggaaggagtgggaagagatacactctggtcatcctttggtgtggtttgtgggggatacttggttgattcttgtagttaaagtgaagttgcttttctgaaaatgttccctgtcttcaggggacttacccatcccaggggacacatccatcccaggggacacagccagccctttccagggaaatacgatgtttctgagtgagaggtgatttcagtgcagataggaagagctggtgcacaccagcagggttgccttccatgccatcttccagctggtgtgggatagactaagggggcagatttttaagaaccccaccagagttgacatacacacg

SEQ ID NO: 42992 - DNA, 1059 bp, Homo sapiens
tatgtcctcacatttcaaaaccaatcatgccttcccaacagtcctccaaagtcttgactcatttcagcattaacccaaaagtccacagtccaaagtctcatctgagacaaggcaagtcccttccgcctatgagcctgtaaaatcaaaagcaagctaattacttcctagatacaataggggtacaggtattgggtaaatacagcctttccaaatgggagaaattggccaaaacaaagggtgttacagggcccatgcaagtctgaaatccaagggggcaatcaaattttaaagctccaaaatgatctcctttgactccatgtctcacatccaggcaacactgatacaagaggtgggttaccatggacttgggcggctctacccctttggctttgcagggtacagcctccctcccagctgctttcatgggctggcattgagtgtctgcagcttttctaggtgcaccgtgcaagctgtcggtgcatctactattctggggtctggagaacagtggccctcttcttacagctccactaggtggtaccccagtagcaactctgtgtgggggctccaaccccgcgtttcccttctgcactgccctagcagaggttctctatgagggctctgcccctgcaacaaactttcacttgggcatccaggcgtttccatacatcttctgaaatctaggttcccaaacctcaactcttttttttttagatggagtttcactcttgttgctcaggctggagggcagtggcacgatcttggctcactgcaacctctgccacccgggttcaaatgatgctcctgcctcagcctcctgagtaactgggattacaggtgtgcatcaccatgcccagctaattttatatttttagtagagatagggttttaccatgttttccaggctggtcttgactcctgacctcaggtgatcctcctgcctcagcctcccaaagtgctgggattacaggcatgcgccaccgcgcctggcccaaatctcaattattgacttctgtgcacccacaggctcaacaccacatggaagctgccaaggcttgg

SEQ ID NO: 42993 - DNA, 1055 bp, Homo sapiens
tactttgtgtcagtgagtcatatagtatttgtatttttgtggttggcttatttcacttataatgtctataatgtttatattatctttaccttttcttttttttttgagacggagtcctgctctgtcacctaggctagagtgtagtggtgtgatcttggctcactgcaacctctgcctccgaggttcaagtgattctcttgcctcagcctcccaagcagctgggactacaggcgcgtgcaccatgcctggctaatttttccatttttagtagagatggttttttttttttttaaccatgttggcccgctggtctcgaactcctgacctcaggtgatctgcccgccttggcctctgaaagtgctgggattacaggtgtgagccactgcgcctggcctatattatctctaaatgtaaagatatattctttacgtttaaagaggtatggtctttacatctgtcaatggacattttggttgcttttacctcttgactattgtgaaacatgctataattaacttgagtgtacagatacctcttggagatcctgtttttaattattttggatatatgcccagaagtggggattgctagatcatatggtagtctatttttaattttttgaagagctttcatactgttttccattgtggctcatcattttacaatcccacaaacggtgtacaaggttttcagtttctccacgccctcatcaacacttgttattttctgtttctttgatatgggctatccttatgagtgtgaggtgatatgtcattgtggttttggtttgcatttttctaatgattaaggaagtcaagcatcttttcacatgcatgttggccatttaaaaatctttggagaaatgtctgttcaagtcctttttccatttttaattgagttttgttgttgttggcctgtaggagttctttatggattccagatattaatcccttgtgagatatagaattttcaatatattgtctcctattctgtagctggcctttttacactattgatcatgtcctttgatatatattgtttttagtttcgttaag

SEQ ID NO: 42994 - DNA, 1044 bp, Homo sapiens
ttgggcttgagctggagactgtgtgcctacaaggttttgcccactgctgcttctacttttttatttcacagagtttcctaaatttgttccagctctaggtaaggttaaatccttctcctatgatctggattttcaaattccccagtggggatgtgtgttcagaggtgggttttcccccctcacactttggggaatcacggtttttcgtctgtcttgcagcatttgcaacagtgtgttgcttctttcaaagcatctgtgaattctttcagttttcctggtacattcctgtggtggttcttggaacaaaagatcacagtgtgattctccacacactgttctgtctgtccaggtgggagatgcaatgcacattagccctgccttttatctgtcatcttgctcccatctctgtcctttcaaatgggatcagggtgtaaggatgttgggattctcctggcccttcagtagctattccaaaccatttatcttccatcttatacatcttccatccttcaagacttttatctggctatccaataaaactataaatcttccagccttctgggatctcagttacattcagcttaggctttggcgcctggcttatcaatgccattttctttctaagtcctgttatcttcccggacaccctgagtgtccatgtggatgacctacctaacaacttgcccccactttccttgacttcttctgtatctgtgactttgacccactactccaccttcttccaacttcacccccttctcattggttgaatgctaaactttatcatcacttgctcctgttccacttctgaaatatggaacttcagtatcccattctgtcattacggccttctattattccagtttttcattccattacttctgctcttcagtgttattaggatttcttgtcccttggctcctctgttttcttcccaatccatcactcttccttgcttttcatctttttcatatcgtagattccttgatccaacacatcatacgttcctcaactccatttttcacatgtcattcctgggctttt

SEQ ID NO: 42995 - DNA, 1070 bp, Homo sapiens
tgcatagctgtgcagagccatatgggagcctgaggcaagaagaaaaaccagtgatactggccctgactttatttaaaattgtgttattatattcattataacttttttgcattcatttttgattttggaaaatacctattaaaatatttatctccagtactgtattttttggcacacctttaaatggtgcccttgaggcaagtgcctcatcactgtgttctagccccagccatgagttgcttaatttgttcctctatccctcctgtgtcttgtcagctggtgattagatccacattctggagctttgctattcacagtgtggtcccgcagcataagcatctcctgggagcttcttagaaatacagactcttaggccccatccagaacctactgagtcagaatctgctttttaaccagatccctagatgatgtgtttgctcattaaagtttgagaagtactgagtggagccataattagattccagtgcaatttatttggcaaggatgcttataggcctgtggtgaattgcttattgtataactttaagaggcatatattgtctaggtgtcctgtttttggtgatactaagattgatcagtagatcctcatgtgatcagcttgacccatccatgaaagttaagaaggatcacttcttagagttcactagagcaaaatggttaagaaagggggctctagagcccaatagtatggatttgaatcttgactttacacagcaaagcaaccctggatagttacttaactgttctatgtttcaagtctctatctgtaaactggagataatagtagtacccatttcactggtcatgcagattttttttagaacaatgcctgacacaaagaaagctctcagacagaaataacacttcttttcttcttctttagtcttttccctcctcatcagagaaagcatccttacaaagatatcatttgagttaagtcctgcagaatgagttggacagtgttctaggtgatattaattacttaattataagcagaaaatgggaattcactccatatttttggagagtggcaaagaattagacttgac

SEQ ID NO: 42996 - DNA, 1029 bp, Homo sapiens
gcccaaatgagaattattgctgtattgaactttgttactaatgggatattgtcatatatttgtttcaggggtttcagggtgtgtagagaggttgacaagcattggactagataatttctaaggactcttccaatctgaaaaactaagatttccaggaaatggaaattgggcttagatgccttttacaaaggcctttttttttttttttttttttttttttttgggcctggctgcttctagggctttcaaactttcacagaaaataaaaataattatagtaaaaacagggattttagacctgaaaattgctgtaaatatttggaagccatggttaaacagtgggtaaattcatatctctggggtgaatcacaatctcatgtaatgaggtaaaacatattttggcaaaaggctgctgggaggattgactttattgagacacaagatgctgcagccctgtttgtgttggttcattcctcattccttggaatagctattttgtcaatttaaatgctgaattaaacaatgaacttgctaactatgaacttgacttcctcccttctttccttaatgcttccccacttcttggaacaaaaatgctcttggcttgctttctattaatattaaatatgttgatcgttgccttgttaaatataccactaactaaagaaattcattcagaggagccatttgtaaaccaaaaatatatcaataaattttcagtgccaccaaagaaatagcactggaacatacatttaattttctcagcaaggcaatttttacttctatagaagggtgtgattcatggatggagcaatggtgagagcacacctgaacaaggaaggagaagggattcttattcctgatgcaggtagcccctactgctgtgtcattcccttgttgtctagggttggaccacacagtctaagctaattccgatctgctattttaaagagagcaggggtaccagccagagtggcagggtgagtagtttggcaggaagggcagttacagaacaggtaactcaggatg

SEQ ID NO: 42997 - DNA, 1035 bp, Homo sapiens
tttgcttataatacactcaggcccttggtttgagatattcttttggatggttcttgtgaaaatttgtgcaagcctctcaatttctattttaattcacaataagaagtgatttgtgttctatatgccatttggtggttctttttagtttaaagaatattgagcttggcctgtgcataactatacgtgttcctcattagctgcctttgtagctgaatataaaatgtctcttctataaaatatccttaaattcttgtataaagtatccttaaggtcaaaggatacagccttagtttaaaaataagacagaggactgagtaaatgtggatataaaagttaggtgtttgacattgattgaaagtactggatttttttttccttatgtaatagttgaaatatttgagtaaaaggtcaactaattggtatgttttaacattagtttgactttgagactatgccattggtggaagagattgttttgcaacttctgtgtccctggattcctagactgtgtttttgaattctgacctgaattggacaagagttcactgtcagaatgatatgcataatacttttgaaatatgcaaactctttgaaggctgttttttctcttcttataagacatcgtgttgtttccttttcctcagaatttacatgtctacatttggggcaggtttattcattcgtttgtgcattaattcatcagatacttagtaagtactttctaattgtgccatacataatcctagaggtcaggggattcaaggattaataagatttggtatttatttttagaacgcttccagtctagtcctgacaacagtcttggaagtctctaatcaccatacagtatgaaagtcactaacagagatgtgtataaggtactaggggagcacagagagggcatgactgtgcctgggagtttcagactagcttctggtgaattagtagtttggtctgctttgttatgttgtattcctagctcctccacctgtgtctatcacacagtaggtgctcaatgaatacttgagtgaatca

SEQ ID NO: 42998 - DNA, 1103 bp, Homo sapiens
attttctctctggtaaggaattatctttggtgaagaattttaaatggtaaagctttagaatttgtgagatttagttaagaagaaaaggaggcaagcataaattacaaggaattgtactatttcgaagatgcaggactctacttgttgaattttaaatgagatatatgtgggtaagtacatacatgtgtatatagtgaaaacctctcttactgtggttataagtctgttgaccaatttctaatattgtacacttccaggaaatcatagaagttaaaaaggatcatttagtctagtttaccatgcaatgttgaaccctcttttccaacttttctgtcatgattttccagttgtttgcccccgggggtaggagaaaggggaagaaaactaacatatttgagtacctgtaatgtggcaggtatgagagacccaagtatggttatgtgagactgatgtttgtttcttcaatgattggtgaaactcacagctaaaaccatctggatctggagctttccttgaggggagattttcttgtgtgtgtgtgtgtgtgtgtgtgtgtgtgtgtgtgtgtatgtagagacaggagctcactatgttgccaaggctggtcttgaactcctggactcaagtgatcccccccaccttggcttcccaaagtactgggattataggtgtaagctaccatgcccagccttttttaccttttttaaatttttaatgtacattaaatttctttaacagttctagaagtactcaggtttcattcttcacttaatttttgtaaggtaaattcttcaaggaatttgtttcatctaaattttcaaattaattgacatcaggttgttcataatatcttctatttaacttttaaatttctatagcatatgtaatgtctcattttcattctcaatattgtttatttgtaccctctctttttcccctcagtaatcttgtgagaggtttgtcaatttagcccttgccaagaaccgttttttggcttattgatcctctcatttatatgtttcattcatttctgatctttttttattgtttcattcattctactttttaaaaaaatttttctgctgtgctttttctgacatttt

SEQ ID NO: 42999 - DNA, 1040 bp, Homo sapiens
tgccgaaagtggaaacaaagtccagtaggttgtcaatgtggggaattagcatttgtgggtgagcgagactgggaatgaaaaatttatgtgtatgctataactttcttgagttttgatagcctgaaacttcaaataattaagaggaggacctagatcagagttcagcctttcagttcattgggaagtctcccaacttggttgtgggactcttataataagtctccaggtcaggtagggaggtgaatacttgatgtccttttgtcagttatgaagataatatccctgacctaaaccgtttttgtgcttgtacattgtaagattctttagtgaagacatatttgtgctgctcatttgtttgctttaagtatatgcaatgacaaataacaagtcccttgtgaagactgaactagtagcctggcttcattatcttgatattaaaaatagctaaaacaagtaaatatagccacatccttttgggaatacttaaagtggtagacagtgtagacaaagtagactgggaaagcagtgtagctctgacatctaaattaaattgctgtgagtctcacagtgtttttgggagtcaagcaaattgttgttattattgttcttttttgcttgaaggcattatgtaaacaaagctctgctctttcaagaagataggaatcttgaatttgagctttgacagtgattaataacatcattttgagcaaatagttgtcaagaagacccaaataaatggagagatagctgagagatcagttgcctgatggttaacgtaagctttgtgacacattggaggaagtcaataaataaatatttgttgcatgatttaatgaaaattttctcatgatttttctggttataatcttctagaataaataataataatacccaagtgattttctgttttggttaaggatttttttttctgctttggaattctttgattaggctggcttttgtgaatttatttttgctattgtaatgttaggagtcaactgtatctcttttaacaattctatattttaataagcatctta

SEQ ID NO: 43000 - DNA, 1044 bp, Homo sapiens
gaaatggtagccactttagaaaatggtttggcagtttcttgtaaaattaaacatatacctaccatatgagcagcaatcacacttataggtacttattcaaaagaaatgaagatatatgtccgtacaaaaacctgtacatgaatatttatagtagcttgattcctaactgccaaaaactgggaacaatgccaatgtccatcaactgatgaatgggtaaacaaattccagtacatccatacaatggaatatggatagtctactgatacatccattcataaacaatagtgtagatgaatttcaagctcatgctaagagaaaaaaactgaactggaaaggctccatacttttcgattctattttatgacattctgggaaaggcaaaactctagacgcagaaaacatagtaattgtcaggagctgaaggtgcaggcagtgggttggctgcagagggttatgaaggaacttcttgggatgttgaaaatgttatatatatttgtcatggtgatagttatatgactgcagcttttgtcaaaatttataaaacagtgtacctaaaagtatgaattttactgtgtatatatcataccccaataaatctaactttaaaaaagaagttacacttccagtttccagttccacatgtaaggagcttggaagttgtcactctgtcctaacaataaacaaaaagctgaacaacctgaaaactcagcaactcttcttgtatctgaaggagaaggtaggacatagggcaaactgctgcccccaagattggagagacaggggaatacaggggattttgacttaacgaagacacacactggaaaccactttggaaaccactttggaaaccagtgccagggtaggaaaacctgacctgtaattgataaattgctgaagctcagtgtgattagctctgagaggagtcccagtctactgggatccagtcataaggagtcccccacaatattgtaagatatgcctccaggagctcaaccaggagctcacaataaatatcagagaaaaatcgccttatacttctggcac

SEQ ID NO: 43001 - DNA, 1032 bp, Homo sapiens
tccagcctactctagccattctgtccacctaagggaagagaaaaaactgagaaacatttgttcaaagtccagagacaggctcattaaagcctgagacctaatcatcgaacctaatcattgcttcccctcccttcacatgctacatggatgtcaatagtacatgccttttgatgatactttttttaacctatagactttccaaatggctctcagaatgtagataagaacggtctgtgttcaaaagaatcagcaattaaaatgaagcgcatcctagtagtcctggaaaataagagaaatatgtctcaggttctggattatattttgctaagataactataacaaattctgccctttagttactcttctggctgttagagcaagaataagtattgtttttggaaatgcctgaatttcttacaatgaataaaaaaagttattaagtgtcatattttccaatggtaaataggagtcaggcacaatgtagagactcagtaaatgttaaatgaatgaatgatcagtgccttgtatgaacttctccttgccaaagctttctctttgagtccctataaactactagtactttggcaggagggagggagagagggaaggagggggagagagagagagggagagagagagaatgagagagaatatgtgtgtgtgtgtgtttgtgcatgagtgcatgtggcagtgtggtgggggagatgttgcctatttttcataatatgatcatttccttttctcttttagacatattactgatgccacacttgccattgtgaaaggagagacagttccacttgatgtcttgcagatcaaggtaaatcttttcatcacatattggaaaaattgtgaaagtaatactcgcttacatgttaaagaaaataaaatgtagcagttcaaatgaggttataatgaaaacaatagttgctcttccattcctaccccaagtattagtccccagaggaaataattttacctgttaattctagttgttatcactaattaatatgcttttgctcctatttttaa

SEQ ID NO: 43002 - DNA, 1022 bp, Homo sapiens
gtttacacatttttaattgagtgtgcatatgtgcatttgtgtgtgtgagaggacatggtgtacaggatctagtcatttagcttgggatcagcacatcagagcatgcagtgtttgcatcttagtgtggctgtatcatcctttactcatagctcttttgaacgtacacttgacccattgtatccatagatgtaaacaaatgcagatagagaatatttggggaaaaaaatattccacaaaattccaaaaagcaaaactggaattggctgcacaccgagtactgtgttgaatccgtgcaaataaagtgatgtgtaggcactgtattaagtgttataagcaatgtagagatgatttaaaatatacaagagaatgtacataggttacgtgcaaatatgccattttatatccgggacttgaacatctgcagactttggactgagggacaactctataccaaactgtattctatggcttaaaggatgtgtttaaaggatgttgtgaatttagtgactcaaggagcctggttatatatctctcataaattgcaagaatctttactgcgtaactaattacatataacttgacaaggcatcaaaacgtggatttaaaattgaatgtaatactcttttatactaagccataacctcctagctaccagaatagccactcatagcagagatgtaattctaatgtattgtctgccatgaatggtatctatcacatgatagttcttttgatattcttatcagatttttatcttggtcttttcacaggtactggtatcttgggcctctaaaaatcaaagcagcccactttttcagcactcttaaggtaaatgtgatttacagtgtagaaatttgctgtgttattttgttgtttctctgtaatgcatatatttggtatttttttttaattccttgctacagatgaatgtggcatgcttcaacactaaaacagggcatgtttgattaaatacaaatatagaacgcattcctgttttgataagcaatcaccctttatctacc

SEQ ID NO: 43003 - DNA, 1123 bp, Homo sapiens
agttaaggggagccgtttcccgcagcgctagccggcagtatttccaaggcgcaagttgcggagtttctgtttcctttttcctctggcgagctttgcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggtggtggcgccatcttcggtaaagggtgtccacctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttggaggaagaggaagttatttgggaccaaaaagacatacaggtgtgagtttatttgggagggaggaaggaatcctcatcagatgtgcaggaatgttggtacgttgtggtcacaaaattggagtgcataaaaattatgaatatagttaggaatttaggactggtgagttgtacttttgccataagaggtaatgtttttttcttattttgtttttttccttcaggaaaagcctaaagattagactgtaagaaaagaaaatagaagccatgtttcgaagacctgtattacaggtagtcacttgtctgtattaatactgagatgtattactatcagccacagtgatcagaagacttctttaggcttttaactacaggggcaaaagacctttgagctcacccacccacctctatactcatttgatatggaggattggggacgattttgccagtgtaaattatgttcactaaaacaaaaaaa

SEQ ID NO: 43004 - DNA, 1034 bp, Homo sapiens
tttttaaacttttgaaaatgctataagaattttgaaaataatatacccctctggatgtctgcaagcgacattaagaaatttttttcaatacaaaattgtgttatttttaaatgtatcaatggaatctaaatagcatagcaatgtgatacctactatcctgtaaaaaaataccagttcagcatttggaaattttccattattcttttttctttgaacttgttttactgtttttattttcccctcagaagtgtatcttaatagtatatggtatagttaagaactttttattaccctgtttgtaacaaaaatgcatgcataaaagaaactttaaaatatttaaaagaattctatgacaaattcttctcaattgacttatcattaaagttgtttttagtacctaattgatcaaaacaattttaatgtatttaaattatattggaaatatgtctttaaatgagatagatggtgcttttttcacttcttgagtaaattgctaaaattagacattgtgaattttgtgcttttgtttgcttttatggacataaatactaagaaagctttttaaaataaatacatggcaataaactaaattttactatattaatgtttctgtgtttatgaacttctgagatatgcccaaattagattttttttttttttttttttttttgagacagcgtctcactctgttgccccggctagagtacagtgacacgatcctggctcactgcaaccttcgcctcccgggttcaagcgattctcctgcctcagcctcctgagtagctgggactacaggcacgcgccaccacgcccagctaatttttgtatttgtagtagagatggggtttcaccatattggccaggctggtctcgaactcctgacctcgtgatctgcccacttcagcctcccaaagtgctgggattacaggcgtgagccaccgtgcccggctagataatattttttaaaaattgatttttgggctggatgcagtggctcacgcctgtaatcccaggcctttgggaggctgaggtgg

SEQ ID NO: 43005 - DNA, 1024 bp, Homo sapiens
agtgtgttgtgtacagtactcagtaagtgaaggctattattgcgctaatattggattgtgcagcaacagcaatttccatatgattccagttcccacaaacacattgtgtaatgatgaaaacagtggaaagaaaatcaagacctttagattctagattccaattcaatcttgcatttcatgatcattttgctaaagtacattttcaagtaattattttgtagattgggcaaaagaccaagtagttttgtttttatttttgaccaagatgcctacctggttttaaaattacagttttatcaaatgtaatataagtgaattttgtaagtttaatcacttttatttaaatagaagtatataggcattgatttacttcctgttatttacaattttgacatgtcaatgaaaagatattgcttaatatcctgaagaattctcaaatttgtaaacatattcagttaatacacatggcattattcagaaatgtgtatttctagccctaatgggactctcagaagtggactgttgtggctaagaatgtagaccctgaaattagacaatctgtgtttaaatctggctttggcccttttgaactgggtgaccttggggaaacttcttaaccagtctctatttaactttcttcacctgtaaaatagaaatagtaatttgtgtgtgtgtgtgtgtgtgtgtgtgtgtgtgtgtgtgtgtgtgtgttgggataaagttgttggaaggaatgagtgaattaacacatgggaagtgcttagagttctacatggaacaaacacacaataaaactgctatcgttgttgttattttgtgaaaaggagcatactttgacataataaaaaggagtatatttggacatagcatgaatgtccattacattactggacatttggtcatatgtaaccagaaattgacattagggttgttctgggatttatatgttaattcctaaaatgatgggaataaaatttcctttggtctgcacagtttgcattatcccattggattaaacacctcc

SEQ ID NO: 43006 - DNA, 1988 bp, Homo sapiens
gatacaatttctataagaactaaatgaaattcttaaaaatttcaaggattttaagagcttgtttatatcacttaagtttcacttaaacatttctaaacatgtctggctttaggtttccctgatcattgctacctgcattctgttaatgaaccattttcaattttttaaaaaagagaaaagattactggaaaggagtcttttaaagcatgaacggaatgtaacttttaaggtagcatcaaaagctacagtcttcaggtgaaactgaagcttactgaaggcatttaaaataaattttccaataatataatttttttttacaagttaaagctggagatggatcatctactctagttcactggttctcaaagagcgctgggagggtgagaatatgtcagagtccattgggaatttttatttttcacattttatatacagtctgtgtgggtttctcagctctatttaaaatatacgtgtcttcattcattctgggtgtgggagtggaagggggaagtggaatttgacaaaactccctagggatttggatattgtggtctaagggaaggcacaggtataaatttatttctccttctaagagaagagccaaggccagttttactccatgaggaaaaaagtgtgaaaataaattccatgtttgtataataatttgcctggcatagaaattaacaagagagtgatacgggttaatgggggtgggagaagaggagaggaaaggggagacatgagggtaaggtcaacagcaggaggaggggtgcagtctgtacaccctcctccccatgcctggcagaggtgtgaggtcaacatcacttcaccacggtatgattgtcctctgtgttgtctatttggatatatggggtctgggaaatggggtgactgtaactctgccttgagtcagcaggaaggagccaggagccctgggcaaatgactgagtgtgtgcacagctagcttgcaaatgagatatctaaacacaggtgcatacttgattggcctgacaacatttctgacctattttaaatatggaaaaattatttgtctcaattttgctgctttcacagatgggacaatgactgtggttataatgatctgaactccaggtacctcaagagaagaaatagctaaacattgatattactcagaaaagacctctcctaactcctacccacccctttacatctttgacttctatgtgttttaaaggtctggattaatcagtctctcatctttattcatgctttccagacattctggaattgtgcagaactggacacctgtgtctagaatcagtagctcagttcatcctggatttgcatactgtgaataacagacttcaggtgctttctgactttattgaaagtagtagttagggagagaaatcaccagggaaggaaagaaaaataacagtaattagactatttgggaagcaacaggctgggtcattcgttttatcatcacgatagctctgtgacgtaacattatcatcatcattttatagaggggacactgaagctcagaggggttaattggcttgtctaaggacaagaagtggttgagttgggagcacccccaaatctgtccaacttcaaacacattgcctttctctgcatggccacaagtgccccattgattaatacatctaacagaaagctaatcttgaggcctaacagaaagctatctaacagaaagctatctaacagaaagctatctaacagaaagctaatctaacagctaatcttgagtcctgtgtcccattgagagctggtactagcatgaacatgtgaactctttgccttggatgggcagacacccagaaagccccgtctgtagcctgtgctgcttgaccctttccttagcgtgattttgcaatattatgggaacacctcagtgtcttctggatacgcacaattctcattgctaaatgctaaaaatgtaattattatatctgagttttatttaaatttttaaaatgttt

SEQ ID NO: 43007 - DNA, 1047 bp, Homo sapiens
tgggactacaggcgctcgccaccacgcccggctaattttgttcttgtatttttagtagagacggggtttcaccatgttagccaggatggtctcaatcttctgacctcgtgatctgcctgcctcggcctcccaaagtgctgggattccaggcgtaagccaccgtgcccggcctcgtttttcacttttaaggcctatgtggtgatgttggactcatcagataatctaggataaacttccaatttcgatgttcataaccataatcacatctgactgtattatattcacgagattagagtgtggacatctttgcagggccattattctgcctactacaaaactcattaaagtgtagattatattttaaaccataagagtagaaaatattacccaaggagaatgtgcagttttttcttgaatcttcacctgctggaaggttactttacccatccttgtcctacatgtcccagtcttttggatatctggaattactccatcacctataacagaatactgtagactgtgtgaggcttataaacaacaaaaatttatttctcacagttctagagtctgcgaaattcaggatcaaggcaccagtagatttggtgtaaggtgaaattcacttcctggttcatagactgctgtctctcgctgtaacctcacatggcaaaagcaggaggtgagctctctgggctctcttttatgagggcatgaagcccatttgtgagggttctgccttcatgaactaatcacctcccaaaggccccacctctaaataccatcactttggggattaggtttcaacttatgaattttggggggacataaacactcagtctgtagtagtgctttaccaatttctcaagcatataggactattttaggaccatggtctatggctaagcccaatttctgcccttcacctcatctcagccatctctgcctttcaagctctgctactgcctatatcttctttggatttacatgacatcttcacctttcactggagctgccaaactcccttgtggacttgatttatgattgttgacc

SEQ ID NO: 43008 - DNA, 1037 bp, Homo sapiens
cactgcatgagtacagggatgcttggaaaacatgggcaaggactgaatacctattgccaagaagccaagatattaaagtatgataatgatagtaaatgtggtgttattgcaataaggctggctaatcacaaatcattagagcaggaaagggagaaagggtagaaactccagcagaagctaaaaggcatggttttctaatcctccagctggttacatattatggccctttcttgtgtacattttaaaactgacgggcaaattacaacaagaaaaattcagagctcaaatgtttaatctacaactatagagttaagtagagtcttctaaagctctctatttctctttccttttctgcctgctttgaatctactgttaataagttactggtattgagataaaactcactaattcaaggtcaatttgagattttttttttcctcatatggttcagccagttctagctaaaatgtaaagaattaaactcatttggaactgaaaaaaaatggataaaggaggtttttaaaaatcaaactgccatagaaactgctttacccaaattattgatccactgctttccttgggttacctattggggcaaataaagtttagccatgtgaacaggtcccaattttatcaaaaataatctggatccagctgtcttttatatagtaatgagtttgtgaagctagaattccaaaagctattggtaaaagctatcggatcttgcatgtatatgtataaacatgtttaaatgtgttatgtgtatgtgcatgtattatgctatgtgttatatctagcatggtaccgaatagcttataagtaaatacgtactcataaattaaataagtccagatgctcttcaggttcacgtgaattcaataatctttggtgaataagctggcttcaaaatttttgataaaataaaagtagaaatgtcttcaaaagtgtcagcatacatttttgtctgagtttcttgattagataagttgtatatttgcccctcctagatagtttaaggtgtcaggtttctgacatga

SEQ ID NO: 43009 - DNA, 1058 bp, Homo sapiens
attgcaacctctgcctcccaggttcaagcaattctcctgtctcagcctcctgagtagctgggattacaggcgcatgccaccacgcccggctaatttttgtatttttagtagagacagggtttcatcacattggtcaggctggtctcaaactcctgacctcaggtgatccacccgcctcggcctcccgaagtgctgggattacaggcgtgagccaccgcgcccggcctttgttttcttctttgagcaaaattaacttctttaactattaaatgttaaattctattagcatcagctccagaggaacattcacagttatgtattctcttgaaattatatattcttgaaagaattttttgattatctgtcattaccttaagatttctattattatggtttgcttctacttagaaaatacagatacttttcaacaacaccagtctctttatttctagttatattgcagactttcaaatattttatgtaattgcatctcaattatctacaaacagaagtattccgaacagatcaattagtagctctcaaactttaacatatcacagtgtcctggagggcttgttaaaacacattttgctggagcccaagatttcacgtttcttccaagttcctgggtgatgctgctgttgctgctttaggggccactctgagaactactgcaatatgttatattatagaagtgtgctttttattttggcagtgtgtgtgattaaatatatgtgtgttttaactcttccacccagataacttacttattttcattacattttattcaagtttataataaaatgaacttgttttctttctgcccatctcagaagacccagacatcgtgaattatagagggaggcataggtttaaacatgtgtgcccaattattatgctctttaggtacacagtataaccttctgatggatggaccaaatgcttaaggtagtgctcttcatgtatcgcaacttagtgcaagataaacaagattctccaggcatggtggcacatgcctatggtcccagctactctagaggctgaggcaagaagattcc

SEQ ID NO: 43010 - DNA, 1098 bp, Homo sapiens
aagtgagggtagtttaaagagattttttagataagataaggcttaatttgtacctggagtaatttgatttacatagttatagagtagtatctagagtctgtcgtaggaaagaaacaatacaatatgataagtacactgagaggcagagggcatgttgtgtctcccctcctcccaaacagatgctcggatctgattttaaaatagcatctgtgtgagtatgtgagatgtggctggtcacaatgaagtgggttcacctccttacaaacctttagtcataactgaggttttggacatcagcaggtaaaagtaaggaacagttgggagcttaagtaagaaataatgtgatgaattgtttttccagcaaggttgccatggagggggctgcactaaggaaagaggttatgggtcagcaactttacttttcattccctgctctatccccaggcccagggcactgcctgatgcatggtagcacttataaatgttcaatgaatggatgaaaattaatctgcctgaaaaactgtaggtattatgtaaaaaacaaatatgaggatattgtgacaaaagaaccagtgacatttattgattgatggatctgtgatataaaggtgagagaggaattctcctttctctttagcttggcctgtttcctttaggcgtctttactaacaaaacgacgttaaattgtgattttctcatcctatatccagggatttaatacactattggatctggataaggagtaattgctcttttctggagtaatctggatcttttgctctgtctctctaacttttctgaaattaaatccttcaaggaatgaccagtagccaattgttccattgaaaatttgagttcacctgtcttcctgctgtatttggttaatataattaatgtctagaaaaagctccacccccctgccccagtcagcttctaaactggagtgtaagctccatgacggcaggaattttctcttcactctatccctaggccttaaagtaagacagtgcccaacacatggcagttgcttgacacatttttattaaacctgtgctttggtccttttcccccaattcttgaagcttcccttctttccta

SEQ ID NO: 43011 - DNA, 1084 bp, Homo sapiens
tgacttgctttattgccatattcactttcttaagctggtctggaaacagacctacggtatctccaaagtatgccaataatccaaaagagtaccctcctagacttagattcttcatgctgggttctctgactagggagggtgcaggtgtcatggccgagtctagtttgggaagtgcagctgtgtgatggcattcacactgtgattaatgcccttttggttgcagggactgccgccatgcggaacaccaaacgaggttcctggtacatcgaggctcttgctcaagtgttttctgagcgggcttgtgatatgcacgtggccgacatgctggttaaggtgagccagcgggctccgtgacccctgtgtgtctccacagtgctctactttcctcctctcttgaatgctctttcatagtccgtctccccttcccgtttgctgctctcctgaagcccgagattctcagacttgggcctattggttctgcccctccaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaag

SEQ ID NO: 43012 - DNA, 1047 bp, Homo sapiens
gtctagcatggtagtggggcacagtgacactgtgacgctggagggtcagggtcggagcggaggagcttcccagggagtgcagacagcggggaccaggaggtgcgggaagaagagtcaggaggagagtcagggtgcacttggagaagagagctgagctcctcagtggggtatttgagggagtgaggactcaaggctagagattagactgttgggaaatcatcagcggtcttgggatggcctgtttgtgccctgtggtgggaacacaatgtgaggagttgaggagagagtgggtggtgagaagtggggctgctggtgtagcctggtcttaaaggactaagggaaggactgtgtgtcagtggtgtgtgtgtgtgtatatatacacatatgtgaatatatgagtggcgtgtgtgtgtgtgttagtgtgtgggtgtgggtatggtgtatgtgagtgtatgtgcatgtgtgagcatgaatgtatgagtggcgtgtgatgtgtgtagtgtgattgtgtgaaagtatgtgtatatgagtacatgtgtgcatgtgtgagtgaaggtgtgtgcatgtgtgagtgtggctgtgatgtgtatggtgtgtgattgcacaagtgaaggtgcacatacatactttcttacaaatacacacaagtggcgtatgtgtatatatgtgagtggtgtgtgtgagcgtgtggtgtggtatatcttttttttttttttttttttttttttggagacggagtgcaggctgtcgcccatgcttactacaacctccgcccccctggctcaaacgattctcctgtctcagcctcccaagtagctgggattacaggcacgttccaccacacctggctaatttttgtattttttagtagagatggggtttcaccatgttggctaggctggtctcgaactcctgacctcaagtgatctgcctgcctcagcctcccaaagtgttgggattacaggtgtgagccaccgcgcctggcctggtgtggtattatctgaatgtgagtggtgtgtgtgtgtgtggtatggtatatgtgtgagt

SEQ ID NO: 43013 - DNA, 1020 bp, Homo sapiens
ttgtatttttagtagagacatggtgtcgccatgttggccaggctggtcttgaactcctggcttcaagtgatccacccatctcgggctcccaaagtggtgggattacagacatgagccaatgtgcctggcccaagtggtggagtattggtcactcagttgtttgatgattattaatttaatatttactctcccatttcgcagtgtggcctaggaagaagggcattgttcattttgatcaccactgtagctcaagagcctagaacactcccaggcctgagctttcagacgatatttgcagaagaaattaatagctttcaattgattaaatatactaatacatttgagaatgtttataaaaaaagaaactaaaatgtttcattatatctaagtttggggcacactacttcagatttcctcttccttttactttattattagaaaaggtattaaatacggtgcaactgtgagctaaaagtttaacagcaggcttggcaactcaatgactcaaaaactcaaagacaggaaagaaggttttaaaatcttattaattttagttgaacctttggaaattgaatgatattttttccttttcttttcagggacaaaaacaacctaagaggccaggaagtttattcctatgaaatgttgcttctccaaaggccatctcaactcgattacacattttccaaataaaatctcttatataaaagcttttcttggggtttatctttctcgaaagtgatataacttcagatagaagctgatttgaccaaccaaatgactttgactcagtcttctggttgatcattatcatgtaagaaaactcaggtaattccagataaaccaatgtttttttaaaaattgtttagtcgtttatttatttatttatttttattttactttaagttctgggatacatgtgcagaacgtgcaggtttgttacataggtatacatgtgccatggtggtttgtggtgggggaaggggagggagagcattagagcaaatacctaatgcatgc

SEQ ID NO: 43014 - DNA, 1035 bp, Homo sapiens
caaatgtgaaatttttgtcctcaataaagagtcagaaatgatgaccattctgccactttcatcattttaaaatctgtattcctgaaaactggcctcgaatttatttctgtatagtccaaggtattgatttgaaagtgagaggctagcatgaaagccaacacttctcaactttaaaaaaaaatgccttaatatttagtattttctcattctaatgtatcctgtaagtgttctttctgtacttcttgttaaggcatggctgtgtaaacttcagagggttttgggaacagcctccattgtcatccacttttcattctaaaatcttggtatatctgtgcatacatgcacaaggcctcccatgattgcactgcttttacgaataatcatagtcaaaattcattttttaatactgctagctcaatttttatttcttattcctttgaaattgatcatcatttggacagggactgcattaaagctcaacactgaccttcattgtggccacaggaagaaaagatctgctaaatgaacaaatactgtgatcgatattgtgcaatggcttgagggaaaaaggaggttttaaccacttaaagtaagcccttttagaaacaaaaactatttcagtgaaaatgctaatcctacacctctccaaagtaaatgtgcttagaggacaccagccagagtttctttacaatgggaagttgccttccaacaagaaagggttttcaaagtgcagaagaaaactttatctggaaaaggtgagaagcagagagcctccaggctccagccccacacactctcatcttcaattaatactccacaaagggaaagttccattgtgggccacagcactccctgcttgagaacctgtagggacttaaccgctgggtttatccaatgaagtgtctgaggtccccgctgtttagcttggccctccactctctgttcccaatttcgtaaccactacctcagccagtctccccagcagagcacttttatcttatagccatgaggcatctgtgacatgtcccacaacac

SEQ ID NO: 43015 - DNA, 1047 bp, Homo sapiens
atgcaaacacaagactggctcgctttaactctattaatgcccatttttggaggtttcaggagagtgttccttaagcttgagagggatggctgaattgctttctaaatatgttaaactttttttctcattggcttcatcttttaaaaacgattttgtcaaaaaacaaaccaaatttagatatgctagggtttttcaccaatttataaaagcctccctccctgagagccacatgctcaggtccttatagccagccccaccccccactcctaatgtgtgtaccacatcagaagacagacacgcatgcctgagctgattctgcatggtttccttagatattacagttcattagactcttgccacttactgaatattatcttctagctgtaattaactacatgacagccttatttcccatacatttccgattgtgaattcctccagcgcaggagatattccttatttgtttttgcgtccccagagtaacagaacttggttgtggtggtgcctcagttgcttttttttaatgaatgagttttctggaataattctaacttaaacttaacgtttgaaaacatgcgctgatttttggctacagaaaacacagtcgttgtgcttaagccggttaagaattcaagctttattatacacttctcgagtaaaattgatcgtctctctcatccctccttttctattcccccttccctcttcacttcccttctccctgaaacaccccagtatctagtacagggccctaacagaaaaatgcccaggttttctatacctatggaagtctgggaaagtgccaagaaaacaggttgtgaaactttaacttttttcccccttaaaactagttttaaggtgtggatgtttttactttttgtgtttggtgtttttttggaaacacgatcaggtttttccccccaggttgagtatccagccttgcctttgcaatgaagcagtttggtagttaaggctcctccttgtagatgaggcaagccccatggttctgctggagtgggataggaagttgctgtaggaggaaccatc

SEQ ID NO: 43016 - DNA, 1033 bp, Homo sapiens
ggaattttagagaagtgccacctctggtgtcatcagttatcaaaggtattgtggagttttcaggtaacgttaatttacttcattttgacttcaaaaataagcatgggtggtttaacatttaaatactatcttaggaattgcatagatattagaaaccctttatagtagtgttaacatgaatagtagcaaatgcttaccgtgtgtcaaggactctgctaagcattttattttcgtaactcacttattcctcatagccaccttatacaacaggtactacagtattatctctagtacagatgatgaaatacaggcgcagaagttaaggaatctgaccaagctcacactgccagtgacttgtggagccagaactgtgaagttcacagacatcccacgcatttccatattagctgtttgcaatttgtcactgtgtactgtcaatcagtgcctcttgaattatttctttagtaaaatattttttgtgggataacccagcacccacacagacataactgggaaaaaaaaatgcactgagtaatacttaaccttgttacattctatgagctctttttctttatttgattttttaaaaagttccagttcccttttactaagttggtttcatgatctacacaataatgaattgcagccctcagtttgaaaagcatgtgtggtgtagatgatcatgatcaaatgtaataccgttttttcttgccctaaagtgaatgcaagtacttggaaacaaaatacacgcaagtaccaatctagaccattgagtaagcatgatttaatctaggtaattgagtaaaagcattgtgctgaaactgagaactgatactcagtcctcagcagttaaaactagtttatttggacaaactgggcagtctttataacacctgttaaatataatgtgattgtgattttctgtaagttttcaggttttccggagcaatttataccagtgacgcttgtggcatcttacttggaagtcatgtagtaaaataggaagaatatagatgttgacttaattaagatt

SEQ ID NO: 43017 - DNA, 1064 bp, Homo sapiens
aagatttacagctagcatgctttaagtctgttctttgttttttcttaacaactttattgagatttaatgcacatgctataaaagtcactcatttaaaatgtataattcagtgatgtttagtaaagttagagttgtgtggccatcactacaatgcaattttagaacatttccatcaccctgtaaagatcctttgtgtctctttgccgtcactccccattcccaccatccccacaaccccaggcagctactaacctgctttgtctctatagatttgcctattctggacatttcatgtaataaatggagtcatatgatacgtggtgttttgcatctggcattcatttagtgttaatatttttgaggttcatccacgctgcatcagtacttgattttttttttattgccaaatagtctgactacttggcattattgtgtgagtgcctcacattttgcttatccattcacctgttggtggacatttgtgttattccactttggggctattataaagtgctgtgaacattcatgtacaagtctttgggtggatgtatgattttttttgtttttggggggtagatatctggtagaataatggggcatgtgacagatttatgttgagtgaacatggtttttaatgccgcagatgtttaattattagctttgggtaacaacaggaaccaggcaatgcaagcatatgtgataaattcaagtcttgagaatttgacttggaattcgttatttgagaagcagaaaccatttcttaatttgagtatgtgtttatttttatttctctgactttagagccagtggacttaaaggtttagaatggctttaagtaagtagagagaaaacttagctactgttggccgggcgcagtggctcacacctgtaatcccagcactttgggaggccgaggcgggcggatcacgagttcaggagatcgagaccatcctggctaacatggtgaaaccccgtctctactaaaaatacaaaaaattagccaggcgcggtggcgggcacctatagtcccagctactcgggaggctgaggcaggagaatggcgt

SEQ ID NO: 43018 - DNA, 1356 bp, Homo sapiens
gtgtgtgtgtctgcacgcgtgtgtgtctgtggtaaaaactcatgcgggctccgggagccagcagctagtgtgtgtgtggaagcacagctggctctgccattgcttcttgtccttgactaattgcatcttctgccttggtttcctgtcaagaaaatgataatccctctccggggattggccgtctagagaacactgaagttgtgaggggccctgtggctgcccctgctgtcgtcctgcttcactcaccagccacctgtgtgtccaagtcaggaggtggcacatctgcagggtacacgcccgaaacgcgtggacattcataaccacacttggcaactcctgcgatgccaaggatctcctatacctgagtacttttgaaaactacctgatttcctaagtatattttgtttttttgtttgttttttgtttgtttttaatatctttaggtttggggacctcctaggttttctagctatgagacatgatttatgaggaaaatatttttaccccttacctaaaaaccatttgaacctctctgacttatgaaatctgcttaagagtgacattttttgatggcttgattataagatatggatatatagtttgtaaagtaaaattcaacattaacagagaagcaagtgttttgtgggcacctgtattctattttattgtcccaggcagttttacaatcagttcagttcaccagacacttgagtgacgcatcaatagattaagcatgggcatgcagcgcacatgcgcgcgtgtacacacacacacacgcgcgcgctcacacacacacacacacacacacacacccgtacccctctaaactggaaaacttcattgcctgagcctcttgtatccattggagcaggctggtagatacacaggtgacacacccagatgccccttcaaggaaggacttgactcccagtgttagcgccatcgggcctcagctgcagagctgcctggaccgggctgcacccttctcagcccagcgggagttaaaggcctggcctgcagcccatgtgagaccctctggcaacgcttgttacagagttccctgccagggtgatgctggctctatagggcctacatcacagttcatcttttctctgccccgtctgcttcctccttgtcatctcgtgggtgcccatctctaagaagcatcttccacccaagccaggtctcagcatctgctccgagagccctgcctgggacctcctcacaggtctctgttgctgcccagcatgtgtgtgacctatctgtccttttagacattttcatgatgtgcctacttctaacatttccttgtagacgttgtttgaggtttctttgctgtattagttattaatgttt

SEQ ID NO: 43019 - DNA, 1025 bp, Homo sapiens
gcacatagaaagagaaatggtctctagagtgggccctgcagactgagtttttctgtcagtgtgtctcaccttattacagtaccccagagacaatccactgattctctttatttcttcctcaggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacacgtatcctcctgcctagcgcaggttgattgcttagagttttgattatttactagtatgacttatgaattattagaattttatattgttttctcctcccagttcatcatgtaaaataatcgcagggttcatttttagccttaagtttttgaacagagtagaactggttcatttttagtcaaatgcagcactgggcagtacagtcaccactgggcacatgtggctgtttacatttgaaatattttaaagttccttaggcacactagctgtgtgattaataaataaaacatttctgtcatgtagaaggttccgttgggcaaagctggtctaaagcaaggtcctgaggttctcagcagatcatttgttttacgtccatttgtttatatattgtctatgactgccttgtgttatgggaacagagttaagtagttgtgtcagaaacagttttgtccatgaagcctaaaatatttactacctgcccttttacaggaaaagtttgtttacctgatcaaaagggataggacatcgagcaaaagttttcctgttatggccctatttttttgtgtttttgagacaaggtctcgctctgtcacccaggctggagt

SEQ ID NO: 43020 - DNA, 1050 bp, Homo sapiens
cagtgcttattgttagctttttgtttttcctggagtcagtaattgcatttttcttttgggacagttttccacaaggtcagtcacatcagataatctaaaaggtccagatttttttataggcaacctccctcctggaatgttcccttctccaccttggcggtgttgctctcaaggcctaccaacaaccttgtgaatggggcttgttgacttttagctttatggatagtgtgaatgggatctttgttccattctagtttttaacaggttttggttgatatattgggaatgcattggtaatgaaatataagaaaatatgtttatgttaatgaccgttaacgtctgtgatatatgttggtttccttaacttttctccaagtcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggtaagatgttttatatatatactgagtattcataacaggatataaaaaaagtgaaataatggttctaacttgttaaatctttcactgtcatctgttactgttttagacactaacgtaggtgacagtgttttgctattgcatagtcttttacctactgtgaatatgaaatcaccataaactatattctagggttttgttttttcgagatggagatctcactatgttgcccaggctggatttttgatctcctgggctcaagtgatccttccacttcggcctcctgagtagctgagactctgcaaatgctcaccaccgtgcccagctctttctgttttttaaaattagaaagctttgataaccttttagcataatagtgctttcgttaaattaccaaccattttggatttggttgttagaaatgatgaactttttcatttaaagcaaatatgtattcaaattatctgcattttactgtgaacccaatgtggtgttccctatc

SEQ ID NO: 43021 - DNA, 1050 bp, Homo sapiens
ccccggctaatttttgtatttttagtagagacagggtttcaccatgttggccaggctggtcttgaactcctgacctcaagtgatctgcccacctcggcctcccaaagtgctgagattagaggtgtgagccactgtacccagccaatttttttttaaacaaatatcaaaaatacagatgattttgtggtatatttcttaataaaaaggaattacccgcatatcaaatgttcagggtactttttttgagtgtgtttgcatatttaataccatgaaaaatgttccagtttaatttgagatgaaagaattattttactatattcttgtgagtttatatatattagcatgtttttgtatacagaataatttaaagaagccatctaaaatcacatgtgtcaatgtattttaatacagtagatgttattcaccgttatttttaatttataatgtgacaaattagtcatcttaaagctttagttaacttgtttttaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcggtaagagttttgttttaaaacgttttaaatttgtttttgtttttgttttttttaatggcaaattgtctttcagcaagagaatctaggcaaatattaagcttttttcagaatagtaaactaattttcattgttttatcaataaatgtcacttaaatattttttagcaagaaagtagaagaatgggtaaattggagttctaaaatacaatttgcccatttctgcatttgctttttaaaaatttcttctttaattacctgaccctaccatcacagtttgcctggaactgcctgagttttcgcactgaaagtcctgagtcctggtagtcccaggcaaatcaggtgccatacctgagggcgagccctgaggattagccctcccatgctttagagtctg

SEQ ID NO: 43022 - DNA, 1048 bp, Homo sapiens
gcggaggttgcagtgagccgagatcgcgccattgcactccagcctgggcaacagagtgagactctgtctcaaaaaaaaaaataaaaataaaaataaaaccaggcctgacaccaaagacggttgaggagcaagaatttccaatggcctcgatgttttcaatccagcatgaggcccgccttcaaggaagcagtgtgcttcctacatcctggttcccatagaggggattcatttctagaagagttaaaggtttggcccggatccacttggatcacaccaaacacgacttccatcatattctgaaagatgataatgcagagagtctataagcataaaactggaatttgaccatgtaattctgctctcatcctatagccttgcatctcaaactgagctatgagtctatttttaaatccccaccccaccatttattagggggatgaccttaatgcttctgttcctcaaattccttatctgtaaaatgtgaataataataataggtaataatgaggattaagtgagctttagtatttacaaattttaacatgaggtatttatttgttaaaaggtgcttagattggtgtgtggcaaagagcaaagctaatgtatttggtattacaaatatacatcccacaaaacctccagtgtatgcctgggaggatgcaaaaccacaggataaagggtggcaaatcttactcaataacttagggagcaattgtgtttacattacaacaaacattctatcaggaaatagaacaactatgagataaaacatgacccttcaagaaatactctgcaaattctagccagttgagagcagttcaaattccctgggtctgtgttcacttttctctattaggagtgttttacaggaaacatctaagaatatttggcttgtctttccaaggatggctttgaagagtgaaccatgttagtgtttctaaaagatttgactgtctcatgcgattgagactgatctgagctacagaaactctgtatgactactgtaggtttctaatgtcattttttaaaaactttaaaaatataccat

SEQ ID NO: 43023 - DNA, 1022 bp, Homo sapiens
cccgcctaatcattttttcattttattttttcttggctcttgagtattgattcattaccagttgaatttttccagatttctccaaaattataccaaatttgaaaatctgggcaaggcacggtagctggacagcctataatcccagaactttgggaagccgaggcaggagaattgcttgaagccaggagtttgagaccagcctgagcaacatagtgagaccttgtctctagaaaaaattaaaaagttagccgggtatggcggcatgcacctgtagtcccagctgcacagggaggctgaggcaggaggatcacttgagcccaggagtttgaggctgcagtgagctatgattgtgccactgcacttcagcctgggagacagagccaagatcctgtctctgaaaaaaatatatttaaaacaaaaatcattttggagagtattggcatttttataatgcaaaatataattctctttactcagatcacctgaataatttattgaaatttcttccttgctttgataatttaatagtttctctctaaatttttgaacagtctgatttctgatgatgatttccatgtaatcacttcagggcttatatttgtgtgactcttggcttcaagtagtttttaatctaaagtaccacatcttagtatctgcacagaagatgcattcatttcttagagtggcagagacattacctcaaaaagataaaataccattctctgagggatcaaaatgatgtaaagacatgttaactgttaataacgatgatgttgttagggcacttaaaaaggaagtttgaaatggaaatacgtattacagagaaaatggcagacatcagtggctgtttaaatatggttgttgtttaccgtaaaatcaaagaactttttcctttttctttctgttttttgagaaacggagtcttgctctgttgcccaggctgaaatgcagtggcacaatcatagcttactatgtcctttaactcctaggctcaagccatcctcccgcctcagcctcctgag

SEQ ID NO: 43024 - DNA, 1028 bp, Homo sapiens
cagccctatactcatcttcctatacactacttctatttcagaactaacttaattattcctttctgaaacattctacctggggaatcttttcattctcttcagagaagtcagtcttccctggcaagtcttagttctgctttcaaagtttaacattttcgtctgtaaacactcagcccctaaatctagtccacctacagcctccacatttacagagtacattctgaaaggctgaaaacaaggacttcagcctcaccttgaactaaaggaaatgtaggtgtcagccaggactaggggaacaaccagggggcgtaaccaaggccggaatcaaaatgaaacccacacagttatggtgctgggatcaggaatgtgtagatagtagatcagaatccaaaggtgacaatgagatcaaagatttaaaaattgtggtctgaggtgcagagccatgattccaagatagatattgatgattgaagcaaaaagtagcagcaggtaggccggttaaaataatgagaaaaggttggacgtggtggctcacacctgtaatcccagcactttgggaggttgaggcaggtggatttgaaaagaaagtatattctgctgttgttggatgaagtagtccatagatgtcaaccagtggtttattattagtcatgtgagtcctggggaacccagaggaactccctcttcaaacaaatgttttacctgagtctgcacgtgttggagagttctccaaattaactctcatgtagtcatatgatgcgtagtaaagggaagacttaaaatgtgctcattccaatcctacgtgcccctgaaatccaggggcaactgcagcaacatttttgaatttagaccaatagaggctttgggggaggagcattttcttgctggcattgtttaacattgccaggacatcaccatgaaaataatgaaggtcaggcacggtgggtgatgcctgtaatcccagcattttgggaggctgagtcgggtggatcacctgaggtcaggagtttgagaccagtctggccaac

SEQ ID NO: 43025 - DNA, 1080 bp, Homo sapiens
tgtattctaccagtgtcaggacaccttgctcttaaatgctcacaaattgtgtatgaattgtgtgtgtgaacacttcactgtgcaacatagagttgtggggttttttgacagtgtattaatattaatccatgcatatttgtactgtaaaatatagcaaaatgttactagctttgctagtagttccatataattaagtatatattgtatactctgatttctctaagattcccttgtatacatttgtatttttgtacaaattaataagacagtcatctgggttcttctcagcaagcttgcgggttcgagtacacctctaaacttcagcgcatgtttcaagacattggcgtgagcaaagatctgaacgagcaattcaaaaagcacttgacaaactcagaacccctagactgtgagtatccgtgtgtctctatgttgtgtttacaggcagagttctctgtagcaaatgaagaaatgacaaaatattaggtgaagatgggaggggctttgtcagaaattcaagaactaagaagcgggagattcctcccaaatgcccagccctcctcccccgactcccgtgtgacattaggagatgacaacccttgaagtggtgtcagctctactggggcaaggtcaccacctgttgggatctggggagggactcacaggcgtggttttgtcttgtaaaccttagcttggatccattctagcatttattttaatgttcacttggcctgcataggtaacagtcaagctaaagacctgtggcttcagactgggattagggatcagtacaggcaggtgcaggtgattcagttctccaggagaggcagctgggctggtattttagggccttgcatagtagtaggatggcggatttatgcttacatcatcttttgatcatctttgtctttttaaatgaaaaatggagaattttatttttcccaaatcagaatgacaattctattgtaaaactggacagttttgccagtgggctttttaactatctgcgaagatgaaattactgttataatttatagaccatgtgtggcgtttcccagtaataagtgaaacatacactataat

SEQ ID NO: 43026 - DNA, 1029 bp, Homo sapiens
caagctagagtacaatggcacaatctcagctcactacaacctccgcctccctcaagccatccttccacctcagcctcctgagtagcttgggactacagacatgcgccacacccagctaacttttgttttgaggacacagcgttttgccatattgcccaggtggatctccaattcccagactcaagtaatccatctgcctcagcctcccaaagtgctgggattacaggcatgagccacaatgcccagcccatcttttaaatatttttaatcctaggtatggttactgcttaacacttttcctttggagagtataggaaaagagtaatactgcacaggccttaaaaaaactaccttaatcaatttttaaaaattacttcaagtgttattttgatagctttttagaatttatactgtcttgattcaccttgacaataaaattatctatgcttttttacttcaaataagttattatcaaataagcagaagatatcttatttacataccataaaattctgctgtaggggagaccaagaatacattatgggtactgaagcaactgcattcagagtctttaatgggatgacttgtgttggaaaatccaagtcactggtcaccgaacactaaaacagaaaaaataaaattgactcttaagaataaaaggacaaccttaagctgtagccatcatattgtaaagagatgctgcctacccaaatatttaattttgaaaaaaaagtccttacctaggacagtaaagtggtcatataaaccaaataggattctctcttttcttttacttagggtgcaaaaatgcttcaaattttccaaattttcaaaacctccaacccttcccatacttaccaatatcagtaagaatcaaaaactgtacttatatgagattcagcgatctgattaactcctccatgcttttcctatacatttatttcctagctcatccttcatttctcttacattccaaccacacagaatagtaatatgtataccaaataagccacttaaatcttacttaat

SEQ ID NO: 43027 - DNA, 1091 bp, Homo sapiens
gagttctctggtccaggctccgtgggaaagtggatggaaagtgcatgctctgggcactgctgccatctgctgctgccttgattcaggaaggcattttgcagatcacaggcagggagacgacaaaaaaaaaaacaccaaagctcattttgttgacattaaatgttcaacgtttctattgctgggcatttgacacaaatatgttcatttacttttctttgattcatgaatgtcttcaggtatttgcaaaggacaagaggcttccatttggtaatttacgtctatttcccatcatgcaactacatttattttgaatatcagtttgcattaagctatttaaaattaaaggaagataatcagataatgtatggctttttgcagtattattttgtaggggtcatataatatcagactttttggagaattcttaaaataactcatcctaacttatttagagtagccacttcagagatttataaaatgaaagtgaaagcagtttttctggctggtccgatggtagtgggttatcagaacttattaacattagtgtcactaaagttggtatacaaccccccactgctaaatttgactggctttttaccatttgattttgtatttcaatcaaacaagctaactttacaaaatattcatgttggggggaaagcattcttacataaatgtccccctccttttctttttagggtcttactgtgttgtccaggttggagtacagtagcacaatcatagctcactgtagctctaaactcctgggctcaagcaatcctcctaccttagcctcttgagtagctgggactacagacacatgccaccatatccagttattttttttccttttttgtagaggcagggtctcactatattgcccaggctggtctccaactcctttggctcaagttatcctgctgccttggcctcccaaagtgctggcattacaggcgttagccgctgtgcccagcctgaatgtacttttttttttttttgagccagaatctcagtctgttgcccaggctggagtgcagtggtgcgatctcggttcactgcaacctccacttcccaggtttaagcaattttcc

SEQ ID NO: 43028 - DNA, 1002 bp, Homo sapiens
acgcccctggctaattttgtatttttagtagagacggggtttctccatattggtcaggctggtcttgaactcccgacctcaggtgagccaccgcgcccggccaagcccagctaatttttgtgtttttagtagagacagggtttcgccatgttggtcaggctggcctcaaactgctgaccttgggtgatccacccgccttggccttccaaagttctaggagccactgcgcctggccaaagtacctttttaatcattaaagattacataaaactgaacaagaaagaaataccctgaccaggctgggagtggtggcggtggctcacgcctgtaatcccagcactttgggaggctgaggtaggtgaatcatttgaggtcaggagtcgagccccacctgaccaatatggtgaaaccccgtgtctactaaaaatacaaaaatgagccaggcgtgatggtgtgcacctgtaatcccagctacttgggaggctgaggcaggaggattgcttgaacccaggagacagaggttgcagtgagccgagatagcgtcactgcactccagcctgggtgatggagcaagactccatcttaaaaaaagaaagagggccgggcgcagtggcttgagcctgtaatcccagcactttgggaggccgaggcgggcagatcacaaggtcaggagatcgagaccatcctggctaacacggtgaaaccccatctctactaaaaatacaaaaaattagccgggcgtggtggtgggcgcctgtagtcccagctacttgggaggctgaggcaggagaagggcgtgaacccgggaggcagagctttcagtgagccaagatcgcaccactgcactccagcctgggtgacagagcaagactccgtctcaaaaaaataaaaataaaaataaaaaaagagaaagaaagaaatacactgagcactaaagtcaaagaacgaaactttcaagcatactagaaataacagccatgaaactagaggcagcaagagtga

SEQ ID NO: 43029 - DNA, 1030 bp, Homo sapiens
cagagtgggaaaaattagaagaatggcaaaaggaactttacaagaatatcatgaagggcaactacgagtctctcatctccatgggtgaggctgagttgacaccttttgaatgaagtgacagcagctccaagagggctcagaacagtcccttttcctccagtgacctcattctcactctgtcttcacacacttcaaattctggtttcaagccaaaatatgaccaattaatgcttgctaactaggaatcataatctctctttttaccaaattgtaggacagagaatgaagttcagggttatgggtgtgacagctggtggtttccatgggtatccttcacttggaaaggagcttgacttctcccccttgaggcacactgtcactctgaaagcagtgctaacctagcacatgtgctttccccacacattacatctccactgcctgctttcctgaatagatatccacagctgaagatggatagatgggaagaagtgatatgaaatctaaaagaaattccctggcactgtgaccacaaagcttcagctcagccttgatggcaattagttgtcatcctcatttatctctttgtaatactctctcttcctttttcctctcctagattatgctataaatcaacctgatgtcttatctcagattcaaccagaaggggaacataatacagaggaccaggcagggccagaggaaagtgagattcccacagaccccagtgaaggtaagtgggagaagagattcctacttcttgtctccctttcctggtcagacatggtggctcagagctaagcagggcttaggggcttctagagccattcattgctaaagcaactagattttgaatgtgtcatcaggcatttaaatataaaagggagcttagaggtcaccttgtccagtgtcttcacctatcagtactacacacctaacagttacaagttgcatttcctgacagaagtactgacacctagctgtttaataaaataaacatgtccttacatgatgaaggaggcagtcatgctca

SEQ ID NO: 43030 - DNA, 1059 bp, Homo sapiens
tttttttatagagatggggtatagccatgttgcccagtgtggtctcaaacacctggacttaagtgatctgcctgccttggccttccaaagtgctaggattacagatgtgagccaccatgctcgacagtggcctgtttttgaccaaaacaccattatgcagtgcatgactccatgtgtcttgctcaaaactgtccttatattcagcacaaatataaacctttgtactactatacaaatgttacatggtacgtgactgcagttaggtacagccaaccactcatcatttaggggaagttttgtatcagcatagagactacatacagtagtccccctttattgatggtatcgttttccacagtttgttacctgccgtcaactgtgatctgaaaatattaaatggaaaattccagaaataatttataagttttaagtttgccattctgagtagtatgatgaaatcttgcactatcctgccctgtctcatctggggcgtgaatcatccctttgtccagtgcatccacactgtatacgctacctggccattagtcacttagaagctatgtcaactgtggcagtattgcagtgcttatgttaagtaccccgcgctccccccctttttaaaaataaataattgccccaaactgcaaaagtagtaatggtggcaattcagatgtatcagagaagccgtcaagtgcttcctttatgtgaaaaggtgaaatttcttgacttaataaggaaggaaggaagttacatgctgaggttgccaagatctctggtaagaacaaatcttctatctgtgaaactgtgaagaaagtaaaagaaatttgtactagtgctactgttgcacctcaaactgcaaaagttacggccacagtgtgtgataaatacttagttaatatggaaacagcattaaaggcaagtacaggcatctccaggatattgtgggttcagttccagactactgcaataaagtgaatatcacagtacaagtaacaataacttttgttttcccagtgcatgtgaaagttaagtttacactatgctatacagtctattaag

SEQ ID NO: 43031 - DNA, 1050 bp, Homo sapiens
atcagttagaactgcaggccagttccaaagagtgtttgcttaagattcaaaagtgggtaagtaaaatggatcagtgggaaggataaggtgtccaacagaaagtgtggaggagaaactcttggcctatcaagtgctcctgagagaaaccatgcaatttaacacttcagttaaagaaatacatgagaactgcttgtcatgaccagacaagataggaaaggggaaaccccagaaacgtgctcttcatctgtcagccttttggaccaagaagctgtcactatcacacataagcaccattcccttagagtggatccaggtgttgactataaccagatttactctttgcttactaggttttccattgtcaccattggatgaacctctggtttagccacagttgtgaaaataaatggaagttggttgattgtctagaaagtgcaagaagatggccctgctccttttctgctgaacatttagtattggaaactcctacttcccttttcattaataatgtgtgcaagtttcctattagcggggaaggtgtggggctctgctgggcttctcttgagcatatctgagaagtgatgttcatgtctatctcaaccaggaccagaccctgtgacttactcggtaataacagtccacacaagcctcgttgatattaaaaaaaaaaaaaaaaaaggacctcattccaaatggaatgggaatccctaatttctgctcagattttctctgaggaggggcaggactcctgcccttcctctcatgtcttagcttcttaaactacaaaaagcatcctcagtgactgcctgagggcagctcagtagccatgaacaaaagcatctttctttctcaaaaatattttcttacggacaaggacctctgatgtcaccaaatatgtttttttttttctttctttgtgcctgatttttttttttttttttgagacggagtcttgctctgttgcccaggctggagtgcagtggcacggtctcggctcactgcactccgcctcctgggttcacgccattctgcctcagcctcctgagtagc

SEQ ID NO: 43032 - DNA, 1066 bp, Homo sapiens
tggaggaagcctgagaagctgagctgccttcctttccctatcccggtgaccacattgtacttcgtagcctgctcattaaattaggtatggggcaaaaaaccaagataggagtgcaaatttggttaccctcttcacttaactaacagtgaatctagaggttttcttcctcaaataaagctttattgcagttgttggaaagacgcagagcaccagaaatctttaggaaatagtagacataaatgttctggcgttgatgcatcccctctccattggcctctcctgtattttttttttttgaagtgaacataaactcaagattttattgtattcataataaaagatgacacttagaactggatcacttggccctttttccggaaaatcggcttagtttgcccaccatagccactctgcttcctgtcataacgccgctttccctgggcatgcagagaatccttgcccttcttgtactgtgtcactttatggggttggtgcttgccacacttcttacagaaagtccgtcgggttttagggacgttaaccatgcttgcgtgagcgctatcggcacggaaagaaagaagccgcgccgcaaacggaagtataccttttttttttttttttttttttttttttttgagatggagtctcactctgtcgccaggctggagtgcagtggtgcgatctcggctcactgcaagctccgcctcccgggttcacgccattctcctgcctcagcctcccgagtagctgagactacaggcgcccgccaccacgcccggctaatttttttgcatttttagtagagatggggtttcaccgtgttagccaggatggtctcgatctcctgacctcgtgatctgcgcacctcggcctcccaaagtgctgggattacaggcgtgagccaccgcgcccggcctctcctgtattctttagttcagcatctatcacttcaaatatcctgtccagagcagtaacaataaaattcctaggggaggggatgaaaagcagtcagttcccacctgagagactgaggggccaggcctgggtccttccctaacaagaaacg

SEQ ID NO: 43033 - DNA, 1917 bp, Homo sapiens
tccttccctcccttttccccttctctttattatagaatattcaaataaaaatagacagaatagtataatgggtccccatgtatccaaattccagctgcattagctgctaactcttggccagtcttgtttcacctaaatccctgcccacttccccactcccattttattttgaagcaaaccccagacattagtcatttcctttgcaaatatgtcagtattagctcaaaaggtaaagactcttttttttttaagtgataatctcaatgttattaccaccaccaccatagtaaaagcttcagcctagatcactgtctagccagtgattagattttcagttgtttcaatttttaaaaacatttttttagtttgaattaggattcaagtaatgtccacacattatgtttgagatgtctcttaagtcttttttaatctgcgggcatctcttccatctattatttttcctttcagtttatctggaaggaattgggccacctgtcctgttttgcatctcgctgtctggattccactgattacgtcccctgtggtctcatttaacatgttcctctattctcagtattccagttgattggtaactggatctttctctctggaacgcactctgatcaggcctttgctcactaatgatgtccgtggtgttacagccagtggttgcttctcagtcttcatcctccctgtcctgtcagcagcattgtgtgtaggtgaccactctctccgtgaaaccccttgccgtggcttctgggacacctctctctgctgagtcttttcctacctcaccagctgctgtgtctcattgtttgccaattttgcctcctttggccagctttctaatgcatggagtgggccagacctctgtcttggccttttgctctttatttactctcctccctcatgactgcatcccgtctcacagtctttattatttatttatttatttattttttttgagacagagtcccgctctgttgcccagactggagtgcagtgacgtgatcttggctcactgcaacctctgcctccagggttcaagtgattctcctgcctcagctgccctagtaggtgggattacaggcatctgccaccatgcccacctaattttttgtatttttaggggagacggggtttcaccatgttggccaggctggtctcgaactcctgacctcaggtgatccacctgcctgggcctcccaaagtgctgaggttacaggcgtgagccaccacgcccagctagtctcacattattaaaagcaatctgtatgctctcacctcccaaatagatgctttctctcccctgctccctttctatatgttgcccagctttctttctggaatgccagattcacattcctacctattaattcatttggatgtcagtaaatcttagatttaacatgtccaaagtgaactgcggatcgcctgcctgagacctgttctacctgaagttgtcctcatctccgttgatgacggatggttccatcctttcaagtgctcaggccaaagccttggagtcatacttgtctcctctctttctcacaccctacttccaatctattagtaaataccctgatttttcttcagaatatatccacaacctggccactcctcaccacctccactcccatcgccatcgtctggtcccaggcaccatggtctttcatctgatttttgccatggcctcctggtgggtctcattgtcttcatccttgtccccccacccatacagtctatctcaacacagcagccagagtgatcctttgaaaatgtgaagcagtcacatcacacctctgcttaaacctcccaaatggctgggcacggtggctcacgcccataatcccagcactttggaaggccgggcaggtgggtcatgtgagatcaggagttcaagaccagcctggccaa

SEQ ID NO: 43034 - DNA, 1042 bp, Homo sapiens
acctctgtgccaggcacctacatacctgcggtcctgtgagggacctcctcttagctggcattgcagctggactctgtcgtaggtgagagctctgttatagcagatgtatgtatcaatcagagttctccagagaaacaggacctgtaagggtgtgtgtggaaaagagagatttattttattttaaggaattggcttgtgattgtggaggccggcaagtccaaaatttacagggcaggccagcaggttagagccccagggaattgctgatgtggctgctggagcctgcaggcagaattcccttttccttgggggaggccagtcttttcccttaggccttcagctggttgatgaggcccgcccacatcatagagggcaatctgcttgactcaagtctactgacttacatgttcaaatctcatctaaaaatataccttcatagaaacagctaaataatgtttgaccaaatatctgggtaccgtggccgagccaagttgacacataaaatcaacaatcatgagacatattaacatactgtagccctttacttatccacaggttagagctccacaaacctcatcccccccttagtcagagcctcacacccataggtaagtgctcatagtgtctgggtagaggaaagcccgttcacttgtcatcaggcatgacccttgaaagcatcacagtattaggatctttaaggagatctttaagagataagaaggcaataaggtgtaaattaggtttcagagactctgtagaagaaagagagtatagggtctttttcttacatcttagaaaaatcccattcaaaagatttaaaggcttcttgtaacattactttataccccataaatatatacaactataatttgtcaatatataatttaaaaaaagaggctttctggaagttttcatctttccagaggaaatacctctttctgtggtggtctcagcaccagaatgggaacctcattctaaggagatttaagttcctgcagcacagaaaggctctttcttaaagactgtaatgttactcccctgc

SEQ ID NO: 43035 - DNA, 1077 bp, Homo sapiens
ctgaggcatgagaatcccttgaacccaggaggtgaaagttgcagtgagatcatgccactgcactccagcctgggtaacaaagcgagaccctgtctcagaaaaaaaaaaaaaaaagagagagagagagactaataaagggtatgaaatcggacatgatctggtttacgtttttataggatttcaggagtggattggcggggggtgcggagccatgtctgaggctcatgcatttgatgcagaccaagtggagagatgctggtggtcagagctggggtagcagcagtgcacagggagagaaaggacagattcagatgcactttgagagtgtcactcatgggttgcctgtgggggctgtggaatcaagactgactcctgggtctgggtcctacagaagtgggtgaatggtagtactgtttgctgaagtgccaagccctggaaaagaacctgtgttgctggttctagtttggagtcaagagttctagtttggacctattaaaatttgaggtgacactcaagtagcagatcaagtaggtgaatataggagtctgaagttcaagagagagcttggggatagactgatttgggagttacaggttgcagtgacttccaacatcagcgacctgtaattggccaaacctcacaggttgagggctcatgcctccacaggaccgttctctcttcagacaccagctgcaaatttgggggttctaggccaccctcacttctgaccagctggctacaaattctgggcttcccatcaccccgtcataatttgctagaatgactcatagaactcaggaaagtgctatatatatcattacagttttatcacagcaaaaggattcaaatcagagctagccaaaaggagatccataaggctaggtctgggatggtcctaagcctgaaatttccattgttccctccctgtggagtcaggatgtgtcaccctcccagcatgtcaacgtgtgaaaatatgcagagcattgccaaccagggaagttcgctgagctttggcgttccgagtttctgttggggcttctttatatagatatgattgattgaatcattagccacgag

SEQ ID NO: 43036 - DNA, 1032 bp, Homo sapiens
caggcttcccctaaattggggagcaggactcctctagggagaaaggaattcaaactgaagaccagggaggtgatggagcgtgaggcatgagaaccactgggctgggggacagggtgggtgggagggggaaggactgggcctgacgtcaccattctgatgctcagagcctgggctttgtctcccactgccccccaaggtggtggagaactgtgcacttggaggaaagggggcaagaaccgcatttcctggggtggtaggttgggtggccactgccacgagtgcaaggagggcctgttatggtgctgccaaggtccaggtgggtcaggtgccagggtgggactcacatgtcccagctgcccacacctgcccaagtcagatgccccacatgcttagtggaaacatgactgccaacccatctgatgcttatgtttccagctccctgcattccattcctgtgggcctctagatggttttcaccttggataaaattcttttcttcctattgagagactgtcctgagataaaagtgagcattgtcagtgtgtgtgctggctcacatctgtaatcccagcactttgggaggccaaggtgggaggattgcttgatcccaggagttggagaccagcctgggcaacatagtgagaccctgtctcaacaaaaatttattttttattttttatttttatttatttattttttgagtcagagtctcgctctgtcgccaggctggagtgcagtggcaggatctcagctcactgcaacctccgcctcccaggttcaagtgattctcctgcctcagcctcccaagtagctgggactacaggtgcgtgccaccatgcccagctaattttcgtatttttagtagagatggggtttcactatgttgggcaggatggtctcgatctcttgacctcgtgatccacccacctcggcctcccatagtgctgggattacaggcgtgagccactgcgcctggcctttttaaattgtattttatttatttacttttttgagagacagagtttcgctctt

SEQ ID NO: 43037 - DNA, 1005 bp, Homo sapiens
ttttctttcttttcttctttttcttttcttttctttttttttttttttttttgagagagtctcgctctcttgctctggctggagtgcagtggagcaatcttggctgcctgaaacctctgcctcccaggttctaagcgattctcctgcctcagcctccggagtagctgggattacaggcatgcgtcaccatgcctggctaattttgtatttttagtagagatggggtttcaccgtgttggctgggctggtctctgaactcctgacctcaggtgatccacctgcctcggcctcccaaagtgctgggattaccactgcatgagccaccgcacccggcctaaggcagagggaattcttaaaagcaaccaaaaaaaaaaaagactaccttgaaatgaagtacagcaaaatgaatgggggccagcttctcaacagcaaccatggaagctaggcaaaagtagaatgatattgtcaataggctgaaagaaagtaactgtggtcccatagttttatatgcagcaaaaatgtttcagaaacaaagatgtaaagaagacatttttagacaaattaaaaatgacagtttgctaccaatacactcttagaaaaggaaattctaaaagatatacctcaggtaaaatgaaaattttcccaaatagaaagtctgaaaatatgagaagatgtgatgatgcatggaaatggttaaatctaaacaaatagtgacttaataaaacgtaacaatttcttgttgtgttaaaaacaattaaaatacatgatggcattgatgtaaatatgaggaagagatgatcagaactaaagtgtttaaagggctttgttaaagggccttctatgtatgtttcccataatttctaggatacttgctaaacaactcgaaattggtcgtataacttacagatcagaaagggggataatggaataagaaaaaattaatgtaaaagaagacaagaaagtagagaagaaagatgggataaatagcacaaaaaaggtaaaaat

SEQ ID NO: 43038 - DNA, 1092 bp, Homo sapiens
gtggctgggactgcaggagcccgtcaccacgcccggctaattcttttgtatttttagtagagatggggtttcaccatgttagccaggatggtcgcgatctcctgacctcatgatccgcccaccttggcctcccaaagggctggaattatgggcgtgagccactgcacctggccagaaatgatttttttaatccatatatctatcagtatataatatcaaagtgtagagacaaaatgaaaacaaaagagaggaggcaaaaataaaaacctattgggaatgaaaatgtgtgcattcccatgtctattggttgatgctggtgtgtagactgagattgtaggtaaggccgttgaacagaacacttcatgcaccctcttcatgtggcttgggatttctcaagggattctagcacctggctgcctgtgatttgccccacttgacagagagtggagcagagacgaaccatccatgtgccaccctcctttaactgcagattcacatgcaaagtagatgatgatgtcttaagccactaaatttggggattatttgtcatacaggagttgatggttggaatagatacctagggaaaatgttaaaacattgaaagatattaaaaatggagtctcaaaaggctgggcatggtggctcatgcctataatcctagcactttgggaggctgaggcaggtggatcatttgaggtcaggagtttgagacccgcctgggcaacatggtgaaaccctgtccctactaaaaatacagaaaaattaaccaggagtggtggcacacacctgtaatcccagctacttgggaggctgaggcaggagaatcacttgaacctgagacagaggttgcagtaagctgagatcatgccactgcactccagcctgcagcctgggcgacagagcgagagactccatctcagaaaaaaaaaaaaaaaaaggatttgcatactatgtttatgaattgaaattcatcctaaatgtgtcacttttctgttgggtggggtgactcatgcctgtaataccaggacgtataatcgtgccactgccctccagcctgggtgacagagtgagaccgtgtctttatttatttga

SEQ ID NO: 43039 - DNA, 1045 bp, Homo sapiens
aggtcctggaaatctgatcccccaaaaaacaaactcacaagagacagattaacaattaaagatgaatgtaggctgagcgtggtggctgatgcctgtaatcccggcacttttggaggccgaggtgggtggatctcctgaggtcaggagtttgagaccagcctggccaacatggtgaaaccccgtctctactaaaaatactaaaaattagcctggcatggtggcaggaacctgtaatcccagctactcgggaggctgaggcaggagaatctcttgaacctgggaggtggaggttgcagtgagccgagatcgtgccattgcacttcatcttgggcaacaagagcgaaactccgtcttaaaaaaaaaaagccaccatgtaattttaatttatatcagagctggcttgacaccccggctggtctgctcagaaaccacattatggtgcaaagtgttcgtttattaaatatatttataaaatctgagcatgggaatgggaggtagctgtgggaccctgataaacagtgccaaggttttcgaactgtgatcaccagaccaatagaatcagcatttcttgggaactagttagaattgcaaattcgcatcactttcatcccctcctgtttcagacctagaaatgttgaggtttgtgcctagcatcctgtatttttaacaagaaccctcagtgaacatgatgcacactgaagtttgagtaccactgacttagagaaactttttttctaaaaaacgaagactagctgtcaaacattatagcactctttcctcaacagagctcattaaatcctagcatttttgtctccagcccattttcctgaccctttctttctttctttttctttttttttttttttgagatggggttttgctcttgttgcccaggctggagtgcaatggcatgatctcggcttactgcaacctctgcttcccgggttcaagcgattatcctgcctcagcctccagagtacctcaccaccacacccagctaattttttgtattagtagagatggggtttcatcatgttggccaggc

SEQ ID NO: 43040 - DNA, 1051 bp, Homo sapiens
gatattcagttttcctggcaccatttattgaaataaccatccttattccaatatatgttcttttttttttccttttcttttttttttttcttttttgagacggagtctcactctgtcacccaggctggagtgtggtggcacagtcttggctcactgcaacctccgccttgcaggctcaagcaattttcctgtctcagcctcctgagtagctgggactacaggcgccagccaccactcccagctaatttttgtatttttagtagagacggagtttcaccatattggtcaggctggttttgaactcctgacatcaggtgatccacccaccttggctgcccaaagtgttgggattacaggcgtgagccgccgcacctggcctaatatgtgttcttgacacctttgttaaaaatgagttagctgtagatgtatcggtttatttctgggttccctcttctattctgttgttctatttgtctttttttatgccattaccatgctgttttgattaccgtagatctgtagtataatttgaagtcaggtaatagattcctccagttttgttctttttgcttaggatgcctttggctatttcaggtttttcatggttctgtatacactttaggattattttttctatttctgtgaagaatgtctttgatattttgataggaattgcattgagtctgtagattgctttgtgtactgtggacattataactaattcattcttccaatctatgaacatggaatatctttccattttttggtgtcctcttcaatttcttgcattaatgtttcataattttcattctagacatcttttacttcctttgttaagttttttcctaggtattttattttatttatagctattgtaaatgggattattttcttgatttctttttcagattgttcactgttggcatataaaaaggctactgattttgtatattgattccgtatgctgcgactttgctgaatttatcagttctaataggtttttttgatggaggctttaggtttttctttcttttttttttttttagacgga

SEQ ID NO: 43041 - DNA, 1045 bp, Homo sapiens
ttccaaagtcttgagcagagttgggggccaatggtagcattgctgtcatctctgggaggagagtgagtatacaagtcagtgacagttcagccaggctcccttgggtttgggaagaggcactgcccttctgtgctgtggatcctgcttgtctgctctggagtccccccacccttgccaggagcttcacaaaccagagacgggctgtcagcaagagctcagacaggatgtggtgcaagtgcaggtgcacgagtttaaccctcagctgcaggagctagtctcaggtgttctggggatgcctcaggctaagaattttgccgactttctgggcttggttggctaatgccaaatgcccctgcttaaatatcacaaggtgctgattctccttttttctttttttcataccaatgtgctcaaactttgagctaggtcttgtgagtttgcctagcactcagacctgtttaagtaacgttctttacattgaaacaagtcaaccgaagctttgtggtgcaggagctgagggtgccccagactcagtgggagccctggttgggccccaaactctcccagcagggtcctcggtttcctcatttgtgaaataaatgagtgggccacgacgttaataagcccaagagaactgtgaaggtggtagtcccttgccctaattggtgctcaataaagttgttggcataaacgagtgcgtgcgcttgatctggtttctgctctctgggaggtgagtggccgtgcggggcggtggcagctggcgacacctgcgggctgttgggcaccagcccggggcgggcgctcgcacctgtcgggcgtgcacaaaggcccggcgcacgctgtgggggcggggcctcccgggttggccaatgaaaagctggcactgggtcggaggcgccagccaagtggggggcggagcttccaccaccggccaatggggatctggcttcgggatgtgggcggggtccacccggtcgcaacccgttgagtctctgcacagctgccgcgctgacgcgttttccgcgtgtcccgagccccggcggcc

SEQ ID NO: 43042 - DNA, 1032 bp, Homo sapiens
ccaggaactggacagcagacaaggaaggtaatagtggctgccggggccctgggtgtagacagggctgctctgaggatgccctaggcgctgcacctgtgggctcagatctgctcctgagccaacatggtgctctggaaacagacctgggcagagccttgttggaggccagaaagccagatagtctgcagcacacacgtgtagacctgctggcaccttagtgccactgtctgcggttccaccatcccagctggagctggctccttgtggctgggtgtccttgtcccggccgtgccagccccacgagccttggtgtctgggcaccagtctccaagcccaggggtccacgcagctgggtctgggaatagagatgttctggagggttcaggcgctccctggaacatgacagatgggtgtttcccacacctgatgctggtgtgcctgagagcccagcaatggcagaaactgttccctgtcccttcttctgtggcagcacgaggccccgtggggctgacaggccttctgatttctcattaaaacaggactgagggctgaggcctgcgagtcagccgtctcgggcagggtaggggagaagcgcccacccggagcctccatctggtcagcccacaggtgttcacctccagctgcgtccccgcctgccaccagcgggggttcaaagaccctggggccaccaggccaggagtgtggaggtggctcccagagggtgagctggcacctgccctcggtactgacagccccacttcagttaaagtgtttgacaaggaaatagacttccctctctgtccctctgtttcttccccatctctcatcctttccccagaggacagaagctggtgccaaacagaaactgaggttcgctaaacaagaagataaagtgtcacaaagtgctgacaaggagcggggtcgggaagatcattgtttgtgtccatccattgggtttctccagtggagaagcttcttgagggggctcccgccgtccactgctgctgcttggtttaacttccagcagaattc

SEQ ID NO: 43043 - DNA, 1164 bp, Homo sapiens
tggctctggccaaacgatcgtctccctgccccaaggtctctgtgctctttctataggtacagctcaggatccctgcccggtttctcagctggagaaaaggcccagggttagtgaagcatccagaggcctggagcttggacatggaagacccagagttgcaggtgaactggtggcttcccccattccctctgcacgggccaggacccagagccccagcttggggaaaacagccttccagggtcagtgtttgagtgatgggtaggaagtctcacctgtaatgcacttcaggttgcatatttcctttcagtgttttatcacagaagcagttgggattttcataaaagcagacacaccttttagaggtggaaattgagaagtgaaggatcaaagtttggggcttgaggggactttagagaataggtgaggaaactgaggctaggatgacctggccatggtcactgtgagagggttggctccatgtcacacacgtgccctacggactcatggtggagacatgcagggggcctggcacctagtgccctgggtcacttggggacagccccacaccaggaactttgagtgtggcctgcggcaggttctcttactggctcagggtgttggcttctgtccaggcgccaccactttgctgtgagctctgagctgcctggggccaccgagccttgcctgtcctctgtagaagtcctagctggggtctccaggccgagatccttattgatgaacttgaccaaacagcggttgggtcctttagctactccagtcttcactttttcctcggtttaaagccctggaggtgccgaaaagagcagggcagagccacagctgggggcccagagaaacagggaagaaaccatctctgcgcccggcctggggctgaacaggttaggaatggcaggtgcctggccaagcctttcctgtggtttgcccagggttgggaccaattccaagggaatttagggcgaaggattaggtgatctttttttaaaaaaaacaaaaagcttatgactcctatgaatctgtaacttctcaatagggagagtaaaagcagaagggggtgggaacccttgtggtttgcctgtaacgaagagcactgagttctggagtggccccagggtcaccccacaaaaaatgcgcagaaggcccttg

SEQ ID NO: 43044 - DNA, 1058 bp, Homo sapiens
cgggcgcggttgcgggtgggagggcgctcgccggcagaggatccagcgcggacgctccctgcagcgccaccctgcggccccttcgagtttcggtgcggcagcggcgagtgcaccccgcggggctggcgctgcgaccaggaggaagactgcgccgacggcagcgacgagcgcggctgcggagggccctgcgcgccgcaccacgcgccctgcgcccgcggccctcactgcgtgtcccccgagcagctgtgcgacggcgtgcggcagtgtcccgacggctcggacgagggccccgacgcctgcgttgaggctcccgcgcccccggccatgcgcggcccccctggccaagccggcgggcccacctcttcccgagcgccatccccaccttcgcctcctgaggcacaggtgggcgcggcagctagagtgatttaggtttgggggcatccgaggctgggccacgtttgcgttcctttgatctttttcgtgaaactttatttgaaaagtttttaccctcccacctaggcccaggagagcgaagaaaggggctttgtctttccccacacttggccaagaagggataagagggtgggcagaggctctgcggggatgaggagtgtgtctgtttggagggatcccgccctcagcatttccccaccagacctgagcagaccctctgtgtcactgcaagccagcccttcaggtcctgtctacctccccctatagcgagctgtccacaggccccccagctcctcccaggctggcctgtctggccgcctcccacccgcctttctgcccctctgcagggagagggcaggaagggacaggagcggagcaggacacatctcacagtgcccgcaggctccacccagctgcctctgtgccctggcctctttccctgtggtgtggctccggggctgtgcctgacccctgagcagctctgtgatgggatcccagactgtccccagggcgaggacgagctggactgcggtgaggatgctttgttccctgagggaggccccgctggctgggcccgggacacagctcacaccccccgctcactg

SEQ ID NO: 43045 - DNA, 1021 bp, Homo sapiens
cctcagggccgagcagggagtccgtgggtcagctgggctcccttcctcgtgggctgatatcaccgctgcatgtgtgcacaggcctcaccctgcagaccacaggccagggcactggaggacacccacagaggcctgtgccttcacttccatttcctcgtggagcaccccctcccaggggcttgggctgagctgagggacagctgtcatcctcatctggccaaggagggagccagggctcagcgatctggtgttgctacgtcccagggctctacgcccccatggtgcaggagcagtctctgcatttggccacaggccacctgcttccttgctcccccgccccaccgtggcttccttcccctcctctggctcttcttgttcccatctattccacccctctctcctttttctgacaggtccatggccaacctctctgtcctgtttgggcaggtgagtggccggtagggtggagggcctggggtgtggagtttgtgccgtgtgtgccgctgtgggagctgcctattgactgggtgtgggcgggcagaggagctggggagaccccagcccagagccatggccactccctggagatgctgttgtcacccctactcctgcctccctgcggactttggatcccctcccacaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcaggtcagcacgggtgagcaggcgtggggatgggtccctgggccggggatgaggcgagtggattcgggggtggaggtctggactaatgtcccccataaacaggccctctcagagggctacagggagacttcaggagggacccgggcaacaagggctgggagcctggtctgactgggggtctctcggctcctcccagctacccctgccgccccggcttcgaggtgctgaaagacttcaccctgac

SEQ ID NO: 43046 - DNA, 1034 bp, Homo sapiens
ccacccagccagcctgcttccctcctgccggtccccaaggacctgggggagggaagcctcctgccggcctgtactggggagggggcaccccctccctgcaggggcatcttgggctctctccagagttcttccattcgtctgcttcctgtctcggcagcccggccccggctccacggggtgtctcaccctccccaccacaccctctctggtctcaggcccacctctggtgggtgccctgaccctgcgaggctccgttgtctgcctgggccttcactcccctctttccccagctcattatcactccctccctcatctttgttgctttctctccgggcctgggccttgactcctttctccctcatttttcttgcggcctttcccacctcctctctcctcctccctctactcagcctctcggcccttttcggcccccctcgcctcagtcctctcctgtctccttgttcttctcttttcttcctataaataactctcctctgtgctgtggctgccgctaagggccactctgaggcccttcatactccaggaggatccccagcagcgcagcctgcgcgtggtggctcctgccctcccagggctctcgatggtgatcaggcctctcccccatccaggttatgcctccgcctcgttgccctgaaagccgcagcgacagcgaaaagggctaagattcggccatgagcagcgcccctcggcgccccgccaagggcgcagattctttctgtacggtgagtgtggcccccaggtcgccagcccaaccttccctccctgggcagccttgggtgctccggccaagggtcctcgccaaccaggggtgtgagcgtgtgtgagtgtggagactgggaggatgctgccatccctaccctgactttgcatgatggtcgtagggggggatgggtagtgggggtatcagacgtcttccagtcctggggagggagttgaggctgttacctgaagacctaggtagcttagcctcagcggttgaggaactttgagaaccctgggtctctcacccagca

SEQ ID NO: 43047 - DNA, 1104 bp, Homo sapiens
gcatgagccttggaatcaccaggccagggttcaaatcccaggcccgcactcactggctgggcaagtaacttaattaagctctccaagccccaggttcctcatcagaaaccaagcataacagaacgtttctcactgggcggctgtagggattaagggtggtgtgaattaaagttctaagtatggtttagcctggcaaagaacacgcgctgcctaagctgcctcccacccctgcccgtctcccacccctgcctgtggtgtagtgggagcaatagccagcactggctcaggtactggactggtgacctcccagcacttgctggaggccccagggttcaagaggcaaaggagaccccctctccttggggcactgccaacacacgctggttggaaaccagatgttatcatgtgagatggcatcagcatgttgtcactgcacccagtggctggttcaggcaaagtgtcagtaccagtggatgattggcatttgggggaaggcttcctggagaaaatgactttgaactaggtctcaaggtcactactatcacggacctgttgttttctgggtgccaggcagcgtgaagggctgcgggaagtgaagggcatgttgtcccctctgggagcgcataacctgctgggaccgtggcacagatgcgggcggcgggttacagcggccttaggggcgccaggatggcagggaggaggctggggcttccgagaaagcctggcatcaggaaagggtcgggtttgtgggccagggcacgtgggggctaggagagcctggtcatgggaggggactctgatgttgagtcagagcttggagctctgggggctcttgatgttgagagagaggggtaggaccacgtggcagggccctggccacccagtgtggcagagagaagggagagagcagaagctggcgtctgtgaagcctgaggcttacccctcctcccagggcaggaagctgtctgccatctccaaggcccggtgccacggactttattcctcttgattaaacataggcccctgtgaacctctgagtcccatgtctagggatgtgccagggggtgagggggcagggggatgaatgctgactgtcaggaagca

SEQ ID NO: 43048 - DNA, 1054 bp, Homo sapiens
ctgctccgaggcagcgggatcacggcgctgggaagcgctcggcagcggcggccacagcgtgcgcggcggcgcctcctggcctcggcctccggcccccggcccccggctccatgcgctagccccgcgccgccagcccagtagtcccggccccgccagccccgcgctcccgctcgccgctgccgccgccgccgccgccgccgcctccgccgcgccgccccgggcccgcctcgggccccacggctccgaagccatgaacttccaggcgggcggggggcagagcccgcagcagcagcagagcctggcggctccggggggcggcggcgctgccgcgcagcagctcgtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgagggtgagcggagccgggggctgcgggagccggggcgcagtggcctctccggcgccggccgagggctccacaggccgtgcctggccatgctctccctgtcgggggtccttgcgcgcttgaggaccaggccacgaggtttgccgatctgtgttgcagaaccggcgggcagcttcgccatatctcgttcggggacactttggggttgggggttttctgctgactgtgttccagggcgcgaaggtggtgtcgcttgggggggccgggaccagatctgtccaggcctggccggggaaggtgggcgcggcagagggcttcagctgcggggaggtggggtcgtgaccggggaggcttcttagccgctgcccgggccctgctccgcagtggggcgggggatcggagcctcgcgttagtggatggcagccttcccgggcccagcgcccgcaggcccggagggtggcgctcgccgcggcgccctc

SEQ ID NO: 43049 - DNA, 1764 bp, Homo sapiens
gttcccgtccctgctctgccactaactggctgtgagagctggggcaagtctgctctgggtgcgtcttctgagagtcacattctggttgtctatgcagctaggggtgaccctggcgtgagtatctggaacaggccaggcttggctccctggccgggggtcttgtctgtcaagtgagcacctgagctggggtccctgagatctgttctgaggctgcctctgtcatgcagcactttgagatgcgccccccttggagccctccaggagctgagaatcagaagagatcctgtggggagaggtgagattttctgtacctctgtttccttacctgaggtgggtcataacaaagctctgccgcttggtagtgctgaggattgagacccccaacgcggtgtgcttagaacagtgcctagcgtgtcataagcacaggtgaaatatcaggcattattctgaaaggcggcagggtatcctgtgtaagggaatgctgtttattacgtgccgccttgtacgcttgtctcgttattgcttttggacaaattttcagaagaaaatggtcagactctggggtcggcacatttttaggacgtttgcggcactctggcaccctgccctccagaaaggccatttgattttcaggcatagagacagcctggagttccctgccccacttccccggcaccccttcttcatctgatacgtaagaaaaaaaaaaaaaagactaaatgactctcgttgttttactttgtttgactttgattactagttgatcactagctatttcattattggattcactttgactattagtgagagttgatattaaaacatttttgagaggtcatttgcattttgttcattctgtacatatcctttattcattttacttttggtttgttcctctttttcttttttctttttgtaaaaatggggtctcactatgttgcccaggctggctgtaaactcctggcctcgagtgatcttcccgtctcacctcccaaagtgctggcatttcaggtgtgagccaccatgcctggcctcccctcccttcctccctcccttccctccttccctctgtccctcccttcctcccttcctcccttccttccttccttccttcctcagaatattggtctgtcacccagactggagtgtagtgacgcgatcgtagctcactgcaacttcaaattcctaagctcaagcaatcctcccacctcagcctcttgagtagctgggactcaggcatgtgtcaccacatctggctaataatttttaaaattgtcttgtagagtcagggtctgtgttgcccaggctggtctcaaactcttggcctcaagtgatgctcctgcctccacctcccaatgttactttttcttattgagctgaagaccgttttaatctcttttaatgtaggtttttctacaacgtacatttctctgtttgctgcaagtcaggcactgtctgagttcccatagtcagcacttcggcctcaatgtgccctgagctgagcagacagtgccatcctctgggccacccaggaggctgaggctggctgtgcccgctccataccgtagccccagatggctgtaccttagggctttgtgcctgttccttttctgccagaacccctccttaccgccgtaggggtgcctgcctacagcagcttccctttagccttttcagtttggtgttttgatggcttgcaaacctgaaaccccagcgcctggagtgggatcaaagcctgtcacaggggcagagggaggaccgaaa

SEQ ID NO: 43050 - DNA, 1032 bp, Homo sapiens
gttaagcacctgggctctggagccaggctgcctagatttgagtcccagacctaccacttgggagctgtgtgacctcgggtgagttccttaacccctctgtgtcttagcttcgccattggtaaaacatgggcatccgtttcatggtgtgggcgtgagaagcaaatcagttaacgtctgcagagcttttagagcagcagctgccctgaggatgtgcgtgctgggtggcgactgtctcattacttgtctcagaggctcagctgtcatcaccgcctgcgtggggatgcgtgaggtgagggctgcatgagatcacaggaatgaccatttccggacccgagcctgagagcccaggtggcagagtgtggggtacgttggtttagctcatccaggcccaggggaagggacctgagggggcagggctgtcacagggcctgcacgttcccgtgaacacccagggtcatctttgatgttttgcctgttgtttttttctctgattcagcactgtgcagtagacatgggcgagtcacacgtgtgaacttaaattttcttttctttttttttttttgaggtggagtctcgctctgtcgcccaggctggagtgcagtggcgcgatctcggctcactgcaacctctgcctcccaggttcacgccattctcctgccacagcctcccgagtagctgggactacaggtgcccaccaccacgcccggcttattttttgtatttttagtagagacgaggtttcaccgcgttagccaaggtagtctcgatctcctgacctcgtgatccacccgcctcagcctcctaaagtgctgggattacaggcatgagccactgcgcctggcctaaattttcttttcttttctttaacgagacagagtcttgctttgtttcccaggctggagtgtagtggtatgatctcagctcactgcaacctctgcctcccgagttcaagcaattctcgtgcctcagcctcccaaggcacatgccttgggattacaggcacatgccaccatgtctggctaatttttgtat

SEQ ID NO: 43051 - DNA, 1050 bp, Homo sapiens
taaaagtcttgctgaattcacagtagtcttttgtccctgtgtgttttcttaaaacctagaagtacaactgttgttgtgtgtggtgggtgacaaagtgtgttcatgttaaggggcactcgtgttcccaccttgggtcctgtgccaggtgggagggtggagcccaggccctgctcttatgagatgaagtgcatgtgggcccggggactggcaccgggaccgggccgctggccgctgtcagtcagcatcttgaccacctgctaggggcttccctcgggaccgtgggtcagaggcctcagtcagcaaagccacagtctttcctcaccccatcctggcattttaggcaggggccatttttgtaaggttttttttgtttgtttgtttgtgtttgtcccatactaagtaatatatgtaatagcagaaagtttgtaaacacacacggactcttggaaactgtgttgcacagagggaagctccctgtctctccgcccacttcctggctgagaaacagggagagcccccaccctggaaatgaggtgctcatggactgtgctgggaagagcccgcggtgctgcagcagtcagtgacggatcccttcctacccgctcttgtgaatgtcgggaaggacccggggctttgtgggagcctgaggacaggctgcagggggcagcccctgcctgcagtgcgccctttgtggcgtctcagatggggtgtcctgagcccaactccgagagggtcttgtggggatttcgtgctcccccagctgcggtgctgttttggagggagatgccgtcctgaacccatgttactagattctcatcacatcccgggctggttgtggagcaccaagaaccctcctggcttccatgcctgggagaggcttggtgtgaggtgccacctgagcctgctctgtgccctgcacttctctgtgtgggtcctgagccgtacagcagcccctaagagatgtgtcgcgttccacttcacatgggaaggctgctgtctctcccagcagctacgccagtgtcgggattgctcagcaagctgcggtgtaaa

SEQ ID NO: 43052 - DNA, 1681 bp, Homo sapiens
cacccagctaatttttctatttttagtagagacgaggtttctccatgttgcccaggctggtctcgaactcctgggctcaagcaatctccctcggcctcccaaagtgctgggattacaggcatgagccacctcacccagccgctacaaaaaatttttaaaaattagccaggtgtggtgttacacacctgtagtctcagccacatgggaggctgctgcagttagataagctatgattgtgctactgcactccagcttggactatatttaggaagaccttgcctctgaaaaaacacacacaagaaagaatgcctttctcttagttctcatactgtgccaggcactgcctgtgtgcttacgtgcccttctcgtattcctgcaatttttggagcatccctacagggtagtattaaccccattttgcagatgaggaaactgaggtacacagatgtaaaggaaatggcccaaggctgctcattcaaatcgtggagacaggacctgtacccaggaagtctggctttggagcctgtgctgccacctttatgcacagggagaaagataagacctttaaaaacagagcagaaatttagaagaatgttgtctaatcttgggatgagagatcctcttaagcggacagaaaacccagaatttatagaggaacaaactgacagattccccccacccccagctttttattttgaaaaatgacagcatttaaaaatgtgatcattattaacattttaccgcatttgctggctctctgtcactgcctcatgctcacatatgttttttcagcagttgtagacacactgacacatcttcccaagctcttcagcaggcatctcctgaggacaggcacatcattctacacaaccattacaccagaatagcacctaggaaggtcagaagagctccctgatatttagtagctgacccataaccacacttccccagcgatgcctgaaaggtcttacagagctttttttgttttcctagataaggatgaaacaggatccaatgtgataccttttcccccatgacatggacttattgtagggccaggacccattttcctgtagaaggcccgagtcctggaaccgtgacgtgggctggctggcgctgggtgttttctgtcttgttcctttctcccttgtggggtctttgaactgaactgtgatctggaagctcagcgggaacacccggttcctccacgggaccacagccttagtgccgtggcgggggcgtgaggactgggtctctccaatgtgaaggttcatttcctccctctgtaattagtaagtagtctgtaggggtgatcattccacacgctcgaaataaactgccccgcacaactgttcacctgatggttttagcgtccatcaatgatctttgcctgagttggtgatatcgggattgtcaaggtggccgtaaacccgacaatctttctgtaagtattagccagtgttctgttaagagcagcatcttcccactcttatctttagtgtcgcccttgtgtcatggattttgttgttcaaatgttataaccagtgacaaaactagcagacatgtaattacatttctgggtcataaagcaggaggacctcttgcagtgcacatgtgccggatacatgctttgcgtgcccgctatacgaagagctcctgcagattaagaaaacgatttgaa

SEQ ID NO: 43053 - DNA, 1073 bp, Homo sapiens
caaaagaaaagaaagacaggcaaagagtaggatcaagacaaatgaaagaagaggaaatgctttgtgttgctgatgaacatgaaaaggcgcaacctcactagtaatcaggggcgtgcccatcagaagcgccagggactggttccccggttggaagagcagactgctggcgcacagggtgcaccgacatccccacccacggctggtggagagcaggagaagggattgctacgaccaacctggaaaagtaacggcgttatccattcacatgaagcattcacatgcctcgggaagaacacaccataggcacacaggtattgattaccgccttgcttgtggtagctaaaaaagaaggaagtgacgtgactgtccctcagcaggggaagggttgaagaacggacagaacatgcatactgtgagatgctatgaagccaggccaccggagcaagctagagccaacccagtggcctggggagggccccaggtgcccctggcggggcggtttggtgtgaactgcagcgtgagcaggagctgggaagacagtcactcaggacgcatctgtgttaaggagagggaagagggcatgcggccaaaacagtggttttctgagcatgttgtgaatgttttcttaccctgaaataaaatttaaaaaagattggcagagtgcacatttatactagccacagcctgtgttcttcctctgtatcccctcagagtctgactcagaggattttcctctcctcattccaagggggaacagtcttctgtttctttttacaaagtaatatatcgtctgtaaacatttcagaaaacagggtgatgtacacttactgcagaaaaacataaaagaagcaaaagaagtcaccagtaattctaaccagaggcaggcagccacggtcaccattttgtcattattttgatattttcttgcattttttatacaggtccatataattttgttacatacaaatttgtatctgactttttaaacaatcaagtattatgccagtcatggtggctcacacctgtaatcccagcactttgggaggctgaggtggaaggatcacttgaggcca

SEQ ID NO: 43054 - DNA, 2046 bp, Homo sapiens
agagaaccacatttttaaatgtcgaaagtgtaggcgatgggtcagttatgagaaaaaggtgcaacacggcatagagccgtacgatgcttcatattctgagtctggagcccccaccgtcccaccctgtggtggtggcccacctcctgcccccacccttcaggccatgggagggctggagatgctgtgaggtgtaggatcctctggcacggcaccggcccatgcggggggtgcagcacatgctggtcgcgttcctctccagggaggagctgctagaaagcagagctaagcccacagttgctgttgctggtcagagctggagtggcgtcacgggcacttccagggtcttagaacatggccagatgggacaaagccaggaggccagatgggggacatgctaagggaccgagtcttcgaggggagggcctttgtcctgtccaccattgcacccagcacagagctcatggatagacaggaaaacaaactgctctcaagtaccatctgtagtactacaataccgccatgtcaccggcctggtgtcgaaaggccattttcggctggaatgacagccactcccacccccaccctggggtaatctcagtttccctgctccttgcactgctctcggtcctgtggctctctctgccacccgcacccccaccagcacctctgccgccttctctccctcagcttttccctggggaggagaggaccaaagtcactggggagctctcagaccgacatcctgacctctggagatggggcagaatccccgggcctcagagcagccttcggagggtcccaaggatgtaggctgggtcctacgccagtccagactgccagccgcgtcaccttgaggcagggtggggcagagacttcagtctgcttgccctgaatgcacttagtaagcactcaaaaaataatgtgaaatgatgacttagaggcccaagctccagcctgggattctggagtcctgggccctgcccaggctctgtcactgctgggctgtgtaactgcaggcaagtgacttcccctctctgggtgtcaatgccctcatctctaaaaggagaggatgaaccagaacacgagttctgaacctggaacccatggcagggattaaggggactcggacctcctcagaaaacacctgtgtgttcttcccagtatgcactagcttttctggagagctcatagcttcctagggctgtggtaataaaccattgtaaacagggtggtttgaaacaacctaagtctgttcctagctggctgcggtggcccatgcctgtaatcccagcactttggaaggtcaaggccagttgatcacttgagcccaggagttctagaccagcataggcagcatagtgagactcccacctctgtaaaaaaaaaaaaaaacaaaaaacaaaaaacaaagaaaacaaagaaaaaatagctggacatggtgttgcatgcctaaagtcccagctacttgggaggccgaggcaggaggattgcttgagcttaggaagtcgaggctgcagtgagctgtgattgcctggttaacagagggagaccctgtctcaaaaaccaaaaagtttactgtgtcacagttgtggaggccagatgtctgagataaaggtgtgggcaaggccacgccccctctgaaggcactagggagagatccgccccacacctctcttcctggcttgtcgatgccgtcttctccctgcatctcttcacattgacttcccttggtgtctgtcgacatgcccaaattccccccttttataaggacacgagtcagattggattcagggcccaccctactcaagtatgacctcatcttaattacatctgcaacaaccctatttccaaataaggtcacattctgaggtcctgggggttaggactcagggctctccagggtcctccgtatctctgaggtctcttagaggggagatggagggaccagcccaggaatcaaagccaagctgagggggagctgctaaggtttcatgggctgactgcatctgcctggctttctgatgtggagagggctggtttcagtga

SEQ ID NO: 43055 - DNA, 1100 bp, Homo sapiens
ttctgactttatggatgaccggaaactggctgggcttcagagcctgggagaggactgatgtttacaatgcagtgtcaatcacagccggggagctcttgcctccaattctgggtgagctctgggtttactgggtgtccaggcagcccacagtcatgaattggaagggcctcggagcttggaggagtgttttcatttacagaacgtcaggctggagccagtaccgcaggctaccacttgatctcagcccatcatcccgacaggaggtgagacccagtgagcagcaggggcctggagaggtccgggcctcagaagtgagtcactcacccagaactgcagcggaggttatctttgacttctctgctgcccttaggcaggacgcttaactcagtccagacagatgagtatcttctggattttataatctccaaagaagacagcctcagtcatcaacagaaaccgactgtagcagccagcaactctcgacctcagaatgtcagagccgaaactaagacaggaccacctcgttgaagctcgcgtgctgcagacgaggacacgcgcgcagacccggcatggctgcctctgacgtctcactcaggcttgtcatacttctgggcctcatgttcttggctcttctggctcttcctttgaagaatgagaaatggcccgcttttctccaaaatggggcccagtgtgtggtggactgaggactgttatttagttggcctgctcgtaatgacagctcctcacctacctgccggatcctaggaggcgccctgggctggaatttcctgttttcgagggctcccaggggctgccccagcaggccggctcccccgcgccgcgccgccgttcccgggcgttccaggccagacttgccgcctctctctccgggctgggctgactcccggcctctccaggtctgggcttgccggccgcgaggtggaggagttgagggactcggtcggcccacaccaggtgcccagaggccggaggtccgtgcgccccggccgcggccccggcccgggcccagccccgtgcccctcgccatgggcctggcccgcgcccgccggccctgagcatggagcggggctggccgcagg

SEQ ID NO: 43056 - DNA, 1041 bp, Homo sapiens
tggcaaggtgacagtagatcctgctggcctccaggccaggtgaatgttccccccatatcatctgtaggggctagtggcccctctgctgcccatgagccccggccaggcccccattagcacagggattcccggcacccgcctggtgcccgtcccgcccctgacccggagctgccctcagcagccctctttgtccttaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacggtacgtgactgccctcctcccccgcccagctgcctttgctgcacaggcagggctgagcgccgagctcccagccaggaggggcgtgggcagccccaagtcaggaagacggtacctgcagtctctccctcagatacacacggctcccgagggtccttgccggtgccctcagagtcttccagactgttctctgcacccacaaggggtttccagtagcggcccttaccctgtccccacagtcctccctgccctctgccgcacacactcaccctccccgccgccttcctctctcctaggcccctttagggtgtctgtgagcttgaaagtatccttggactcacttggcctaactcccctgaccccctttgattcaacagctaatgaaccggcggccggaaggctgtttgcccaaggcgacacagagggttagctggcccagctagagtcagagcccaggcctccccgtcgccttccggctctttttccgttaccccactgccgaggggaaaattcatgctttccacccaccgctgtgattggtttaacaaaggcttagccatcttttcctgggcttcaccacgctgcctcgttcctccctctcaggtttgtcctgtctccttgtgagctcctcactcacccctcacaaacctcacaccccacacctgggggctgttgtgctggcccggct

SEQ ID NO: 43057 - DNA, 1031 bp, Homo sapiens
taaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggtcagcgcctcccttcccgtgtgctccagggctcagaatgaggcccaggaatgtggcgcttcccagggcct

SEQ ID NO: 43058 - DNA, 2003 bp, Homo sapiens
ccctccccccagctcctgctgggagtggagattgcatttcagttgccatttgcattcccaatcaatccggactccgcaattaagtcggctggcggagctgggagggaggcggcggcgggaacgggtcctctgggggctgtcgcctccgcgcctctgcgccgttcccattccgccccagattgcttcctgctccgccgtgcgcagccggccggccggggagggagcaggaacccctgtagcttctttggagagggagtgggaagaggcacgggctaggcgggtttcctcctgtccgcttcccgggagcgggcgggtgggtggggtggggcggggctgagcggcccggtcgttccgcccgcgcccccggctaacgagcgtcattacagcggctccctcgcctccgcctggggagggcgttgccgaggacgggggcgttcagggtggaggagggaccccctccccgatcacattctctgcgaggagggaggagccacacgtgtctgggtcggaaaggaggtgcggagaccccttcccgccctgactgtcggagaaaccgcgcgcagtgcaggccttgaggggctccaccttccaggccgctggagatgggagcagagcggagcagagcagagcggagcggggcggggcggggccggccgtggagtctcctgctgaaggctgggagaggctgggagaggctgggagaggctgggagaggctgggagagggaagcacgcctagtggggtgaggggagtcgggacgggggcggggagccgggtccatccctcacacttggttatttctttggtttgtgtgctgggggcggggcggggggtattggggatgactccaaggcatctccagagcctgagggacttagagccttcgagcacgctagtcccatggctggtcgcagcgggagggggaacagctgactgcttctgagctctcagtgcacctggcccctggccagtgacaggaataccacacccagaggcaggtcaccaaggcccagcctacctggaagactccttcgcagaccaagaggcagggcccgcttgccttgtggaaggtccccttagtgccgctagttttcagaaaccccttttgaggatagggtctcccaggccaagggggccaggtagcaggatgtgtctgcacatggccatgtacttcaactcccagcccgcatgctcgcacctccagcaatggcatttggccctggtgtggccggaggaggagcagcaagaatgtgaaacgtgctggaaagtcagcaattgatgtcacagctgctggggccgctggaagtgggtgccctttctggcctccccctcacctcctgttggggagggagaggtccaggaaacgggaatctcttatcctaatggcatccatctaggagttagccttctattaggaagaacttagaggaggaaggtgcagttgaatccagtatttaccccccacccttgggcgtcaggaccacgagctgcagactagggactgccgtttccttgtgcctgcatctcttagtccctgtgttgttggctgtcttctggcggggccctccattcctaaaggagatgccatcgcggggcctcttccctctctgggcgccccctcctctaagtatgggcagagtccgctttttcaagtctccctgctgggggtgctgccccttccgctctcccagctgagggtgagccccacactcagcccccagtttgtggatctacctgtgcccctcttccccctatgctatttttgccttgaagtctccagggagcactgcctcttctcagccctcttgagttggggattttggaggatggggggccatggatggtgatgctggtcctggatctgcccctggtctccatcgtggcgctccctggtcctgaatgacccccgcctcccattcccagctgttgccttgtgtgtgttgtttaagggagagaagctgagccagtgagagcatctttagagggttctcactagaggagta

SEQ ID NO: 43059 - DNA, 1031 bp, Homo sapiens
cagctgggtgagtcacctccctagagggcctgtgcttgtcacagtgaggggaggatgtgacagacttagtggacaggtggttggggatacgacatccagtcccctggaatggatgggagagaccccaaacaataaagaattgtcccactcacaaggctgatgggactccgctgagaaagcccaggttagagggaaggaaggcgcaatgatgcctccaggtgtggtccttgttggaggcaaggcacctgaaccaggtgtgctgggcccactctcgcagaaacaccgtggaccagcccgaaggcaggggagtggccagggggaggggcctgacacaactgagatgtaccctatgcagtggatgtctctgcatcaggtcccaggtcctcagcagctgtgaagtagagattattgtccccattttaatgaggaaacagaggcttggcatagctaacaaacttgtctgtaaattccacagtaagtgggagacctagggttcaacctaactgtgtctgacttgaagagcaatcttctttcctctaagccaccctgagctcagaaaggaagcctgtgaggtggatggagggaaggaaggaagctaagaaggagaaggccggccaccacccatcatggggctgtgccagtgggggaccttgagcctgccgtggggttgtactggcctgatggcaggtcacatgcagtcttcagtgctctgcccggagagcgggtcagagctgcggggagccctctggcaccggcccccaggagcccctttggtcagcttggggtttctcttatcattccaaaaatgaggagcaggcccaagtgagtccctttccttgacagcagggagccagaggacagctgggctgtttccctagagcaagggaaacgagaagacgctgtcctgtcccgttcctgtccctgacatccctcacctgggagcggcagtggcatggaggagacagccccgtgccctcgctcctgtaatgacagcgcccacacgcaggagctcgcggacggtgcccacccag

SEQ ID NO: 43060 - DNA, 1018 bp, Homo sapiens
gggacagagctgtggaccgtgaagatctggggacaggctgcttcctaaggcacacagggtccctgcgcagcctctggctctcccagaagctggcccgccacctgatgaacccagtgccctgctgaatgtctcaggctctgctctgcagctctatttttaggatagtatctttgagaatcctcccctgcccggcctcccttcccagtctgacccttcccgcccccaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctggtgagtggtggctctgctgcttcccaccttttctggggccccagtgacagagaggaggggaactgggcagcattcttggcttgggaggctgcagtgggacagtgtccaggccaaggggtggggcccagctgggccctcctgggcttgtcagagagaccctgcttcggggctagtactgacgttgtcttggaagcagagtaggggcactgtcccttctccagcctccatgtgcagcccttttccccagagcccccatctgcctgcagccctgcctggggccggcgctagaggcccaccctctgcagctcctcctcccctttgtccccaggcggcgctggtggtggctcccgcatccccatcagccccccgcgcagttagctcatcagcctctcggcagggggacggggaagcggctgagtagggaggtcggacggaggctgggcgctctaagccatgtgagccacgttccgaaggcagcagcatctcgcccgctactgtggaactggggggtccctgtggagttgtcctgaaaggtcgttttccacctgtgctgtccccctcagataggcctccacccatcctaggtgggttggtgactccaccgcctctcccgtctgcccc

SEQ ID NO: 43061 - DNA, 1031 bp, Homo sapiens
ccttcccttgggtcaccggtccggtggcctgtgctggcctgcgtgagggccctctgttgagtctggaaggaggaaggcaggaagggagggagcgtgtctgcctctaatgaagtttgacatttagtggtgagcgccgggcggggtgtgggagacggagcttgattagcgcgctctaattgacagtaattaggcagctccctgattgtttctaattctgctattaattgtgaggagcggggagtgtgattgaggataaatttggtgcggagctgctggggcttcagctccccgtgagttccctgggctgccttccacccctccaggctgcagaggcagcttcctccctttgcctccatcctgctctgcctaagtttcctattctctttccacattttcctcctccaaggctggggagctttgggactgggaagcccaggcagacctcgcctagagagaggtgtccgtctggctctcctgagtgtggcccagctacagttggcaggactggtcctctcctcctcccagtgccctgcgcccctcccctcctctgcctcccttcttcccacacttctccaactctcccctcaccagccagtggcccagctgaggtactcagttccagccccaagctggatcctcccccatctccccactccaaccggaagaagcaccggaggaaaaagagcaccgggaccccccgaccagacggccccagcagtgctactgaaggttagggggacccagagggaaaccgggcacaggaggtgggcagtgggacttggggatagtaccctaaaagtaacacctattttttattttttgtattcagtggattaagcactttctagtagttgctaatcaaagtagttctacagcttcttttggtaatctagacctggtatcttagaaaagttcttctgataactgaaaccctttctgttgaaatgtgggcttacttcatttattcttaaggtaaaagacagcagactgctacatcaatagctcctctaagatgttcgggcaggacctgt

SEQ ID NO: 43062 - DNA, 1030 bp, Homo sapiens
agttctgctaacagtccctgagagcaagggcccagcagaggaggaattccaggggatgtcggtgtcactgaggtgaggctgcctggggccaagatgcagtgaggacttacaagcagagatggccttggcagaactggggttcaccctggggccttaccacaggcacctgtgctgtctttccagcccccaggacacagtcacactgcttgttaggaattgttcacccatggggcagtgaccattgggaatgagattcatgcggctgtcttctggggcctgggggaccagagcttggaagagcttcaccacattgcttgggttcacagtccagccctcagtgcttgtcagtacagatgccctcaggcccctatttgctcacatactgcaggtcctgtagaaaacctctcctcctctcccccatccacttgcccttcctgcctgtctatgccatggtagtgggggaggggcccagctcccaggagccccacgctgacgccgtcaggaatattgggtttaatgagctgcaaaatgaggcggctgcagctgacatgtacggatggtgcccacacccgccttcccccaccctctcccagtgtttgcctcctagcaccccgtcacatccttctccagatactcagctctttctgtgggatgcacccctctctggtttcacacccattcccggcagtgccaggggtgccaagatcttgcatcccccatctgttttcacttaagctccacaggtggttaggaatgagaactgggagctcacactagtcttgcaggtttactctggcctccccctgcaagctgtcctggagtgtgtggccttgcagctggggaagggtctaggggaggacacttgccagtggagcagggtagtgagtggagttgtggcgatagcatgccctgggtgtgcacgcaggccaggagccctgatggcataaacacccccccaacagaggcagaggagtcgtttgaatttgtggtggtgtccctcactgggcagacgtggcacttcgaggcttca

SEQ ID NO: 43063 - DNA, 1023 bp, Homo sapiens
tggcgctcctgagaggctgtcagtgctgagtcaccgatctacctcattcgggtgggcagaacttatgtgtgccatgcgagtggctccagaccgctcctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggtgagagca

SEQ ID NO: 43064 - DNA, 1080 bp, Homo sapiens
agggacaaaggtctttgggggtccaaagcaatcataaggtaagctcccagcacaacttgaatgcagctaaaggggtttgcaagtagactctgaggatcaggaagctccgcacagtgttcagacagaatagttttagctcctcctcaatagtgcctgtccactgaggaggcaaaaactctgaagtttctttacttctagaactgtcccaagaaagcccaagggtagaagggagaattctcaagttgaacgtcaggcttggcagaggtggagtgtagatgaaaacaaaggtgtgattatgaagaggatgtgagtcctttgggtgtaggagagaaaggctgttgagcttctatttcaagatacttttacctgtgcaaaaagcacattttccacctccttctcatggcatttgtgtaaggtgagtatgattcctattccatctgcattttagaggtgaagaataacgtacaagggattcagtgattagcaagggacccctcactaagtgttgatggagttaggacagagctcagctgtttgaatctcagagcccaggcagctggagctgggtaggatcctggagctggcactaatgtgaggtgcattccctccaacccaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggt

SEQ ID NO: 43065 - DNA, 1028 bp, Homo sapiens
caggagaatcgcttgaacccaggaggcagaggttgcagtgacccgagatcgcaccactgccctccagcctggacgacagaatgagactccgtctcaaaaaaataaaataaataaaataaaaatgatacaagcattactggctgctttttaatatgtttagtctgaatagaatattagaagtagaatccagatcagtggatacgaaaataaactaatgaaagcaaagggccaagtgctggttaggattgtatcagctataataaatgaagtgtttggcttcagtatttaaatgaaataaagctttaattaattatatttttcttaattttggcttttagattgagttatgatcttgttttcattttttttactttgttttttaaaaagtaatatgcttttaatataatttgccttattatattttaaagtgatgttttttaaatttgtattttttcctaggcccttatgttagctatgggatatcatgagaagggcagagctttcctgaaaagaaaagaatatggaatagccttgccatgtctgttggacgctgacaaatatttctggtaggcgcttttgtacttggtgaacaccagctttaaggaagatggcccagactatacagaacaccctgccatgcccttgagactgcagactttcatctacaacagtggttaatgtaaaagagtagttatggtgtaaactggtgaatttcttcttccctttgtatttctaattgacctttcctccctgtaaagaaaagaattttcaagcaggtaggatatcctctcttcttctgtacatgtgctatgttgctagtcggaactttccattataaagtttcctgtcagcttttcacctaatggttttggggtagtattgatgattattcctcaaatccgttgtttaagagctgtataatggtgatattattccttctgtacttattttttttgagacagagtctcactctgtcacccaggctggaatgcagtggcatgatctcagctcactgcaacttccatctc

SEQ ID NO: 43066 - DNA, 1094 bp, Homo sapiens
ccaaggaggtgagaggagcaagctgccagagagagggtgtcagagagcttcagaggagcccttttgagtcttctgctcagtaatgatcagcacatgtgtgtgaggaaactgcccagggctgggcaaggtaccacatgaaagaagcagggaataatcctccgagttcatagaaggccaggaatagtttatgttcccaccagccagagtggaggatttggtagtcacagggcgtcaaatagagtcttcagaagggtgttgcctcagcactagggcataatttggtttcacttaacaaagcttaaaagctactcctgaacagtacccttaacttaccgttttcaaataagtgcatccctaacaaaactcaataatttagcaattcaaaaatatccagcatccactgaaaaattagcaggcatgcaaagaaacaagcaaatgtaacctataacaagcaaaaaaatcagtcagtagcaacagatccagaagtgacacagaagatagaattagtagacaaggacagtaaaacagtgactgtaatccatctgctgaagaaggcagaggaacaactgaacatgtcagataaagacatgggagacattcaaaagacccacattagaatgtaagagatgaaaagtacaacatccaagatgaaaagtacattaggtgggatgaactgcagaatagacactatagaagagaagattagttaaatgttacataaggcaatagaaactatctgaaaaaacagagaaaaggctaaaaaaaaaaaaaaatgaacagagcatctgcaagctgtggcacaatttcaggcggcctaaaatgcatgtaattggagtccctggaaaggcagacatgtgggacagaaacaatacttgaagaaaaaaatggccattaatttttcccagtttgatgaaaactataaacccccagatgcaatgactttaatgaccccaagtacaagaaatatcagaaaaaaactacactacagcacactataatccaattccctaaaaccagtaataaaattgaaaatgactttttagctaacctttcttgaaaaaagttaggtaagtttggcttatttttttatttta

SEQ ID NO: 43067 - DNA, 1037 bp, Homo sapiens
tcagacctttgctcattttttaataggattattagatttttttcctatagcattgtttgagtttcttatgtattctggttattcatcccttgccagatggatagtttgcaaatactttctcctggtctctaggtttctcttcactttgttgttcctttgttgtacagaagctttttaacttgatgtgataccatttgtccatgtatgctgtggtggggtattactccagaaatctctgcctagttcaatgttctggagattttctccagtgttttcttttagtagtttcatagcttgaggtcttaagtctttaattcatttcaatttgatttttgtgtatagtgagagatagggatctagtttcattcttctgcatatgtatatcgagttttcgcagcaccatttattgaagagactctccttttcccaatgtatgttcttggcacttctgtcaaaaatgagttcgctgtagatgtatggatttgtttctgggttctccattctgtttcattggtctgtgtgtctgtttttatgctggtgccatgctattttggttactatagctctttagtataatttgaagttgtaatttggggttagataatgtgaagtcaagtaatgtcattccttcagttctgttgtttttgctcagatagcataggctattctgggtcttttgttattccatataagttttaggattttttttttctatttctgtgaagaatgtctttggttcattggtattttgatagggattgcatcgaatctgtaggttgctttgggtggtgtggacattttaacagtattgattcttccagttggtgaatgtggaacatctttctttttgtgcgtgcatgtcttcaattttttttttccttccttttgagagagtcttgctttgtcacccaggttggagtgcactgctgtgatcttggctcactgcaacctccacctcctgggttcgcatgattctcctgcctcagcctcctgaggagctgggattacagttgcccaccaccacacccggctaattt

SEQ ID NO: 43068 - DNA, 1053 bp, Homo sapiens
tcatttgtttaaagaaatcttaaaatttccttcttaatgtctttattgacccactggtcattcaggtgcatattgtttaatttacatgtgtttgtatagtttcccaaattcttcttgtaattgattctagttttattctgttgtggtcggagaagatacttgatataatttcagtttgtttgaatttttaaaaacttgcttttagacctcaaggatagacctaacatatggtctatccttgaggatgatctatgtgttgaggagaagaatgcatattctgcagccattgaatgaaatgccctgtaagtatttattaggtccatttggtcagtagtacagattaagtctgatatatctttgttgattttttgtctggatgatctgtccaatgctgaaaatgaagcattgggagtcttcagttattgtattgggatctatctctctctttagctctaataatatttgctttatgtatctgggtgctctagtattgggtgcgtatatattcacagttgttatagtctcttgctgaactgagttctttatcattatataatgaccttgtctctttatagttttttcttgagatccattttgtttgatataaatatagctactcctgctcttttttggtttccatttgcatggaatatcttttttcattcttttgttttcagtctgtgtgtctttataggttaagtatgtttcttgtaggcaacaggttgttgggtctgcttttttatccattcagccactctgtgtcttttgactggggagttagtccatttacattcaatgttattactgataagtaaggtcctactgctgcctttttattatttgttttctggttgttttgtggtctgcttccttcttaaccttccttcctgtcttccttttagtgaaggtgattttctctggtggtatgttttaatttcttgcattttattttttgtgtatctatcatatgtttttagatttgaggttaccacaaggcttgaaaatagtatcttataacaattttaaaccaatggcaacttaacactgattgtc

SEQ ID NO: 43069 - DNA, 1015 bp, Homo sapiens
attatccttacaatctattgatcagttaacttaaaaatcttcaggatagtaaaaaggtctacctcactttttttttttttttgctccttcctgtacaccttcctgcacagtgatctttccattttttttaattgtggtaaaatgtagataacatgaagtttatagttttaatgaatttttttcttgtcttttttttttttttttttttttgaggcagggtctcatgctgtttccctggcagaagtggtgcagtggctatggtcatggcttactgcagccttgatttagtgggctcaagtgatccttctgctgcagtccgctgagtagctgggaacacaggtgcacagcaccatgtctggctaatttttttttttttgtacttttgtagagacagggtttcaccatgttgcccaggctggtcttgaactcctgggctcaagcgatccgcccacctcagcctcccaaagtgctaggactacaggcgtgagccactgagcttggcatgttcatgttactcaatccctgagcctattcatgctattggaaaggatgctgtgtttgttagggttctccagagaaacagaacccataggatgtgtgtatacacacacacaaatgcacacgcacagatttattttaaggaactgacttaaacgattgttaggagtgtgtggagactagcaaatctgaaatctgtggagcaggccagagacacagggaggagttgctgttgcaatttgagtccaaaggcagcgcgggggcagaattccattggtatgtgttcagatttcctcctcttataaagacaccagtcctatttgactagggctcagcctaatggcttcattttaatttaactattctttaaagactctatctgtaaatacagttacactctgaggtactgggggttaggacttcaacatgaatttttaggaaaacacaattcatcccataaaagatgccaaataatctcctgtgggatggagtgggaggaagcaaaccagcagatatt

SEQ ID NO: 43070 - DNA, 1033 bp, Homo sapiens
tctcaactcgtcaaagtcattctccatccagctttgttctattgctggtgaggaactgcattcctttggaaggggagaggcactctgatttttagaattttcagcttttctgctgtgtttttcctatctttgtggttttatctacctatggtctttgatgatggtgacgtacagatgggatttcggtgtgaatgtcctttctgtttgttagttttccttctaacagtcaggaccctcagctgcaggtctgttggagtttgctggaagtccactccagaccctgtttgcctgggtatcagcagcagaggctgcagaacagcaaatattgatgaacagtaaatgttgctgcctgatttttcctctgaaagcgtcatctcagaggggtacccagctatgtggggtgtcagtgtgcccctactgggaggtgcctcccagttaggctacttgggggtcagggactcacttgaggaggcagtctgtccattctcagatcttaaactctgtgctgggagaaccactactctattcaaagttgtcagacagggacatttaagtctgcagaggtttctgctgccttttgtttggctacgccctgcccccagaggtggagtctacagaggcaggcaggccttgagctgcggtgggctccacccagtttgagcttcctggctgctttgtttacctactcaagcctcagcaatggcgggcacccctcccccagcctcgctgctgccttgcagttcgatctcagactgctgtgttagcaatgagcaaggctccgtgggcgtgggaccctccgagccaggcatgggatgtaatctcctggtgtgccatttgctaagaccattggaagagcacagtattagggtgggagtgaccctattttcaaggtaccgtctgttacagcttcccttggctaggaaagggaattccctgaccccttgcagttcccagatgaggcgatgcctcgccctgctttggctcacactcagtaggctgcacccactgtcctgcacccactgtccaacaagcc

SEQ ID NO: 43071 - DNA, 1081 bp, Homo sapiens
cctttgttcctcactgcctttacctgtttagaaaagttttgaactgttagccaatcgggttttagtttagattgtgaggtctggctccagccaatggagtcagaacacagcaatagggacctcatgcgtaaaggataaatattctagtgtcttttttactttgtgtgtgcttgtggcaggattgctgacgggcaccaccctttctgcagagagtaaacatcgccttgctaaggaaactttttgtctgattgctgattcttctctgcgacatcggggaataagcatttatttccaacatagtgtttactctagagtttacaatatacattttattttatttttcaattggcatataattgtgtatatttatggggtacatagtgatgtttctatatacgtaacgtatcagtgatcagatcagagtaattagcatatccatcatctcatacatttatcatttctttgtgttgggaacattcaatattctccttatagctatttgaaactctacaatatgttattgttaactatagtcatcctagagtgctatagaccagtagaacttattcctcctatctagctataattttgtaacctttaacaaatctcttcctatctcctcccttcgcccacccttcccagcctctagtatcctctgttctgatttttctgtgagatcaactgtttttcagcttccacatatgaatgagaacatgtggtgtttaactttctgttcctggcttatttcacttaatatcctccagttccatccatgttgctgtgagtgacaggattccactcaaattatggctgaatagtatttcattgtgtttatattccacattttctttatctgtttatctgttggacacccagattcattccgtatcttggctattgtgaataatgctgcagttaacatggggatgtagatgtctcttcgatataccaatttcctttcctttggataaatgcccagtagtgggattgctggttcatatggtatgctatttgtagattttgaggagcctctatactgttttccatagtggctgtactagttgatattctcacccgcaga

SEQ ID NO: 43072 - DNA, 1047 bp, Homo sapiens
gaatcgcttgaacccgggaggcggaggttgcggtgagctgagattgcgctgttgcactccagtctgggcaacaagagcaaaactctgtctcaaaaaaaaaaaaaaagacactttgggaggccgaggcgggcggatcacgaggtcaggagatcgagaccatcctggctaacacactgaaaccccgtctctactaaaaatacaaaaaaattagctggccgtggtggcggactcctgtagtcctggctactccggaggctgaggcaggagaatggcgtgaagccgggaggtggagcttgcagtgagccgagatcgtgccactgcactccagcctgggcgacagagcgagactccgtctcaaaaaaaaaaaaaaaaaaaaaaaaaaaaagaagaagagagaaaagttcatcgcttttttaatgttctgttcctgcaagtatgaagatatgttactgcttttcagaaaaagcagtgtgcttttttctgtgcattattttgcactttaaggcaagaaaagctgtaaaggctctctttattagatttttcatttagaaataaattagttcatctaaggatttgtcaagttgttccttttctgttgaaacctgaattgattggttttggttcttctggaagcagatcttgagatagaaatctgaatccaagttgtgtatttgcgaggtaatcccaggacacaccagtaggggaatgaagtgcgccgtctaggaaagacagccaataaagggcatgttttcaagccaggtcccgctgtggacaaatgaagcttgattgtgctgaggaattctagagccagtgtagcatacgtatgtcagagttgtgatttttccactgggggtttggagggaggctggatttaaggaagctggagtcttcttatcagtatattgtgaggactgccctcaggtaggtacacattcccctgtagtttgggcctgccctgcacgtgggcagatgggcttcagaagccagagatacaggtactggcagttggaattcagaacactgtgcgggatagtaatgctcaagggg

SEQ ID NO: 43073 - DNA, 1075 bp, Homo sapiens
gaaatagaattttctcattagtcttgtggtaaaagatggacattaaaaggtggttaagaatttcagattagatagtgattcatagaggaaaaactattcttcaaattgtgcttttagaacatttgttcagtactcaaattttattctcatatttttgacaaattgatggaattaaaatattctttcggtgtgcttaaacctgctcatttttcttggtgcttgtggctatggaaatcccctttgcttgtgaggttaaaataatatggtatcctatttctttcatagccttaaagtatttaatcttttccatagttgttcttatattttcaagttagggagtttctgtctaagaaattttttacctcatttattaaatcactacatattccttgtagaaaatgttttaaataaaagaaagaacaaagaaaattagccatgatgccactaacctgagtctattaattttttggtagttgccaaaagcagtatagcattttgtagatagtgtagaaagatgaaaataagtagtagattatatagcaaaacattaaagtggtgagacttctggtgatttttaagtagtttcctttttgcttgtctgtgttttctgagcttttagcacaatagcaaaagctattaaaacattaattgcgggccaggtacagtggctcacgcctgtaatcccagcactttgggaggcctgggcaggaggatcacctgaggtcaggagttcaagaccagcctgtccaacatggcgaaaccccatctctaataaaaaaaaaaaacacaaaatattagccgggcctggtggcgggcccctgtaatcccagctactcaggaggctgaggcaggagaatcgcttgaacccaggaggcagaggttgcagtgagccaagatctcgccactgcactccagcctgggcgacaagagcgaaactctgattcagaaaaaccaaaaaacaaacaaaaaaaaccccattaattgccagcaccctgaatggagccttgcctgtagatcttctactgtgttcctagtttattagccttttctttaggattatttaagattttcatta

SEQ ID NO: 43074 - DNA, 1114 bp, Homo sapiens
tgagtataagtttgttctaaatgtttattgattggattcatggcaaataggaattaacatcagtgaagaattttactctcatttcacttttctctttcattgttttttttccatcaaaggcttttcgtgcatgtggtcagtcattccacagacagacatttgttgagcaccttctgtttgctacacgccgtcttgagccctggaagaaacaaacagatgtagtagttcctcagttctcagggctagagtctagcaggggaggcaaataagtcaacaagtccttacatgagtaagggctgtgacagggtttggggaaatgggggcatagtactggagtggtccctgcagagaggtgacaaggctggagggaggcagggctcagatgctggagggctgtgtgtgccctgggaaagaattcagggttctcaatgtgttctctaagttcatggcttttttttggggggggggggatggagtctttctctgttgcccaggctggagtgtggtggcatgatgtcggctcactataacctccacctcccaagttcaagtgattctcctgcctcggcctcctgagtagctaggactacaggcgtgcaccaccacgcctggttaatttttatagttttagtagagatagggtttcaccatgttggccaggctggtctcaaactcctgacctcgtgatctgcccaccttggcctcccaaagtgcagggattacaggcgtgagccactgcgcctggccagttcatggctttttgatgttgcttaaagctcctaaccctttttttcccaaatagttgcttggaatgatttgatacatggaagctcttctgttatcttggtatatcataatttattcaaatcttttttattattgggcaaaaaaataaaatttcaaatataaagtcttatatttgtttccttttgaaacctcattgaggagaagctggacatcagctcatgagtgctgcatgaaacacttgcagtgattttggtaaaaagaactcacatttttatgtaccctctcttccaaaaaagaaaaaaaaccctgaagtttaaaaagtctttattcggctggacatggtggctcacacctgtaatcccagcac

SEQ ID NO: 43075 - DNA, 1047 bp, Homo sapiens
gactctgattcagggtcttcatattagtgaacactgcacacatccatttgggttctatgagttgaagcaatgagtaaatagaacagaagagaataggttccttttgagcatagtgatggcgcatgttggagagtgagttgttcactgcacttgccatgtcacccagttgtgttcctgaagataatctgtgattcagcctgtgcacttcctgactgccccgatgaggcatcgacgaaaatggcagccgtgtgcccttctgtctccagagggtcagccagaggctgtcgggctcctctgtcacctacacagtccaggaattaagagagttatgtaattgttaaaccctaaaattggaaaagagttaattcagtcaaattcaatgaacaaaattcagccactgcttaggtttcttcccagaatagcacctcactttctcctgccttagctatctgaagtggaatgaaccaagttgaaatctgcttccctgtaagtctagtgcattggtctgtttctgctttgagaccttacagaatcaatatgtggaagaatatgcaaagtgttgttcagtcttaaaattcgttatctaaattttattttatttttcttctctagatctggatctataatgaagagcatgaattggttttaaatagtctcctttgtctagatatgtcagagactcgctcatcagacccgccacggctcatgaaatgccacgggtcaggaggatcccagcagtggacctttggggtgaggagtgctcggtgatgttgggagaatgcgcagaggcccacaaggttgagtgagggagtgtggcagatgaactcattttctaccttgggggtggtcttctcagtctgcagtacagtggtccccccagaaaccacaggtagtacaaaccctgtatatactgtatttctttctagagatacacctgtgataaatttatcaattaggcacagtaagaggttcacaacaataactgaaatgaaacggaacagttagaacagcatactgtggttgcgcagtggctcccgcctgtaatcc

SEQ ID NO: 43076 - DNA, 1029 bp, Homo sapiens
cgccggggtggacaccctgagggacaccgggagcgcgggatctcccctcctaggaatattcgccagcgtgaggcacagatcatcactgcagatcctttaacgtcactcatctcctagtgaacggtgtccctgccttccagcgttctcagcactggccctcgttctgtccccgcgtgtgcgtgtcattcctcctggctgaggattctttaccacctacttgtggagagaatagcatcgatctcccaacttgataccatttttactgccctccctgcgcttttccagtatgaaatggcacactcaggccaagctgtccctttggtttgcatagatttgccttttcgctgaaaaatgatgtgtttaaaaagactccattttgaaaaataccctaaatttgggagagcatgtttgtggaattgtggtagaggtttttgtttttaactttttgagtgtgaccacttctttcgttgccgttaagctattaaaaagagatcttaggaaatgccctgaagtatcggtgacccaagttagctggttgtagtaaggtgattgctgaatccatgtagctggtagtttgggaatacaagcttgcctgcctgcgttatgggtgtagtgcttagtaaaatagcctggaagtaaatttggtctcttagcgatttttttcaagaagggattttaatcatttttgccacaaaatgtaacatggcatgttcaccttacccttgattcttttctatagaaaaatgcacttggtttggtttccttgacaaccttgtgggggtgccttctttagtttgctacagtccatctcctactgttagttccttccttttgctgctgaagcgaccagaagtggttgtggactggaaaaatcctctttgcttgtgtgaattctttttgaaatacacgtcatatcaagctttgtagctctttattttagaacttgcttttctacctaaaacacaagccaaaatcagcgttgtcgatactacagctcccctccctcaattattgacacccttaactcat

SEQ ID NO: 43077 - DNA, 1030 bp, Homo sapiens
gagtcgtactttcatcagaaatacattaaggacagtgagaagccattagtatatttatggaattaggtttatgttagaattatttaggtatagtttgaccatttttcaaacccacaataaatattttagtggagtaaaatgttaatttagcaaatatttctctaatgtctgttctgatagccagtggcctgcttaggtgcaaatcctgtctgtctcttagaagctgtgtgaccttgatagattgttaagcttccctttctgtgaaatgcagataatagtacctgtctcataagctattgtgaggatgtaataaaatagtgtgcaaaaggaaacacttagcagagtgttcaataaatgtaaactttaattattattattagttattgacttcagagcctcccactggagagacagttaaagatgggggttatctgatgtcaaggaatctatagtttggtagactgatcttaaacaattgtaattcatccagaaaaatgccttaatgcaggtataaaagggccagtggaagcatcaaacacgtgtgcagaactgcaggttgtcaaggaagccttcaagtgaggagatggtgttgatgtcgagacctgatgaatgaaaatagctcatgggagagctcaagagtgtgagcaggagttagaaatttcaatggaaaatggaatctttgtgatgccctccacatttcattagctgtctggagtgaattgatatgattatttactgctaagtatattcccaaatatttaagattaagatcttattaaaataatgaattataaagccattaatatttggaatttttatgtaatagttatttgattatggtactttttttggctacagatattaaccaataacattctaatttatccttttaatgggataaattttaacggttttttttcttcctgtaacaagactaaaagtacattttaaggctatgtgatgtagagtcttattatagacattatttttcagtttactctccttttctgtattgtacagaattttgtcc

SEQ ID NO: 43078 - DNA, 1021 bp, Homo sapiens
gagagcaggtgaaaatcagcctgggcccaccgtgggcttcatccaggagctgtaaaatggaccggagtctgggtcccaccctgggagattctgatgtaattgggcttgggctgggtggagcctggacacctggatggtaaaagcttcccaggtgactctaatgtgcttctaacttgaggaccgccatcagcgccagcccactcttggatcagccagcgtttagtaacttgcacgctttacttgagggggaagccagtttgaattgctttgtaatgtaatggatgtctttctacttctcagttctattcaggaggtacttgagtacctactaggtacaagacactgttgttaaattaggggatttaagtatgtacgagatgattcggttcttgccttcaagagcttataaaaaagctaaaaatacggaaataactctaatgggaaccactacaagctaaatgtcattaaagtgaatcatgcaaattatggtaattgagagaagggacagattgcatttaattagaggggatcaagaaagtctttgagaagctgccatctgagctgagtctgagagcttggcctgcagagctgggggtgggtggacaggccaggtggagggaagataatgagcgcagatagaaggagagtgggcagatgcctgcggtgcctgttttgaccagagcctacggtggtggggaaggtagtgggaaacaaacctaggagggagggtggggccagcaataaaatatctttagcctgctccagcagtctgggtccagcagtgggttgggagttgttaaaaactcttcatgaagtttgtgaagcagatgtaaatacatcctgctatagcaaagggattgatttttctgtaacaaattgcttgaattgaatatatataattatgttaatgcattttaaactagagaagcctgttgcagggtaaatgagttatagatataaaataaataaatacttactattgagagacagagccttgctctgtcgcccacgctgaagtgcg

SEQ ID NO: 43079 - DNA, 1069 bp, Homo sapiens
gtggtggatttaagctgtatgatcctgatgacaaatgttgttgactgtcttttcctgtacttagtggtcatttgtatattttcttttgtgaaatgtccgtttgaatcttttgcccaattttaactgatttgtttattaagtgacaactcaatagtaagagttcttcagatatcctggatacaaattctttgtcagatttatgtgttgcagatttttttgctagtctgtggcttgtcttttcatattcttggtggtttttgaagaacagaaatgtatggaagcccatttatcaacttttttcttttatggttcatgcttttttatgtgctagctaagaaatttttgcctaccacaaaattacgaagtttttaaaaaatggtttttcaaagaaattttgtacttttagcccttacatttaactcagtgataaattttgagttaatttgtgtatatgaaatgagaaagtaaataaatgttcatcctctcactccatggatatcaattattcccacatcatttgttgaagaagactgttatttccctattgaagtatcttgatgactttgtctaaaatcatttgaccacatatgcatagcactgtttgtatggttatgtgaataaaagaaatgaatttatataatgcctttgaaggaaactcaagatcatgtaatacttctcaagtattataataaacatttattttcataccctactgaataattttttagttaaaaaacctattacagagacatgacaagtaattgcacagtcttaccctgcactggactctggactggagagaaaaaaataccttaaagaatattaataaatcaagtagcaaaatgggaataggaacagcagattaaagttttgtattaatgttaagtttatgaagttggcagttgtactgtggtaacgtaaaagaatgttctcagttttagtaaatacacactatttagtagtaaagggccatgatgtatataagttactctcagatgctccccgctcctagatgtgtgtgcatgtgggaggggacagaataaatgcatgcaaacgataaataaaaaca

SEQ ID NO: 43080 - DNA, 1031 bp, Homo sapiens
gggagaggcccctcgtggctctgagctgctcagcagacacagggcccctgggacatatgattaaggccagtgggttttccgaagaggcccagctttttctgacactgagacctgagagaaatttcttctttagaccctcactaggaatacctccttcacccatccctacagtggataatgatgcgcgtttcttcccgccgtgtcttctaatggctcgcggtgcaagttcagagggtgaacagtcttgtgagtgaatactgaaggaatgctgagcagacagggagcactcccctgggacttttggatccagtgatagaatttaggagacttagaggtgtgaatggactatgtacctctcagattatccttcagaataacaatagctcagaacgtggagatgaggcagcaggtgtgcccacggtgctgtgttggccattgggtgttacagtaagaagcagacccgcgtcttcgacagtcgtcttgggaaggatgagctcaccaagtctggggtgacagtcagggaacctggccctgtggcccctctcctacactgcggtgggccaagggacagctctcagacaccccaggcttccttggggcactgtttgggatcccctgacatatgggctgttaggagaccaaggctgcagcattccctgccagagagcgaggctggaggaatcttagcctggaaaagttttaaaggagttgtctgtggtgggctttaaaaaagcaaatgaaaaacaatagcaaaagaacaaaaaaacaaaccccaaaacctcagcaaaagcgcccttagaaatgtctaattccaagcactgacccatccttgttcttccccagtcctcacttaattcttaattggatataagccagggtctgtctctccagaatatcatcggccagcgtggccaatcatgagagagcaggaccaggggtcagttgaggcttattctaagatgagatgatcaaaataccaacatgcttttaagttatgattcttgatattatggtaactaggtatgcagtgt

SEQ ID NO: 43081 - DNA, 1055 bp, Homo sapiens
tttgtagtcagtcctggctgtctttccccagaacagcagtaagcaggaacagactactctcatatcatataacttagaacctgggttgctagggacagaaaagtgcatttttttttccgtgctgattccctgtgacttctgcttacctgtaaacttgttgagggactcactgttcacacactcagagctgactgggaggagtgcctgaaagcagagagctctgtagttgctcaggaactcgggaagagctaacatatttagagggtcttaaaggaaatagggctttttgactccttgaaggattaatttccttatgtagttttcacataaggtgttttctctaagaaagttcaatcaggagatacactagtcccccttgtcagtgaggatatgattcaagacctccagtgggtgcctgaaactgcaaatagtaccgaatcctatatatactgtgttttttcttgtacatacatacctatgataaagtttaatttagaaattaggcacagtaagagacttctgaacagcagtaactactaaagtagaataattattgtaacaatatactgtaggaaaagttatataaatgtggtctctctctgtctgtctaaaaatacctttctgtaccatactcacccttcctcatcttgtgagggtgtgagatgatgcagtgccccatggtgagagggcgagaggtgagtgacgtaggtgaggccactgtggcctctgacatacatcagaagaggaccagctgctcgggtgacctgggccgtcaaaccatgaggatgtcagtggctgcaggtcaggagctgacggtatggatgactgacaggtgggcagggttgacaacgcggagatgctggacagagggctggttcgggttctgggcaggcggagcgggacaggcgagtgcttccccttcctcagccccccaccgagcttctggggtggccaccgagcgagtcttggccctggagggcagtgctggctgggtggctcatctgagaatgttccttccggtaacttggatgctttcttcccaagattgtccttct

SEQ ID NO: 43082 - DNA, 1034 bp, Homo sapiens
gccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatctttctgctgtagtgtggtggtctgttggttttctccctgtcgctgtgcctcctttaaagaatattgacattgttttacatcattggagaatttgattaatactcagcttgtgggaggaaatgtcttttcgcgaatggtgtgggctgcctgccccgcagtgaccactccatcgctgggggtatcgtgggtctggataacccgtcagagatggtttttgaatctggggtatagtgggaaggagtgcctaatgatttctgatgttccttcctagaagttcaggattcatgactgtaagctttcagtaactactctgatgtttgctgaatggactgctagcttgaaaggtaatttgctcaattaatagatttaggttgatttcactcttcatattattcttataattatgttactttaaaaatt

SEQ ID NO: 43083 - DNA, 1031 bp, Homo sapiens
agttttgctcttgtcccccaggctggagtgcaatggcgcaatcttggctcaccacaacctctgcctcccgggttcaagcgattctcctgcctcagcctcctaagtagctgggattacaggcgtgcaccaccatgcccggctaattttgtatttttagtagagatgaagtttctccatgttggtcaggctggtctcaaactccccacctcgggtgatctgcccgccttggcctaccaaagtgctgggattacaggcgtgagccaccgtgccaggccgagaacattttgttttaaacctacattgacaggacagaatgatccattacaatgtgacaggtatgatgctgtggttctcaaccctgggcaagacccatcccaaattaagagaatcagaataggagccccagggaaggcatccaatttttgctttttgtttttaaactccttaggcaatgccagcgtagctggatctgaaaggcttatgagcagaaggaagggtttttgactcaaaaagatctgaataccaattctggctgttcctcaagcaaatgagatcctattttctgtttgctcatctgtgggagaattgtaatggtccttttcctgttaatagaggtgagttatcattttttgtttattcagtgagcctggcagatactatagatagaaatgaactgtgatggtcatgtgcacccgtcattttataaggaagaaaaatgtttacagttagtaaatttgataaaatctgcacataccttttgttcaggttgaatgagttagatcataatatagaaatgagttaagtattcctagagttgatgggtaaaatcgacctcctatgacaaaactacaactccaggtgagcagttttctgtaaaaaatatttcatcaaatacactcgttaaattctaaaattataagtctacagtctttaggactattaaaccttttaatagtgcaggagccaggtgtggtggtgagtacctgtagtctcagctactgggtaggtggaggtggtagaatccattgagc

SEQ ID NO: 43084 - DNA, 1067 bp, Homo sapiens
caccctcctctgctgctgcccctctgtgtgtagaagacagcccctcctttaccaatgcaccaatgacacctgtgtccctcgctggactgacgtcctggaacatgggggccgtatggtgcttatcttgggaacccccgaggccttcacaaggtctggtaggtgccccgtagacacttaactaagctcctatccgacaagaagaaggcatcactggttttcctgggctgcgtgtgctctggtgctgagacacattgtgtgtctggataactgtaggacggtgagcacccaggatgtagctatcgttaccttaagagtttaatggtatcataaaatctaactcttgggcatggacttcaggagggttttgggaacctgaagagtagaggatcaagcttgtctaaggctgccgcctgcctgcgtctgctgtgccgccagccagaggccggtggagcaatcaccctgcagaatccttgaagatgtgcctgtgttttatggcagtcgtagctcattccacagctttactcatatgaataatgagctctcgtgtgactgaagtgcagatcgttcggtgattaattcgttctttatgatccctcctttatatctcatttgtagaaattacgattgtgccagacaggcttgtggggttaatcaagtgcaaagcttattgaaaaccacaagagaggcccattaagaatatttatctattaaataattctttacttaattgaataatatttcataatgtttcttttaaaagtatctgtcacccttgttaaatagaaatataacttgattggcaaaataattgcatggggttctaattggcaattacttcaatttcacttggtcagacagaaataaatctttttaaaaagaggaaaagaaactatagcttgatcttagtatcactgtgaaagttttttttttttttagttttaaaatattagctccttttaccctatattggtttcttaaaagtaagccgtggctcattctctgcaggttgacttctcagctttgattttttcatttttagttttgactgccgtggattattttttctg

SEQ ID NO: 43085 - DNA, 1114 bp, Homo sapiens
gagaggagggagtgttatccactccttcggcccccccgccgctcaaagtttgccccatgtctcatctcacacatgccaggaacttgcccttcaggtccctgtgacgtgctctcctgcacataagcagggaggccagggtggcagtgaaggtacatggggtgggctggaggcaatatctgccagctgcacctgtaggaagctggttactgcagcggtggcctcaggaagggacaggtgaggccatttgggtctgctgtggtacgtaagagatgtctactgggatgctctgagagcacagcttagcaagacagcttcctggaaagatggtacccttctgtcctgcaaaggtctgcttgggatggggatcaggagtagcgtctgagctgcccagcttcaggatctggcctcgataagggaaagaagaaaccattctctggacgttggtcctattggaaaccggagagtcagtcaggtgaagacaggatttcaagagccactgtgtccacagatcttaggcaaggattgttataaactcttgataagtttacacaacattcgtctactttttacttttataggttgtgtcattttctccaagagtcttctattagagttctgtcacggtgctttggcaaagactgagattatccttcacaatgtatttttctcactttccatttgcaaagcatgttgcttgtctacagatagaatgtattgaaaacacagtatgttaactgaagaaataggtaggaaagggattttaagaaatacctgcattaaggcttgcttctcttcttgatttttcaaatttaataagatccaactccagaaagcttgaatacagagatttagtttagaattcatgaaggaacagggcaggagtttgcatataaaatacagcattttaaatattccactttcccaccatctcagggttttagttacagactacggaatccaagttagctttttaaatttttaattttttttaaattttactgtaagttctgggatacatgtgcagaacgtgcaggtttgttacataggtatacatgtgccatggtggtttactgcccctatcaacccgtcatctagtttttaatcaccacatgca

SEQ ID NO: 43086 - DNA, 1052 bp, Homo sapiens
ctggggctctcccaggttggagagagaaaggtgagcaaacagagacgttcactggttcccaactgttagccagggcagaaaatctgcggctatctgcagggtgcactaattatacagatttgatggaaggctgtattcgggggtttactagagagactgagtgcataaatttgatcaagaagattagaaaatgaccgaggaagtggataatcggtttttacaatggtgcgcttggaaattctaattagtagtagcaattggattctgcaattttttctttggtgagtcccaacaaaaccaattaacttgtgttgcatccatacattaccacgcacacgaccataagcaagggaaggcgtgctgagtctaactgctgccttttggcttttaacagaaaatcaattcattttggcacattaaaccattagtgcccattggatatgaatttcccctttttctttaaatttctctcccgcttcccctttttctgttatgggggaggaaactgttgactttgaaggctgtgaatgggaggcttcccgggaaatcgggataaactcatgcacactgatgtgtctttgggcttcaaggaactttctgattgaattctcaaagtcctcaaggcttctaaattctacaatcaagcatcagctttatgaattccatattccgtgaagaggtggtgtcattgagaacctgttggatggatgtcatcagcactgtctgaagggttcctcagaggtacagcagattagatgaggaggcacttctacactagggatggaaaattaatggtacctgtgatggttaatgttaggtgtcaacctggccaggctaggctaggctgtgcaggtgtgtggtcaaatgttactccagatgtcgtgaatatatatatatatttatatatttggtttatacttatataatatatattatcatatatagatatataatacatatattatgaatatatataatatagatatataatacatatattataaatatatataatatagatatataatacatatattataaatatatataat

SEQ ID NO: 43087 - DNA, 1097 bp, Homo sapiens
cctgcagactttcccccctggctggaccaggaatcttggggtggaggtttttggatgttgaccaagccagcttggaaaaggggaataacatgagaactctgcttaaacttggaaagattatcttcccctggatgctgtcttgcattgtttttaaataataataatgataccggctggtttgaatgcttactgtgctgggtgtggatctacgtgcctcacatgtatcagtgactctacttctcacaaactctgtggatgccctgtttttacagatgcggaaagtgaggcatagagagatataaaaatagttaaagaaagaaagaaagaaagaaaaagctcggcaaaaccagctcaactaatgtgccatatttatattattcaatacattgtccaggcaaagatataagctcctctctgtgtaatgagatgttgttcatagtggattaagggatgggcttgccaggaagctgcctaaggcactgatatacgttgagaccatatgtgaataatctgaaacacagggccaggtgcctctggtctccccatgtttgtttgtccatgatgaacaaagcaatagcctcacacatctcagagactacctttaaaataattcatcaccagcaactccaaatagggaaaaatgatatattacattcagggtacttaatgcatgttttatttggaatacaaagagttgttacatgtttatgaatagaaaagtaatttcttcctacctgcactggtcaaatatgtagactggctctgaaggggtgactcgttactctcttgggtactcctcctgtttctctcactgtttgctacccctttcccacactcctgccacattctagtcctcatgtagagcaccctaaagccactcctgagcccagaacactgcccgagccagcctgcaaatagaactgcagataaaaggacgcccagcagaaacttagatttctgatgaacaacacgtcattttttagcataagcgtgtcccatatgatatttatagcacaaatattgcatgggacatacttatactaagacattattcattgtttatctgaaattaaaaacgacgtgtgtgtcttgtattt

SEQ ID NO: 43088 - DNA, 1032 bp, Homo sapiens
tcacagctagcaatgtacaccacgggagacgaagacacagcttctgttcatgtagttagagatggaccggggaggagggagagggaacacattcatcgcctaattaaacaacaatgcaaaaaactagcacttaacgctggtccacagaagaatgggggatttggtccagctgcagtggtcatggagggattccccagggaagtgaccactgagctgggttctgaaagaagaacaggtctcaaccagttggggagaaaagggaggtaccttctgacagagggagcaggtggcaccgaggtgccttgtcaaggagagcaaagtgcattccagggagcaaaggaggctgactggatgggggcgccagggctggtggggccagggtaagtggatgctcaccctgaaatatttaggggctattaaggagaaatatttaggggctagacctctgggacttctaaggctgtgtggaacagtttgtccttatcctaagagcaattagaagtgactgaagtactgaaaccagaaggtggacatgcttggatttgcattgtgaaaactgcttctctgcagaatgagttggaataaggacatctggatggagatggtcacgttgaacggctgttactgtcatactcgtgagaggtggtggcagccaagggtggtggcagtggaagtggaaaaagccctcagggtctagagatatttaggggttaaaatcaataggacttgatgatgtgttagatatcaggaagaggatgtgacaaggggatgtcaaggacagctgtggagtttctggtcttcatcattagatagaatggattgaattgacactgagctgggaggaccaggcttggggccggtggacagcaagtgaagcagagatggtttggtttccagatttgttgaatttgaggggcctttgacatatccaaatggaaatgtcaagcagagagttggattatatgagtttagttgggcagaaggcatccttttttaacttgatattttgaaataattgtagactaatgaaag

SEQ ID NO: 43089 - DNA, 1030 bp, Homo sapiens
tagttccacatttttgcaattgtgaattgtgctgctataaacatgcttgtgtaagtatctttttttgtattatgacttcttttcctctgggtagatacccagtaatggtattgctgcatcaaatggtagatctacttttagttctttaaggaatctccacactgttttccatagtggttgtaactagtttgcattcccaccagcagtgtagaagtgtttcctgttcactgcgtccatgccaaaatctagtattttttgattttttgactatggccattcttgcaggagtaaggtggcattgcattgtggttttgatttgcatttccctgatcgttagtgatgttgagcattttttcctatgtttgttggccatttgtataccttcttttgaggcttgtctgttcatgtctttagcccaattttgatgggattttttttttcttactgatttgtttgagtttgttgtagagtctggatattagtcctttgtcagatgtatagattgtgaagattttcctccgctctgtgggttttctgtttactctgctgactgttccttttgccgtgcaaaagctctttagtttaattaagtcccagctatttatcttcgttttcattgcatttgcttttgggttcttgatcatgaaatctttgcctaagccaatgtctaaaatggtttttccaatgttatcttctagaatttttatagtttcgggtcttagatttaagtccttaatccatcttcagttgatttttgtataaggtgagagatgtggaatccagtttcattctacatgtggctagccaattattccatcagcatttgttgaaaagggtgtcctttgcccactttatgtttttgtttgctttgtcgaagatcagttggctgtaagtatttgggtttatttctgggttctctattttgttccattggtctatgtgcctatttttaccagtaccatgctcttttggtgactatggccttacagtatagtttgaaattgggcaatgtgatgcctccagatttgtt

SEQ ID NO: 43090 - DNA, 1053 bp, Homo sapiens
ttctggccaggacacttcttgatcagttcaaactgttacaaagttcagctgaagattcccttctccctgtggccttttactagtgcctctggccaccctgctgaaggacccctgtgaggccaggcagaaatggtttgctaggggacccagtgagctcacagggcttttgccgctgcttcctctacccctgtattttgctcagctctctaaattgactcagctccaggcagggtcagaatcttctcctgtaatctagaccttcagtttccccactaggggtgtgtatgtggcggcagatgatctccctttcccacttccacagtttgggcactcactgtatttggggtgtctcccgggtcctgcaggagccatccacttccttcagagggtctgtgggtcctcttgggtttcctgatttattcctgcagtcgtcctggagcaaaaattcacagtgtgagcttccatatgctgctctgtctgtccaagtcagagctgcaatctagtcctgcctcctgtctgccatgctccctccattttaggtttttgctattataagtaacactggtatgaacacttccatacaagtttctttgtgtgaacatgttttcatttctctgggataaatgcccaagaatatgttttttgggttatgtgatatgtgcatgtttagttttataagaaatggctcaaacattttccagagtggctgtatggtttatgttaccaccagtaataaggttgttcccagtttctctgcatcctcatcagcatttggattggaatgggttctctgctcccacaggatggaaaacaactttcctcccctattccaaatttccagagatagagactagagagaaagggatagaaagtggacctgcaattacacagttaaaaaaacttcaaataatattgaaataaatatttttgtacatagacttctttgttgtttatttagttatcacagtggttaggtacaagacttccaagtactactttttaccttctctgcactcttttctcccatctgtgggctacccctgcttaggggct

SEQ ID NO: 43091 - DNA, 1047 bp, Homo sapiens
aatatttaattaaaacctccaagggggtgggcgtggtggctcatgcctgtaatcccagcactttgggaggccgaggcaagcggatcatgaggtcaagagatccacaccatggtgaaaccccgtctctactaaaaatacaaaaaattagccaggtgtggtggcgggcgcctgtagtctcagctactcgggaggctgaggcaggagaatggcatggacccgggaggcggagcttgcagtgagccgagatcgcaccactgcactccatcctgggtgacaaagtgagaacccatctcaaaaaaaaaaaaaaaaaagaaacgtccaagtattttctttgggagtttaactttgttctaacaactagaattgtgatgaaactaacaataattttgtttttctccttcagtctaattttaaaatagttctttctgtccttcccataaccatttacttataaaggagagtagtatatggaagaattcttaaccaagtgtttgcccattttgtagtgaggttggaatcccatggcgatatggtttgctgtgtccccacccaaatctcatcttgaattataactcccataatccccacatgtcatgggagggaccctgtgggaggtaattgaatcataagggcggggctttcctgtgttttcttgtgatagtgaatgtctcatgggatcctatgttgttttataaagggcagttcccctgcacacgctcttttgcctgctgccatgtaagacatacctttgcttctcctttgccttccaccatgattgtgaggcctccccagccacgtggaactgtgagttcattaaacctctttttctttataaattactccatctctagtatgtctttatagcagtgtgagaatggactaatacacatggggaacaattttccaaaatccaatgaaaaatgtcccattattttcaaatatgcagaggtgctagatttcagaaacacaaaatacaacctaagtccctgaaataaaatagtatgctttagcatgttttaaaagaaagtgtgtgcattgtcagaaagc

SEQ ID NO: 43092 - DNA, 1065 bp, Homo sapiens
atggctgatccagagccctttggcctgatctccactatccatggaagcatctttcttcaaatctagggctacatgaaacgttttgaaaactattgatctgtggttaaaaattagcagttaagcatgagcttctccaggagcttctgttattatacccttgaatttattaatttggcttcatacaggtgagtttctttggttgagtccattatacaaaatgtcttctttctgtaataggtcagggcagtgatgtttgttactggaggaagctgagaggcttagaaaagatgctgagacttggtgtccatcagataatgtatgatggtgagaactggtgaggactgatgattccagagaaagcatatggacagggtaaaggaggtgacctacggtatccaggaagtcttttctacagtgggtttagggtgcagtggaaggggagaggattttataggttgtggaagtatttggtgaccggtggtgataagggatgctggacctgagttgggtgccagtcctgtggactgatctgtgggagtggtgacctcagcggtcatgccctcatttccctcctgcctctctgggtgggagtgcctggatatacgtgaactgctgcccagctgcacagggctgccaggctcatgcggcctccccagcactgcaccactggagcaagtgggcgttgatgcgtttcctcattcatccttaattattctgattctctggtgttaaaatggatccaggaaggctcttggagccagtccaacatcacagtcttttgtctctgaaccagtggttattgtttctacctctcaaggtgtataccccctattttggaaaattatctgccatgttgaagtctgaaaatataggtatgggtgactgggtcatctcattctctgtcccagttttccctgagtgtggcagcctcctttgcttgggatagtgggagcagagactcttaatttcaccaaggatggactttgcatttctcatgtatattctccttggattatatgggttttaggacagaaagggtggcagaaaacattgttatactatatt

SEQ ID NO: 43093 - DNA, 1025 bp, Homo sapiens
tggggtacatattaggagtggaattgctggttcatatgacaattgtatagttaacttttgaggaactgccaaactgttttccacagcagccacaccacttcaaactcccaccagcaacgtctaagggctccagtttccccaaattctttccaacactgctattttctgattgtttattattgccatccccatgggtatgaagcggcatttcagtgtgactttgatttgcatttctctaatgactaatggtgttgaacatcttttcatgcgttactggctgtttgcacatcttctgaatgtaaacttttaacaaaaggtattttgtcatcttgtaaccattttaggcaatattttcaggatttaggaaattcaacaaagcctcaataatgtgcattccccccataacctgtaagtagacataggatcagggtgggatgggatggctggaaataaaagacctacgctctgatgttctcctccacttccaccctgctgacttcttgccgggcaggctgttttgaaaacattatcgtgcactgagcaggaaaccttagcttttctacagttcacacattattttctctggctctttgtatatctagtatccttccaaataggtgtatgtttaggacagagctgggcacagctgtgcagagtaatgaagctggggtcccttgagctgcccgtgatattgcttcaataaagagaactcggaatgcaggctgtggcattacactgcatcccatttagtctcctcatgggaaactccactgctatttagctcttcccgaatcttgagctaacaattttagacaaaccatgaatttgctgggggtcaggaggatggtgtattctcagcttcagataggcagtagatataaaataagttagctcctaccttcttctcagtagtcactgagagcatgacatgcccctacttaaacacctcccctggctgccccgctcacggaatgaaatctgtttagcatcctgcaggccccacgtggctgccccagccctccctc

SEQ ID NO: 43094 - DNA, 1082 bp, Homo sapiens
tcttgtataaggtgtaaaaaagtggtctagtttcaattttctgtatatggctagccagttctcccagcaccatttattaattaggaaatcctttctccattgcttgtttttgtcaggtttatcaaagagcagatggttgtagatgtgcagtcttatttctgagttctctattctgttccattggtctatgtgtctgtttttggtaccagtaccatactgtttacagttggttactgtagccttttagtatagtttgaggttgggtagcatgatgcctccagctttgttctttttgcttcagactatcttggctatctgggctcttttttggttccatatgaattttaaaatggttttttctaattctgtgaagattgtcaataaaggaagtgaaggacttcttcaaggagaattgtaaaccactgcttaaggaaatcagagaggacacaaacaaatggaaaaacattccatgttcatggataggaagaatcaatattgtgaaaatgactacactgcccgaagtaatttatagatacagttgatttttaaataccgacttcatatcctataacattgctgaaccgatttattaattctagtaattttttgtgcattccatagagttttctatgtataagatcatgtcctctacaaatagagataattttaattctttctttccaatctagatactacttacttcttcttcttttttttttttttttgtgggggggggggggggcctggctagaacctccagaacagtaatgaattgaagtggtaatagtgaacatttgtgtcttattccaaatcttaggaagcattcagtctataacatttaagtaggatgttatctatgggctttttatagatgccctttatcagcttaacaaaatttacttccattcctagtttattgattaattttatatgaaaatatattgaattttgtcaaaccttttttgtgtctattgagatgatcatgtgttttttgttctttattctattaatatggcattatatttattagtttttggatgttaaactgatattaaatgcctggtataaatcccacttgatca

SEQ ID NO: 43095 - DNA, 1023 bp, Homo sapiens
tttttggtttccctttcttcctttcctcaagattactaccaatttctgggggcaagcattgactagggttgctcttccctgtcatcactctaggcacattgctgaggatcagtcctcactgcctctctcaatgtctttcccaagccagagtcttctgctgcctctgaccctctctagaacatggggaaattatgttgttctcaacacatccaattctatggggtttttaaggtttctcatcatttctgtgctaatctctcagggttgagtattggtctacatttcctgcaccacgagggatgcatcagaagtcagggttctccagtgaaatataaccaatatgatgtttattgacattgatatggtttgaatctgtgtccccaccaaaagcttatgttgaattgtaatccccagtattggaggtgaggcctggtgggaggtgattggatgatggggtggatccttcatgaatggtttagcaccatccttttggtgctgtcttgtgatagggctctcatgaaatcttgttgtttgaaagtgtgtggcacctccctctctctctcttcttcctgctctggccatttaagacatccctgcttctctttcaccttccaccatgactgtaagtttcctgaggcctcctcagaaacagaagccactgtgtttcctgaacggcctgcagaaccgtgagccaattaaacgtctttctttataaactacccagtctcagtatttctttatagctatgtgagaatggactaatacgaaataaagcttaattagttttacactttagatatacagtcatgtattgcttaatgccaggggtacgttctgaggaatgtgctagtaagtaaggtcatggtaacacaatggtaagtatttgtgtatctaagcatatacttccatagtgaaggtacagtaaaaacatagtataaaagataaaaatggtacacttttatagggcatttaccacaagtggagcttgcagggctggaagttgctctaggtgagtcagtgaat

SEQ ID NO: 43096 - DNA, 1005 bp, Homo sapiens
atatttcccgactgaagcttatagacactgagagaagagcactaagaaaatcaaatgaaagaatgagaaatcattttgaaagttctgaagtactacacaattaaaatggtttactgatatattcccctggtctctcaaattaattttaaataacatcactggcaggttctggaaaggcattatggaagtacttttacacattttttctgcacagaagtccaggatatccatagtggcctcagaaaaatttactagggaaaattataccaaagtgaccctgtgacttcttctgagactgccttgtgttggctccctcttcctgggcagtcggactacatctcccagaatcccttgcagttgggtctggtcattatgactgctctctagccaatagaatgcaagtgaaattaccatgcgccacttctgggcctggcccatccaagcatcccctgggcaattattcgtgttcttttaccttcccaggtgaattctgaaactgtgggtggtaactgaaagtgacatagaatggaaggaatcttgatttataaagtatcacttcaagcaacgtcactcaatgaccggcaacattccttttggactttacctgggtgagaaacttttaatgagttagaccactgaagtttcatgggtgagctgcttagcagctgctgttgtcttaattaacataggtacctctggggccaggtgaaatataactggttccaaactctggtgatgacaagggattgaaagccctcttcacacagggagatgtacttcttgaagacccaaggtcgtgaaagtagagcaaactctttctgattaggcttggcgtccacttcgtgtatggtccaggtccactgctctgtgctcctctctgcaaatgctgcgattcaggttctgccatgactcagcatcttcccttgattgggttagaaagggcaatcctgaagaaaagaaattcatatctgtcaatttggtggagtttgcaaaagtctgctaaaa

SEQ ID NO: 43097 - DNA, 1023 bp, Homo sapiens
ttttttttagaaaaatacttacacataagataattgttttgaagaacactgcaggttgttattctgttatgactgcagactttgttttgctcaaagcaaatccacttgggcattacagaaaaagaagagcatgatgaatgtcctgtaagaatctgtgttatctgcctctgtgtgaatgcaaaacaacttgctttcctaccagggcttgtacttattcattggattcttcctcattacctgagctgctaggtgaatgtttggctgttgcttatttattttataggattttcattaagtctttgtatatttcttaatacaacaatagagattgtaggtgagtttaaaattatctgtaatgttatttaacagaatgcattaagtttgagacaatgacattatgtaaatatattgaatgagttctaatctagagtgtggggtgcaaatctctatggaagcaaaatggaatttcatgttgacagcagcagtgcgtttcctttacttttatgtgctgaattctggctatttccagaatgagtgcaaagcaggtaattaaagttaaaagtaaaggtttgacaatgatgcaaggatttttatgaaacctctatacagtggcaagaatcttccctgtaaagtttgtatgttttggcactagataaaccttatttttaaaatattttaaattaattttaatctccccccttttgttttagtgaatatgttgggcatcagattaaaatgacattctgaaaaatattccttcagccataagaccctcgctggttctaagaaaccctcaatgtgttgttaaataaaaactgcactggacaagatgagcaaatagaagttggttttattcccacactatgaagagcagcaggggagagaacacagaccaagcccagatactcagatttgctgaaacaaagggcagggaaatttttaagagctggggtggggcttgtaggccatctgtgtttctagtttgcttcactccaagggaaagtaaactttctcctgtcttca

SEQ ID NO: 43098 - DNA, 1023 bp, Homo sapiens
tgattttgcaactacgcaagtgtccttttcaattcctttattcaaaacaggatgtgttaattttggaaaaataatagttaaatgtgtaagtttatgaaaccctaagcttaaattctggttagacacaccctggtttcctgtacctttttttcattacatatatttataattttttcattttatatttatatgcattttgaaattttacaatagttttaggtttacagaacgtttgtgaagataatatagaattctcatgtaacagatacccagtttgggtgattactattttatattagtatggtcataattgtattgtatattgtacataattgtatgttagtatttgtcataattgatgaaccgatattgacaggatatgactagctgaagcccatactttattcacatttccttagatttacctaatgccccccttttttgctctaggatcacatgaaggatgccacattacatggagtggccccatttccttaggcttctgtcagctgcgacactgtctcagaccccttgttcttgatgaccttgacagtgttgaggagtattgatcagatattttgtagaatgtcccttaattaaaatttgcctgatatttttctcataattagactggggtagtgggttttttggaggaagaccacagaggtaaagtgctgttttcctcatattgtgaagggtacatattgttaattatgattcatgactgttaatgttcgccttgatgatttagccgaggtagtgttggtcaggtttttccatcgtagactggctctttttcccctttacctgctgtagtttttggaaggaagtccttagttgtagtccactcttacgaagtagagagttacacactctcttccttgagtaactacgtaagtaactacgtaaattatttggaattcttccacatgagagatgcctcttttccttcactatctatgtattggatcatttatttataccagcattaattttatttatgattactttatactttgggtg

SEQ ID NO: 43099 - DNA, 1194 bp, Homo sapiens
tttataaagatcaggaaggccttacagtctaaatgaggggaaagcttgccagataggaatgggagttcttctaataggaagagatagcatataaagtgagagaggcctgtgaagtgtttggcaagcttgggtaatcacaactgattccatgtgactaatgggagtaagggggtgggatggtgacattacaagagattaagatgctggccgtggtggcacgcacctgtagtcccagctgtttggaaggctgaggcacgagaatcgcttgggcccgggaggtggaagttgcagtgagccaagatcatgccactgcactccagctagcactagagtgagactcgatctcaaaaaaaaaaaaaaaaagaaaaagatgtgaaacatctcatcttggactctttctttttagcattaatatgagaaacagaatcttatttcaggaaaattactcctggaacagtacagaggtcaacctgaaaggaaagcgactggagaaaaggagacaaatgtaaaaccttgctaacatttacaagaggaaaagaaatgaacacagtgagcgtggggagaggtagatatgaacagctctgcagttggaggaacaaaccttggaaataaggagaggtgacctgtgtttagctgcacccctagagggtggaatcggctgaggagcaagcccagcaacactgaagttcagagatggagcggctgggcggtgggcgagagaaactcttcggggacacatgtggttcatttcaggaggtagctaaactttctacaaagttagtacgtaattacacacttattttttaattcaacaaagtaatttgggagagcttcatggggagcagcactgaggtttaaagagctgaggatacaattatcttcatttaactttctatgctaaaatatttcttaaaaataaagttgtgcagctattactattcaaatatttccttaaattaccaaatatttgctagattgacatatgttgtttaacttttcctaatgagactaaactcctagagctaggatacgcagtatttcttccaagtttcctctcaatacctagcagatagattaaaaacacactttttgtgagctatcaggtagatacttttaattatcctacacaaagaaacaatcttgggatgatttggatggattatctatgtcttcatcattggcattcacattgct

SEQ ID NO: 43100 - DNA, 1048 bp, Homo sapiens
ccccgccctccgcgcccccgcccgcgcccgcgccgagcgcccgaagcgcgggagccgcgcgcgccctgcgggacgcaccatcccgccccggccaccgagggggagcgccgaggagccgcccggcctccagtgacgccccgcgcctctgccgccagccacggctccggggtagctggcgccggcagcccgctctggcccttgcggttccgtggccgccgctctgcaacgagggggccccgaggacgaggggaaaccagctcccccctcggcggggccggagtgagccggtcccggggaggaggggagctggcaggcccctcccgtcgccacatgcggctgctcgggggcggcgcatgcgcgcggcggaggggggggtggggccttggggccgcgagtgggagcgggagcggttctgcggcctcctcgggcttcttggccctgggcggagtgggattgggtgtcccggctgttcgcagtggccgcgagtgcggccggacctggagtagtacctgagccgctctggccgagcaaggcgcggggccccggtctacaccgcgctggacccggctatgccgtgacggaattcccgaggccgtagcgccacgcgagacgcgcactggtggcctccgcggcgagtcctggggtctccgcaaggcctcagtgcccgagctggggacgtgctggggggaggcccggccccgtcgctgcccgaggccccgctgtcccggccggaccggcctggtccctggcgtcctgtcgggtccgcgctggaggagagtcccagacagcagagcccgcggtgcagctccagccccgggaagccccgcgctcaacaggttaatactacacagcggcgattctaatggtcacgcttttatttacagctcgcctcccttccgccaagattcacagaacacggcagagtggcctcgggatcacctgcccaagacacctgcacgaccggaagttgggagaagaaattaaggccatgatgatgaacgcagcctttctcgtttatttccaatcccacaacaaaccggagtccagg

SEQ ID NO: 43101 - DNA, 1081 bp, Homo sapiens
aaatagtttagccttcagtatttgtaattggatcctcaagggtttctaggaatatctggacaatttctcatactctcatattctacttttttttaaaccatcagccaagagcataagtaaaatttttcatagtatgttttttacctatttatttattaagctatagtgaagtaaagttaatttggggggtccatttttcagaactccaaaattagaacctgatgaagtataataaattgaaaacaacattttttatctgaatgtttgatgcaaactgtgtttcttgtttctcagttgaacctaaaatgtatatttctttcatactacactgaggtgaaacaattgcagggttctcaagagccctgggacacagtgacccttgtgtcccagcatccaaccccacgggccggcaccccactcccccctacagacattcattcctgccttcatctttgccattttacttctcttttggaatgccattccttcccacctgtccaaattccaagttcgtgtctataaagaataactattccagaccacagtgatctctttctctgtgtcccagttacataatccttataattttacacatgagaaaacaaacatgcagagccacgtcccatcagagggcaagctgggatttgaggctgagttttctcttcttggtctggtgttctttccgcagcttgaggcttgaccatgcgggaaccagatggagaataagcgaagcctgtgtggggctgtctcgccccgtacttgcccatgtgcatgtgtgcacagtaggtgctcagtgcctcgtacagaacatgctagaacccccgaaaatcaactccagggccactctaggagcatgtgacccagactgtcaaagtcacatcagcaaatatgtatctcatcacgtgcccagccccagtactgggtggtggcaggagtgtcagagctgtgatgtgacagggtgtggacagatgctaacctttttattgtaagatagaaatcacaccggatgaaaagacaaggtgaactacatagtcatttaagttctgtgtgctttaggcaaatgtggatattaaatataagg

SEQ ID NO: 43102 - DNA, 1837 bp, Homo sapiens
gtcccacatggaaatagtatgttgttttcatgcattcgccatcatccccgttaatagtcttcaaaggagagctggcaactccatcattgctttcttgctttgagatttttgtttcggtactctttgggagagaattcctaagaaggtttttagaataaaattgtcctcaaccagattgactaattacacattataactacaacttgaataacatttaaagagttggttatttctgtttgataggttggtgctgttatatgtcaaggctttttaaatcggttttaagaaataagcattattttggtggaggtagaaatttcacaacattcataagttctaaacatctagaaatggttggaggaaacattttcgttttgaagatagtttcattaagtaatccctgctgtgctcctttgcttacagaaaaaaatgttaaagataactcaaaataggatagttggtgtaattataattctccttacttcagctttctcttcatcctttttattctttaagcttgggggaaaatgtttggatgttctcgtatcttaaaactggaggagagaggctgggcgcggtggctcacgcctttaatcccagcactttgggaggctgaggcgggcggatcacgaggtcaggagatcgagaccatcctggctaacacagtgaaaccccgtctgtactaaaaatacaaaaaaaaaaaaaaaatagccaggcgtggtggtgggcacctgtagtcccagctgcttgggatgctgaggcaggagaatggcgtgaacccgggaggcagagcttgcaatgagccgagattgtgccactgcattccagcctgggtgacagagcaagactctgtctcaaaaaaaaaaaaaaaaactggagaagagagatcaccaccttaatccccttccctgctgggctatcacatgaaactgacctctgaggttctaagcctaacccgcctaccactgtttttattcataaatacttaaatccttacctctggatcccaactgttactctttttttcacttcaaaatttgcaaactcatttctatccatcaaaccccggaaatggcccaggggcttcacagtgcagtcccctccctcctgctgcatccgttcctcaggctgtgccccaggttgcattcgtggtgcgtgttttctcccagggcagccttccccacattccactcttgtcatactgttgactcacaaaatggaagtggctgaatgttccagggatagtgtctaagagctattggtttaaggttgaaacctacaccaagtaaggctttgtgaagggagatgacgagagtgaagttgttgacagtctgaaggtgaagagattccgaggctcagttcagcaccgggaccagacccgcccagatccagggtaatttgaggtctgtgtttggtgctgatggttttgcccagtgcactccacaccctctccttcttagctgtctcagttctcttcagatgcctttgttctaacttatgcttccctcccttaagaagaaacatagttacttgcaagaataaccatgctcaaaagttacaagttggctttgcttcaagttatatggtctcctagctttttctatgtggtatttccccccacacatgccgttgtcctttgtgtccgaaaatacagcagaaacatttgttatcagcctgttacggtttttttgtttgctttttgtttgtttttatttttactttttttgagacggagtcttgctttgtcacccagactaaagtgcagtggcacaatcttggctcactgcatttgaaccgtctcccaggttcaaatgattatcctgcctcagcctcccaa

SEQ ID NO: 43103 - DNA, 3280 bp, Homo sapiens
gctccttcctcttaaagtgagtggagggcaattaagtaacgtgggaagtcacgattctgagggaaaaaaattctgtatggaggtttctcttttgccctttagcagaagctccgtggcctcaggaaggtcatttaatctctctggctttgcttcttcatcagtgaaatactgttctccattaagaatttaccctgaggtgcctggtcatagtagtaactgtagtgtctacctctcagaagctctgtgagggtcagatgaggaagaacatgtagaaaggatttcccaactgtgaagctctgtgtgaattgagggcacacagagcttcagtattacaaagcatgacctatttccaatgtctgtttcaacaaactgctggtaaggtgggttataacacaggcatcagatactaataaaggtttgtggcagaaacctcccttcagataaaggttcaatcccttaaattgcagttagaactttcaggaacctatcataccctaagcatcaccatgctttgataaaattgggtgtttcctttatatagatattaatttagttaaactttcaccaatatcttacacttatataacaggctttatataagggcctcagcagcgtaatttcacctgaggcagagaattatcctaattttgcaggtgagagctgtggctcacggggccagagccatgaagacggtgcaggggagctgggagagctggcctcggtctccagttctctgcacatgtcccacctctcaatcttgttgcttcagtcaaagaaagtgtcaatctttcccatgttaggacctacttaattggtaattaaaatatttatacatttagtgctaattttctctttccttttttttttcctttctacacatagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaagtgttgtatttatgtttgctttttaaaaaacagttggggtggtggtctctgtgtaggatgttagaatttgtaatggagaaatattttgcagttcttcaaattttactgaattttgacacaacctcttgggaagtatttgaatcatccttcaatatacacaggacattggttccaggataccccacgtatgcgaaaatctgcatactcaagtctggcacttggccctacggaacctgcgtacactaaaagtcagccctccgtatacgtgggtttcacattcagcaaataaaccatgtttggttggaaaagctccatgtatataagtggacccacaggttcaaaccctgtgttgtttaagggtcaacagtatgtgtttttcttatggtagaaagttttaagtgca

SEQ ID NO: 43104 - DNA, 1085 bp, Homo sapiens
aacgtggtggctggaagatgggcccggaagtgcacactctcatccccttccctacgatcttccaactcaggccaggccggggacgcatgccccagcccaccccagacttgtcctaccatccggttatcccggctgtgctcggggaagaaaaggcgaggccctttgccgctctgccttctgcccctcgggcctgcgctgaccggtgggactcaggaggatgcacacagggaaggaggaaaataaaggcgccctttccccttggctccactttgtttgccagcgccagcccgcagtggtggggctcagcccccttcctgcacacagcgaggacaagggaggcagccgtccctcccggcacctgccatccccaaatagaaaggaccttctctcagggtttcctgggggctgctgatgggaaagaggcagcattcgcaggggccctgcagagatgctggatatattttttcatagatctgcgattttaaaaaactaagtccatgtccttgtagaaatcatcaactgcattccatgcgggtctgcggctgggaaccgccattagaagtggactgtttgaccccgagctggcagcggatccccgctgcccccaaaccctcaactattttgcgggggtcatttgcccagatcacagcaggagtgagccaacccttgggccgccatcccgcagaactatgcgtgcatatttctgatgaaattcagatttctcagctagatctgaaatttgctccattgttctcgtcttcctcctttgttaatatttaattaacatacaggctcacaatgccgggcgaggagactcggccgggctttgtgcggcgcgggagttcgctgagccagcccccaacggcccgggagctgggcagcaccgcccggcccggcctggcccggcccagctcagcccagcccaagtcgcctatcttcatgggctttaaaatatccctgcaagataatgtttctgttctttggtttctccgaaagaaaggggagagagagttttcttggggaggtttgattctgtttctgagactcctaagtatttgtcttttgaaagaaaatcaagaaaaaaa

SEQ ID NO: 43105 - DNA, 1050 bp, Homo sapiens
caaggtgcccaggcaggaactcgggctcaagtgatctgcccgcctcagcctctcagagtgcaaggattacgtgagccaccatgccttggcatgatacatttcaaaggagtcatttggtattgcagccaagtagtaaggatagagaaatggaattgctatccttactaatagcagagagaatgacaactgttatttattggagactgaaaacaaaaacataaaggcaaaaacatggcattttggggaaggaacaaatagtttaatgagtttcaagatcttctagttccagtgcttccttgtaaaatataaaataaaaaatcagtacacaaatcgtaaaaagcctccaacctagtgagtgcgttatctcacttaagatttacaacagcattcttgggcctgagctaatctgattttataggtgaggtgaaaaaatgggtgcttgtaaattttttgttttctagtcaattcttagaaataaaaagttttaatgggaaatttcaaacacatccagtagtagaataatgaacccacatacccatcacctagcatcaacattctggcaatctgttttcatccccccacctccacttttgtatatttcaaacaaatcctaggctggtaaaattttagagcaagatacactgctgggatgagttaagactttagatactaaaccagttgctttaatttacatttgatagtaaactagccgagaaaagttcagccacctagctgttaagaaagggaagtagactcgaattcaggttttttgacttctagttcagtgttccttccactgtgtcagtatgtagtaaggcaggaaagtatgaagcatggtgcagaaggttttcattcgaaattgtgaaagtgaaacaagttttagtacttcaacaggtaaaatttacctggtaggaaatttttggagcattttaatcactaatagtgctgataaatgagatgttttcatactgataattatgtgtgtatttaattctttttttttttccttcaagaaaatctttcatgcttaatttcttagcttcaatcaag

SEQ ID NO: 43106 - DNA, 1096 bp, Homo sapiens
ttacctgatttgtagttaatatttaaataaaggatctggatttcctcatctataaaataaggaattttgactattagtgatttggactaggaacatattatacatgagtgtgatattgaggaaaaagaaggttgagaacctttggaatacaaaggtcagcaaactttttctgtaaagggtcagatagtaaatattttaggctttgcagggcagatgagttttgttggaagtgctgaactccgccgtttaccttgaaagcagccatagacaatatatgcctgaattggaatagctgtgttccattaaaagcttatttacatacacgggtggtagctaaatttgggcagaaacaggtggcaggccctacttggcccatgggctttggtttgctgacccttagattagataattgctagaaccctatcacaagctaatagtctatgtggtatcttatccaagtcgaggattctggaaaagaagaagaaatagaatggtaagtaaaagtttgtgttaactgtagatgtctgattgctgcatgatagagaattgtagaaatctagtagatatcttcagtcttgaaggaaaattgatccccctattaaaatagaatgtcttgtacaatgtttaggccttagaaggagattttccaggtaaggaggtcattgacctctttcgttttgctcagttaatattttaccccttggctttcatggatgtgctgttcttcctttaaagttctggactaatggggacacattttttcttcttggttctgtttaatatgactgctatgaactggaactttaaaaagtatttgtattctaaaggaaaacagagggaaatgactcagaatatattaagaatataaacaggctgtacagggttcttgtgttagcttgccctgtaagattttgagtcattatttcacttagcatgatgtcttcaagattcatcagtgtcgtagcatgtgtcagaacttcctttttaaggctaaataatattccattatatatctatactatttttttttaaaccatatatccttcaatagacacttgagttgcttccaccttttggttattgtaaataatactaa

SEQ ID NO: 43107 - DNA, 1027 bp, Homo sapiens
tattgcaataatatttcataatgatcatgtattagtttggtatagataatcaagctattactctaataaatgagttttttaaaagtttaaggaagaataaagaagaccataaatccataattaattctgtgtgaacagataactaccattgtagcagtttggcttatatcctgggcacacgtgtacacgtatgttttacatacacagtggccataccatattgtatgatattggagaattcccccccattatattattggggatattttttcatgtcaggaaacagtttgactttaaaattcttattgctgcctaatatgtaactacatgactgtacttttatttgacctctctgctctggcttttttttgttgggcatttggtttatttctactttttcctattaataaaacacttcttgatgaacatccttgtacatattacctttgttcactaaatgatgaacagtatttatcaaaatcttgggagtccccgagactatgtcagagtgtctgtgaagtcagactattttcataacggtattaaggctgtttgcctttttttttttttttttttttttttactgtgctgacatttgcatcaatgttgcaaaagtaatggtgggtacattctctggtgttttaacatgaattaaggcagtgacaattatttattttattaaatcttgatcctaaagtgcatttaaaaaatctttgtgacaagtagggagcatatgcataaaggacttctgtttcgtactgaagtataacagttgtcttcaggaaaagtacctgtccagctggcatggtagtgtgcacctgtgttctcagctacttggaggctgaggcgggaagctcacttgaacccaagagttcagtccagtctgggtaacattgcaagaccccgtctcttaaaaaataaaaataaaaaaaggtacttgttcaatttaattgtgagctgagctagcttttcttatttcttctgtagaacatcatttttacttgaaaggacaattgacagactgtgg

SEQ ID NO: 43108 - DNA, 1094 bp, Homo sapiens
ggcagaaggaggggtaagacttcagcatatattttttggggatacaattcaaccagttataagcagttctgccagcaacagatttcttcctgttctgttcatctgtgaatgtctttatgaaagatcatgttggtggatttgggactctttgagcactttgaataggtcatcttactgcctctggctgcttctgttttgatgagaatcaactattgcacttccattgtaggtgatgagtcatttttgtcttggtgctttcaaggttttttctgtgtctttggcttcgaaacattttgactacgttgtgtgtgtttgtaaatcgttgagtttattatcatttgagtttgttgagccttctggatgtatagataaatattttccagtaccttttggaagttgtcagccattatttctttgagtattttttccttctcctgtctgtcctctccttctggtgctcccattacacgtatattgttgtgcctcctgatggccccacatttctttgaggctgtgttcagttttcattttctgatttctgttctttggattatgtcatctctgttatctgttttcaagtttactaagtctgctagttcacatctactactgagcccctctaatgaactcattttagttatttttcaatttcagaatttctatttggtttttaaaaataatttctgtgtgtgtgtgtggtgtgtgtgtgtgtgtgtgtgtgtgtgtgtgtgtatatatatatatatatttttttttttttgagacagagtctcactcttgccaggctggaatgcagtggtgcaatgtctgctcactgcaatctctgcctccctggttcaagccattctcctgcctcaacctcccgagtagctgggattacaggcatgcattaccacacccacctaatttttgtatttttagtagagacaggtttcaccatgttggccagcatggtctcatgatccccctgccttggcctcctgaagtggttttttttttttctttctttttttttcttttttttcccagacagagtcttgctctgtggcccaggctggagtgcagtggtgtggtctcggctccctgcaacctct

SEQ ID NO: 43109 - DNA, 1027 bp, Homo sapiens
gttgatttatttccatgtacttgtcagcaagaggcacagatactttctagatttttgcttgtataattactaatgcctgtttttatgactttgtcagtttgccctgggaaactggcatcacattccatttttagttacttaaggtgatggtatagacgagtgcctgtctttaaaagaggtgcttgtgtgtttttggttatctggaatcaaattttcaaatggggttattgtaaatattgttgactagacagcattgttttctccctgcctctggagggtagttggaacactgaagatacaaaaattgtatttgatagatgatagtggttttaaaatgttggaagaagctatatgttattctcttataactatcctataggagtttgtgaaagattgtttttcaagggctgttaagttcttgtcctgcatctgtcactgctgtgtgactttaggcaagttatttcatgtcctatccttgttttctttatctgtaaaatgtaatataggacttactggaggataacttaaaataacgaataaagtctttagtgcatgaattaaatgatttgtcaggttgtttttagttctaaaaggcgttatatagaaacatgcatttcattataactccatatatgcattcccggagattatagtattctgcaaagtggcatgctaaaaataaacatgattttttggtaaaataatggttttgctgatttctcaatacctatagaattttgtaaccagagcacctattaaaaataaagcagcaattctaataacaatatcgatgcagttaaatctccatgagtattggcacctagagttacagtccatctaattgtatttcctctttgtatatttctgtatgttgacttttaatgatatttgcttccaagagattgatttccccagaattaaaaacatgatctagtggtagccatttttatcaactaaaaaaatcttgtttctaataaatgcagtggaaaatgtcttcagcttttttatttgctaagggtttctgttt

SEQ ID NO: 43110 - DNA, 1051 bp, Homo sapiens
ccacattaaaatgaatttttttttcagaattaaagtcttgaagtaaaaaaaaaaaacttagaaattctggaagtgttctgatgttttcacagagagttgtaaagtttaaagttgagcagtagtagttcaatgtctttctgtgagcaatgtcagttcatcttgatacatgtgttctagccgtggtcattcttttcttgctttatgatgatcacaatggtaacatctgaatgatctgaaatggccgcttccttggacaggaggagatacgcagagaattaaattgtgaggtactcttatcttgctcggcaatgggagcctctctctgtcttcggaggctgtcactgaagcccagatgatttattcaccattagactaatgaacacatgagcagattgtgtctctgtgtaccccaatggcattttagtttattaaatgacttgtataactgtgatttttgttctcccttgggttgttaacccccactctaagacttgaactctgaaatgtggatctgttggaacctacctgtaaagccacatggaggggctttggtgcataacagggagtagaatcatgaaaccccagaatgtacagtgggagggtttgctgttccctatgaagaaagcgaggtccagagacatcaataaagctggacgcacagctctgctgtcctttcctgtgaatgttgctggtgctgttcttgagagtgaattgtgatttcatttgaaaatgtgtgctcattatattagtaaggagtgtatattggtttagtcgacaaaatattagaaaatggttgagtgacttttacctttaagtgcaatcagtttatttaaggcctttaaagttaacatagattaagattttattgttctgtaaaaacaatttcaggttgacattttatgtcatgggtagcagatgtttgtttcccagcgagaatccaggggtgtggactgtactgcattgtacactggctgaagatttggattagcatcatttatttgactttatttgaaatctgaatgtcctgctgcccgtgattcatgggtagtga

SEQ ID NO: 43111 - DNA, 1050 bp, Homo sapiens
aagaatttgacctttttttttttttttttttttttttttttgaacattaactgttaatgtttaaggttattttctcctggagtcagcttagggtttcatgtggccttttaacaggacattttgcagtattttttacatctgaaatataaacaattaaatattttagcattctttaatatttaattcaaaagaatatgaacttactgtcctttttttgccttgtgtatctgcaatatagggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttgggtaacttttttgcctgtctcccatcctcctttactctcatttcaacttcctccatagtattgctgtaattaatcaaagtaggcaaagaaggttgactaggtaattgcggctgccgtccggagagtggccggactttggagtgagtgctgtttatggtactgtaaaactcattctttaaaatcattgctgtttatggatttaaaatgcttgaataaaatgtttaagataattaaaaaaaatttttttttgagtctgtggcctacagctgctcttgtacatgctgtggttcctggctggtcttgaaaaggtggcatggggatggtagctatggggccaggttgacccttcccaagaccctgaggttgtcagggcgaattctggacaagaccggtttatattttgtaccttttagtgtcttcatagctatatctttttttgtgttttctgcagttcctctgactttaatgagacaagttgactcgtttatagaaataatcactctgagcaaagcttgctgtgtgaaaggtctactacagactgctgctgattcacggagacttttaatagcgaccctacccctcattatacagtgtttttcaatgtccactgcaaggaataaagcagtgattccaaatttgag

SEQ ID NO: 43112 - DNA, 1044 bp, Homo sapiens
aaataatagtcaactattgagatttaaacttctgcttgcactgctgtgtaccgaaaaggaaacttctgctttccccttttctgttatggaattgttaaaaatactaaatgcttagcttaagcgtaagcacaatgtattatatgtctggtacgcatagtatatattttatattaaacttcatatgttgtcttacaggggtttgagtgttgagtaaagtgtgtctctaacacaaggggtttttcttgcagtgcccttgctaccagttccgagccagccgagacctgccgtgggaccccagagattcccagtgagtagcagctgctccttctcctttgatagggatgagcatacatttactaagaaatattaatatagcaagtgcaagaggttccagccaaatataattttaaggatttgcaaatattgacaataatctctgcaatagaaaatgtttgttaaaagcttaaggtcagtggatttttgagagtagaattaattttgtttaactgtaaaattgttgaatcaggatcatcagtggaatgccgttcgtcttaaagaatatgaatattgattttattattgccttatgttagtgagaaagggccttgctttattagagaggtggggggtgtatgtgtgcatgcacgcacaggcacgtgtgtttgtgcatgtgtattgtgtgtgaaattctaggaaatgaaaatgagagatctcttgtattttaaaagaacctctagggtcttaatgagccactcattttatattttaaaatgaaggttttcacttgaaaatacctttaaaagaaagcatatattctctctctctctctctcacacacacacactgtcattcacttatacacacacagaaatgcacactttgctgtatcttcagtaattttatccattcttctaacatgttttaggtagaagaaaaagcccattaactagttatatttgtttaaatatatacactttattttatttgaatttttggttcagtgtgtagtttgttcatggttttactaaactagagagtacattt

SEQ ID NO: 43113 - DNA, 1028 bp, Homo sapiens
ttcatccattaaatatttatgaccgcctgtgtgccaggcactgggccaagtatggaaacacattgatgtgtaagacaggcctggtctcagctctcacggacccggcagttgaagggcagagagaagtggaagtggattggagacattcaagagacagagtttctaggacttgctggtactttatgagggatttctgatttgaactcagaaataagaatgcaagcagggaatctatactgatttggtttttaccatatatggaaacatggaaatatgacagaagatatggaaatatgtcagaagctatatatcgtatttacagtctgggctgctgtctacaaaaaggtgtaaaaatgataacgacatgtatggtgaacttttgttatttgctaggtactgtcctaaggactttcctgcccctgtgaggtaggtactaattgctgttttgtagatgagcaaactgaggcccagacagattcagtcatgagctcaaggctgtagctggtaagtggctgggatggagacagggctgggagagctgtcaggttagatgatgggtgctgcttctcagcctgagcacctacaggatcactgtaagttagaataaagttctgcttaaacattagtgatggattttaaaggcttttattttccactgagtgtggaaaaactatcatgagagaattttcggggctttgttacgtaccagtaacattcagatgccagtgactgtgcatttagacagcatgtaaatagtcagttaaaggaaagaaagttttgggaagagatgaaaatcacaatattaaagttccagggaaatcttccagggaatctgatagtgcttagagacctaagaggtgatgtacctagttctcaggtagcttggaattttatggaaaactaagtttgtggactaaagtctttgagtttcttctaattcagtaactctttccttttagaaaaggatgaaagagctaaagacagagtccttttccctgatcacaacctgtggcaaagtaaaaaatcga

SEQ ID NO: 43114 - DNA, 1409 bp, Homo sapiens
attgcatggatttcaataagcttaaaaataatattcttgcgttataatgacattaaaacattgacttaatttctagttgctgcgttttgatttttgatcatttaatattgcagaatcacctgttgtgtaacagtttttatgttaatatgtgtggtcatgtcttgtgtaaggatattttggttaatggtggactgcatagacagcagtgtttccatgagattataatagtgtattttattgtaaccttttctagggttggatatgtttacatccacagatacttagcattgtgtgacagttgcctacagtattcagtacagtaacatgctgcgctggtatgtagccttggagctactagtgtgtactatacaggctaggtgtgtagaaagcgctaccatctaggtgcgcgtgtgtgtgtgtgtgtgtgtgattacaatacactctgtggtgttcgcatgatggaatcacctaaggatgcgtgtcagaatgtatcctgtcattaaggatgcatgactctgtgtgtgtgtgtgtgtgtgtgtgtgtgtgtgtagaaagagaaagacagtgactgttaggagacacgttacttgacatttttgaggaaaacttggaaccaggtctatatttctaaaaattacataccatttttctgtccttcaccctgtttctctgttgttgttgttgttctttagggccctccagaatttccacagcatacacctggacctgttcccaacagtttcagccagcccccacgactccctctccaggaccagtggagagccccacccccgcctcaggatcgagaccctttcttcttaggaggtacagaaagagtgagtggtgtggagtaacaacagaagctgcattgggtgatgtgcccaaacacatttattttgtaaactgaattgaactcccagttggagatgttaggaatgccaggtttttgtaccatagcagttctgcctgtcatttcaggtgctaaaattggacattgttggtatctgaaatcggaacatctcatataaaagggaatttatgtatagaaaatgacaaatgaagcaatctagaaataagaggcaaaatctggaattgtttccaacattcataacctgtcaacacttgtgacttctgtccacagtaggatagtgcttcagactgcttttctgagaagcacatggtctttttaacctgaagttaatgatgttgtgttacctttcagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcc

SEQ ID NO: 43115 - DNA, 1031 bp, Homo sapiens
aagagagacacaatgtggctagtggtcagtggtcagggctcttgcctccattaaatatatatgagactttgtaatttggtttttagaaaaagagacacagtgtggtcagtggtcagggttctcgcctgtcagttttcttttggtattgtcttcttttcacccttgagcttcagtcatgtcacttagctgcttggaatctcagttttcctgatatttgcctctttctttcttaaagtaaacattgcaactaaagtgctgtgaacagtaagaaaagatttctaaatctgagaagagggtgctttataacctgggtttcatttgttagaataatggtaggctagtctcatgaccctcgtgcactgggatatttgacctgcgggacctcggagatccccctgcttcccccctccccccttccagctctctcgtgttctctttgcctcctccaggtgttggttctctcttaagaatccccaggatgaatatgactaagcatttcctctcgagtaaaacgttctggcacctttcttctcccgggggtcatgtttcttaggacattgacctgatgcttgattctttccttgttccagcttaaatttaagtgactaggtaaaatagtagcatgtgaatcccgttgatctctggtggcagatagagtggttttttggctgtcttaattcttttaaaactgtcagtccctttactgaagcacctgctaaagatcagcctggtgtaatttctatgaagaggagcctctctgtaggcaagtatgacaactttaccaatggaaattgttaacattaggatgaggcatgctgccacatggatcaggtgacatttatgtatgagaaaaaaagtatgagaaaaaagtatctgctccccaaaagaagtcatttactaattagaatgatttattgtgtttttatttaataatgtgccttttaatgttccttctgccaagtttccacttacaattagaatctctttctttttgtgaaaagaatacaacttctcagaatgtaagcaagcgg

SEQ ID NO: 43116 - DNA, 1584 bp, Homo sapiens
tcttagtgaaggtacagtaaaaatacagtgtcataacctcatgggaccgcctttgcaggtgtcgcccatctgagcagaatgttgttatgcggcacatgcttcagttttctcttttgagtcttaatgaaaggccagtgtgacaatccctaaattagatatcactcagttttagcttcttattgtagataatttgtgataaaatcattacgtttgttttggaaataaattttcctttacacaaatcatttgtggtgtatagctttagactcagtgagcagctgtgggacagtgggagtggtgggcagtgcaggtgtgtgtctaatttgaatcagctttgtcccagactactggactactgcttgttttctgttttcagtttgccccatttaaaaaaaaaaaagcgtcatagaattgagaattgaagtcctgtatgctcttcccacatgctttcagaagtggagcatgcctcatttctttctcttgcttttcatcattgtccatatcaggtcattttcagtcaggcacaggaagtgcagttttccactgtagtttggataggttcagtactctaaaataaaaccagtcactgcagatagatttccattgcagaagattcttccataaagaagtgatctgtagaacacttgcttctttatcccaccatatagtcttattagttgtggtaagtagctctcatctgttgttttcatgaaaatgaattctataacaaatactatggtctctgtaattgctctgccctataacagtgctattcattgtatgcaatttatattataaactgaggaagaaagtaggaaagttgtaaacataggcttctagagtaaaccagctagcaacgattgctttaaaagacacaaaaaatgtatacagtaaaaaaagaaaataacttatctcttttagtccatttcaggatggtaggacatgtgatcatgtgaaggagaacgttacttcgtctccttgcttgtgcttaagaataactcattttgttagttggttaattagctgagatttagtgcttttatttctaggtttgtagaacaaaactttgactttttcatgtgctataagaaaatctttataaaatactgtgattagaagttccatatgtagactatccagtaggatagtctttatctgaatctgttttctcacatctattcgttgtaattagaaatgttgagaagaatggtgttacataaaattgttttcatattatatgaatttgttacctttaggtgagaactcaagcactcagtttcttcagtgtttatggcccttttgcttttgaccttgtttttaagtgtactgtgttaatcagtgtctcattcttttacttgtgttacagactttttttaagatgagatgttggccattgttgggaattaggccttttcccatagcaaccagaactggtgctgtttgttacaatggccgatgtagagggctgcatgtactctgcactggcaggctgggaagtgaagggtccagtttctaccatcaaagagcagcttttacactcataaacagctttcctttaaaagaattttatctacatgaattttt

SEQ ID NO: 43117 - DNA, 1910 bp, Homo sapiens
cagaggggatatcgggtccttcttagtgcattcagttgggaggtttgtccaatattgacaagattaactttgatggggcggcgggtgggtaaaagtgatgtttgccaagtctctcctctgtaatgttacagttttaccctttgtaattagtaaagtaatttataggaagatactttgagacgattgggactatgtaaatatcccatttctgatcaaattttcactattgttagcaggcactgaagtttttctaatgccaacactcctgtatttgttagctgtcatgctcctgctgtgataatttacacttctccttcatctatttgttcatttatttatgtcagtgtgggtgtatgaattgttactttatgcaatgaactgtcactgtcattatttatgttgattttagaattgtaccagattgaccagtgagagcccctttaaactggtttctgtgtcctttgatttgttgccattactcttggaacatgtcctcactttctggtgcaagaagatgttcgagctcaccttgttctttctctgtatgggctctggaattggtcctgcttcttggaagctccaggtccttagagtggagatctgggagccagttgtgcccactgcttttgtctgtcctgtcttctgggcccgctcagcacatttttgattcttctacagtgagttgcaaagaaaggaaaatggctcatacagatactgcttttgtactgtattttttgaaataggtcattggtgggaattaggaagtaatttttgctattttgatttcattttttgaattattgtagttgatagttctaagaattaaacattactatttagatatttaaagtgagtccctcatcctctataaacccaaacaaaagattgacagtcattatttgcaaattttgttgaggttctaacctaagtgttgatacatggaaaggcatgagacacagctgagcactgagttgagagctgggcagaaacgtgcatcacatgcttctgaggccgcccatcgccctgtgagaaccactggtctaagaacccatggaaattcctcagcacttcggttggggttagaatttgctactgtcactcctgctccttctctggaggtgccatgtttcatgcctctggcccacttattactttggatgcagctcaagtgggtcgtcttctgggacgcctccctggatggccgctcccacgcacactggttcgtcctttctttgttcctcttctgcagcccgatcttctcatctgaccgtgtgttttcagagccggctcctgatgttactgctacttacctgagtggggttttggtctttttttgtgtgtccaggatgtaaggcagtttcaggtacattataaatgtttaagatatttaaatactgtgttaaaaatggcaacatggcttgcactctcttactgaagcatagcaaaggaggaattagcagtgttcttacccctttccccagtacttctgatgataaaagtagtagttgtttctgttgacatttagatgataccagtaagtaagcaaaatttggaaaaagacaaaaagcatgaatcattactaattcttctgggcattatttcctgcaaaaatttattattgcctcctgaaagtcctcctttctagatttgcaaaatgggatatttcacatcctgttttgctgctgtttgaattgtgttaagtggcaaatctgcagtggtaacttgtttgtggtgaagacccatgcaaaggcagagcctccaccttgtgagtgtcattcaggggaacccacgttttttagcctctaaggtcccggacaggaggatgccgctgttctggtcgcttgatttctggcagaaggtgacttcctaggatgatctctggcagcgcctgggagtggatgagtagcaga

SEQ ID NO: 43118 - DNA, 1053 bp, Homo sapiens
aaaatggttggggaatttgtcaagtgttgtcactctagaataatgctgcttagcgtctgataggtataatcaagagttgagatttctatagagggggttaatcaatttgcttgctagtgaatgcaagtcagtgatagcacttcttcatggggtttaagagtgaaaataagatttgatctgtcaaattgcaggaagccctgacaatatcagtaggtgtttttatctatgcatttaaacgatttgttataaataaatttgtcctgctaatgttgggggctacagacctctttttttttgtaatgattaagctgataaaaagtattccctaagcttacttaattcaaatagtgccttttataaatatacaaaaaaaactagtctaaaaagcgatttttatagcattaaaagataatcatttgtgggaaaaaaatgtttctggtttgaccagagatgacaaaacttcttttctctctcatgtgctttggaggaagtagaagatatttaaaatgctgtctgaacctagtgttgtttgaagagttaaaaagcgaacaccaccctgggaaaattcagtttcaaagcaaacatactttttatgaatagaatgtatagtctgtcacccacatacaacacttatatgtggatgttaagataacagccttctaaaattcaatttgaatcaacagtattttaaaatttacttaactaagtactagtaattttaggatctctttcaatgctgtaattatatgcataactataaccttatagaagacttataaataaatgggtagatttaatttggcttggttcttattcaaatcttgtctgtatgtgtgagtataggtataaaaatatgtaatcaatttgtttctcagatgtaatcagttgaagaatttgttcctggatatttgtactacaacatactaaaatcaaaagtcaaaatcaggaagttgttttggtatatgcagtaaaagggaattgaaagcgttgtttccacattgatcctgccatataaattgggccaagtgtgagtctagcgcgttgcagttcact

SEQ ID NO: 43119 - DNA, 1026 bp, Homo sapiens
tcaaaaacaaaaccactaataaagtaaaatttgaatgtgatcaacagaatccaaagggacaagttgaatcgaagagtcaatgggagaatttgacccatgggtagaagttgttcacctgatccaaactacgctcctggccacaacctaggaatgtgtatgctagttcacattctagtgtgaactggagtaaaacccgggaacttgaaactgttctgtagaattagcttttcctcatgctaagtcaaaagggaataattgttcttttaattagaaaaaaaaattcatttttttcttacaaaatgaaacaaccttttacttatgttcaagccttcattgcttagcatgatcttcagaaaaattcagaagcacagcattatagtagcccttcatttaaagtgatttaattgttgatcccgtttgtttcaactctgtctgaaaatagtttcaaaatatgttagtgtaaactcctcccctggttttggagccacaaagatgttccagcgcttattgtgtgactgaagtttgtttaatgggcacaatgaggatactactacttacctcttagggaggtgtattaggcagttcttgcactgctataaagaaatacctgagactggataatttatgaagagaagaggtttaattggcccagggttctgcaggctttacaggaagcatggtgccggcatctacttggcttctagggaggcctcaggaagcttccaatcatggtggaatgcagagtggggagcaggcgcatttcatggcaaaagcaggagcatggtggtgtggggtggggggcggggcatgtgccatgcactctgaatggccagatcttttgtgaactcagagcttgcttatcaccaaggggatggcctaagccattcacagtcatccgccccatgatccaaacacctcccactaagccccacctccagcactggggatacatttcaacagaagatttggggagggacaaaataccaaaactccatcaggaggactgaaggaaaacaatgtctgtac

SEQ ID NO: 43120 - DNA, 1061 bp, Homo sapiens
tcatgtgctaaatagctgtgacttggtttagattttacaaatatgacagtatcttggattgtatcttcatctcttaatttaaagctggctaactctaatgctgaaacatgcctgctgagctggctgcaaatgagatgcatgaaaaggaacacagttccaggtccactggaaacagggttttccacggaaactcctggtctctgtaggctgacccagcgaagaagctacctgcttgttcagtccgatttctggcctccccgtcaggtgccacctgtggtgcccattgttgccattgccacgcaccgtgcgtcccgtggtgggatctggtgtgtctgggggcagagcactttggaaataagacatttttggatgcacagagtacatgtcagagttctgaggagtccaaagtgctttctttcaagaatctcttacagcctctagcttcatgggtggatttggaaacatgttaacactagggttgatacgggtaattaatgtacatgttttagatctccatctgctgttgacagttcctaaaaatgaatagatgaaaactcttccagaaacatacatgttacttgggtttaattgctgccatcttcattactggcttcctggggagataggtttcatttttattggtgtgtagtaatggaaagttaacccaaagccttggcttctgtttgtgatagagcgggctccctagtggtgcagttaggaatacttcatcagctattagaagcgtacagtgtatgtttaaggatatttcaaaacaattgatcataatctggattaatttgcaggaacacggtagacactagagcattttagatggattaaaatgtggttatcctaatctgagattctcaaaataaatggtgatggagaattctggtccagtaactgtgtagcagtgagtccagatgaaaaaaccctgagcctagtctgttgtgagccacagatgggtgcgcttggcgaggcctcacgtgtgtggcccagtgtcctgctggtcctcctgtctttggggcgatctgcacttccctgtgggcagaagggttgca

SEQ ID NO: 43121 - DNA, 1033 bp, Homo sapiens
attctagtaactgcatgttattttttgtttttgtttttggagacggagtctcgctctgtcgcccaggctggaatgcagtggtgcgatctgggctcaccgcaacctccgcctcccgggttcaagcgattctcctgcctcagcctcgcgagtagctgggactacagacgcgtgccacgcctggctaattttttgtatttttagtagagacgaggtttcactgtgttagccaggatggtcttgatctcctgacctcgtgatccgcccgcctcagcctcccaaagtgctgggattacaggtgtgagccaccgcacccggctgtcactgcatgttaactatactttttaaacccatggaatttgagaacttttctcagtgtagcagtgatgtggtagccagttttgttctcagattagtgttttacttccttaaactacattaataagcctctccagaaagtccatttcaaagacatttatctatagactcagtgaggaagaatgagaagatttcgtagaaatgtcataaccagaagatggtcttccaaaaagtttcgaactgtaaccatgtttcagaaattgtaacttgacaagaacttgattcttcgaagactagatattttttttttctgtctactcataaaccacataggaactctttcgttcttcctgggtgtcatctggaaggaactgaaagaagcaagaaaccgtcatctgtgtttcttgcgggaaagcacattaaagcagcgggaagaaggggagtgggcgcacagcctccctggctgggccctagtgaccgacttctcccgagtcagctttgctcccaaggccaggggggctgccgtcccccagaggctgctgaggagagccctcggagatgcagtgcagaagcctctccctgacgctgctgatttgggggtaggcatggaaatgtagagagtaccgctcagagaagaatctgccctttgcagagcggatctcagcccaccatggaggccctgtgaactcggtggaaggtgggatcatctcggcgtctg

SEQ ID NO: 43122 - DNA, 1056 bp, Homo sapiens
caagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctcttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctcc

SEQ ID NO: 43123 - DNA, 1029 bp, Homo sapiens
catcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaa

SEQ ID NO: 43124 - DNA, 1068 bp, Homo sapiens
ttcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttccactctggttccgtagccttcattttgtctgggcgctcaggtcgggccacagctcatcttacctgtgtgtccgagacggtgcttccgcacctctgtaaggggccggggtcgggggctgccctcacgctccccagattggccgctgggttgcagcccgcggctttca

SEQ ID NO: 43125 - DNA, 1032 bp, Homo sapiens
tgacgaatgctgttacgaacatgagtgtgcacacgtctttttaagagcctgcttccaattcttctgtgtctgtatgggggcgtggaaatgctgggtcgcatggcagttctatgtttaatttttgagaaactgtcatcctcttttccaccgcagccacaacatttgacatccccaccaacagtgctcaagggtttcttccatttcgccacatcttcaccaacatgtgctattttatgtttctttgtttttgtgtgtgtcatagccaccctaatgagtgtgagggggtgtctcattgtgatttggagttacatttccctaatggttagtgaggttgaacatcttctcatatgcttgtgggtcatttgtttatcttctgtggagaaacacctattcaagttcgttgcccataaaagggattttgtaagcaataaaagactactttgtagatctttttgcagataatttaaaaacctatgtgatatggacaatttcttaggataaacagtgtatcagtatcaactgctgtggagatctaaagctcataccagtcaatctctacagaaaaaaataaaatgatcaaaaaactaggcatgcagaaaggcccacatgttacagaggaattctactaaatgtttggagaccagatataacttatgctgcataaattgttccaaagcatttaaaatgagaaaatttccacatccttttaatgaagcaaatatatcgtttatatctatacctggaagagatagcacagaaaagatgaccaaccgataatgtttatgaatattgatgcaaaaaaatcctaaataaaatactggtgaaccaaatactacattaagaaacacaaggccgcgcgcggtggttcacgtctgtaatcccagcactttgagaggctgaggcaggcgcatcacttgaggtcaggagtttgagaccagcttatccaatgtggagaaaccctgtctctgctaaaaaaaaaaaaaaaaaataagaagaaaatttttttaaaaattagccgggtgtggtggcagg

SEQ ID NO: 43126 - DNA, 1032 bp, Homo sapiens
taagcaacctgacctggtttgtacatcaagatttgaacctagattcattgacttattaacacctgcttttctcacagttccattgctctctgccatgcaataaaacaaaaacaattgcatcaccatgcatgacacatagtaaaacatccaggtccctctgttggagattctgccctgacaacccaccccccttccccactgaattcttctgtagtcctgagtgtgcttgagtatgtgcttgagtggagtatgcaaccaagcatacaaatgaatccaagctcactctctgcccctcaagtttcgggaatggtgcatcaaggctctccagaggaataggactaattagggggtggaggtgtagaaagagagggtgggagaaagatgtattatgaggaattggcccacatgattctggaggctgagaagtcctaagatttgcagatggcaagctggagaccaaagtataagttctaattcgaaagccagcaggctcaagatccaagagctgatagttgagtctgaggccaaaggcaagaaaagaccaatgtgtcagctcaagcaggaggagctccccctactcaggggagggtcagtctctctgttctgctgaggacttcagctgattggatcatgcccacccacattggaagggccatctgctttactcaggccaccaattcaaacattaatctcctccagaagcaccctcacagacacacacagaatattgtttgaccagctatctgggcatcccatggcccagtgaagctgacacataacgttaaccatcacaagtagggacccctgtttttattctcttcttaataggcttggggagaggttggcctctcatgcttctaactcatcagctgttacctgtgggagctactacctactcagcatcgctcagggcactgcattacgccttccaggcaattatacaaggtactgcttgagcttaagcaaactgagagaagatttagcacactttctaaaggtaatatcataaatagacattgattccaatcattt

SEQ ID NO: 43127 - DNA, 1050 bp, Homo sapiens
tttgaaattgtttttaggacactttccctccaaaattagcggtttgtttaatttaggttcttgtatgctactgtgcctgcagtaagttaaggccgagcaaaagcgcagtagatagggctctgttggagttgagcagataccagaggtgcacagctgggtctgaagagctacacaggggaaaacgagatggtgaaatgtattattaatagcattaatgggaatagtgacaggcacagcctggtgagtggaatgtttacccatatactaagcactcaataaatctgatgtatttaagcagcaatgatcagtagcagcttccaccagttcttggaagtttaatatttaaatacacatatggcaaagaaaaaacacaggatttggtcagtgtaaattttttgtaatttatttctcttttcaagcagagtctttgtggaagtggtgaaaagtacatcccacctcatgtgaggcaagctgaggagacagtggacttcaagaaaaaggaagaactagaaaggctgaagaaacatgtaaaaggtctacttaacaggtgaccttgtagtgttgttacactgtgtcacttagagaggttgtctgtttcctaaaatgtaggaattatcccagcaattcaaatagaagtgatggggacagtcgattggatcctttctgttcttggcttgatgcaccgagacccatgagacccatacctcgagaaggagaggatacccgactgttggctactttgaatccctttagggtttgagagcagcccaaatgctcacattgttattctgagaagcaggaaggaaaggggcagaggttctttgtccgtctaaggacagtgttggaaggactggcttatgtcccctctctgcagaaacacattcacctggtcttccatcccccttactcattgctcatgtctgcattttgttgttacccactttaagaacagaacatttaaaaaactgattggaaaccatacaggtggggctttgtcagttacacgtgcccatcagctctttggttttgaggatgtgtgtgtgcatgtga

SEQ ID NO: 43128 - DNA, 1050 bp, Homo sapiens
gcacaggttcacagtgagtaaccttccacgtacatatgtgtgtagtgtccccactacccgttcaaacagagcagccttttctagtgttaggaactaaggatttttgtgccacctaagaaataaaacgttagcattttttctaacaacacgtcctaaggctggaccctgcctatgggatatcaggtcagaatattcaggggagtatcctcacgtatgtttctgtagacttaatccagggtatgcctcagtgtggccacatttcatcttgtaaagacagcaattacattgttttgggattccagaatattatctggttatgaataatatatgctgggttattggggcaagataagaatagttaaggggtcaaaagtgtacataaaaatagaatatattgttggtatggataactctttaattttttaaaattgaactgaaaattcctaattggaaacattgttgctctctgtctttacaattctctgcaggttgagtgaacccaacatggcttccatcagtgggcagctggaggaactgtacatggcccacagcagaaaggacatgaatgacaccctgacctccgctctcatgggtgcctgcgtcactgcctcggccatgcccagcagactgatgatggagcatgttctcttagtcagcatccttcaccacacagttggaatcgaggtacagttgtaccttttctccaggctgtcactagtgtctcatggtgattattttaatgataggcttgataagtgcgtaattgtgtgctgtgggtggttcttgtgtcgattcctttttgttgtgaataaatactctattgtctatgtcatgtagttgtaaagagcattcaggaagtacttgattacttgattttgcttaactttgcttttttgttctgtccattcttttttttttttttttttttgagacagggtctcgctctgtcgtctaggctggagtgcagtggcacgatcacagctgcagactcgagtgatcctcccacctcatcctccagagtagctggaactgcaggcgcacaccaccagg

SEQ ID NO: 43129 - DNA, 1031 bp, Homo sapiens
ccggtgagatcagggcagacctttactgaagcttgctttgcagtgcagcaggcaaagccgctgaagcgctatgtgaaattcccaagatcacgtcttgttaaaagtacacagaacttgttttctgggctcctaggcaagcatgctttctactgcaatgctagtcacattcatttcatttttatattactttctctcaattataatcttaacagttatttagagtcttaccaagtggggctctccaaagcttgctttaagatgcacatatttgccggccgggcgcggtggctcactcgtgtaatcccagcactttgggaggccgaggcgggtggatcacgaggtcaggagatcgagaccagcctggccaaaaaggtgaaaccccgtctctactaaaaatacaaaaaaaaattagccaggcatggtggcgggcgcctgaagtcccagctactccggagactgaggcaggagaatggcgtgaacccagcaggcggagtttgcagtgagccgagatcgcgtcactgcactccagcctgggtgacagagcgagactcagtctcaaaaaaaaaaaaaagatgcacggatttgccaaaatgaagtagccttcttgtcactggggcttctgtgctgaaggcggcatggggtgggtggagatgctgcctgagtacaaaacatgctgtaacgcgcacggtctgtgtcacttagatgaacttgtgcctccgagtcttcctgtgtccagtcgttaaggtcaacgagttagttcatgtaataggcataggaaagagctggcccacaataagcgctcattgaaggctcattatttatgtacagaaggagattttcgtgttttaattctgttcttcctctggctggcttttcctaccactgctgatttctttgttgttgctagataatgttctgatccacatttttccatgtctagcagtagttgcatggtggcagctttttgaaaggcctgtggggcattaggaagctgagggctggagagaggggcacaggcctgagcatctgag

SEQ ID NO: 43130 - DNA, 1030 bp, Homo sapiens
ggaactttcaattctgttttgctcagagcttccgtgtcggcatgagcctgtcatgaaaatcaagaaatagtcagacctgcacgtcagggtggtgtctggtgagtgagagtgctcagaggcagagtgaacgcggctcggttttcctcaggggctgtcccagtggtctgggcgtgctcgtgcagaatgtccgtgtgtggggaagcccatgttgggcgagcgtcctctttgcctcaccccgggtgctaaacttgggctgcaccattggatcatccgatgctttcagagaaggccaagtccccatccggaccaaggaaattgggatgacgtaggtcctttgactctctctgacatgcagccaggatggagactggggcagcctccctgttggagtgagtctttcagcccctgtcatctcaagtccaaatcattgctgacccaggctcttccaggcatgtgctcacctgccactgagcctgaggcagctctgttactctctcctgttgggacagctttccaaacacagcgtgtttggggtgatggactctcaaacacaaaacactgagtttaccgctagttttggcatttttccaaacaggctaaccgtcccaattgccagtgacccattccagtattcatgcaccagaaatgtcatggtcaaaaacaaaaagccaccggtgatggaaggacggaatatgaaccaattaaaagcatttcattagctcttctctcttcatcaggtccgcaacgccggctcaggttctgagacgcagcttcgcgtctcctgggacagtgtcttgagtgcggagcagacgggtcgctggtggattgtggggtccgcctggagtggggccccgatgatcgacaacagtcaccatacgcacctgcagaagcagcttgtggggacggtagggacacccatgctcaaggctgccaggcagaggcacccccctgtgtggtgtgtggtcctggctttacctggagcagctctcttactgttcttgaatggtcactgaaatgtacaaggtttatc

SEQ ID NO: 43131 - DNA, 1014 bp, Homo sapiens
ctcgggaggctgaggtacaagaatcacttgaaccggagagatggaggttgtagtgagctgaagtcatgccactgcactccagcctgggtgacagagcaagactgtctcaaaaaaaaaagtaagaaaatgtgaagtcatcgccatagcaggaaccagctctaagggcacacacgattgagtcagtttattgtcagccgggcacagctgtcgacttttgcagcgacgggggaccccctagatggtcttgtctcctctgacattttgccacattgtaggagaacctgaggaccagagaggttgtgacagggctgggcccctagctggtgtctgccgctgcctccacctcctttacgtggctcgcctctaaccagacccttccaggcgggaagatgttcccctgaaaggtatcagccattaaactttggaagtcgagtgatgttccagtcattgctgttctgttttctaggcttggacttaaggatcagcaggagagagaaatcattcacgttctcatggattgctgccttcaagagaaaacttacaatcccttctatgctttcctggctagcaaattctgtgaatatgaaaggagatttcaggtagcttagtgcggaggcaccagttacgtccgctctactattttttctacacaggctacctggctcaacccacctgcaaaggagttccccaagtcaggaggcccctgatatccccgtcacctggtccacgctggctgccaggccaccttcactgggagcggaagtgggagggctagaggggagtgtcaagggtccaccatgtcctcatgtcacctgcttctgccacagatgcaggcagtgtggccaggccagcaggagcacctcgtcggttcacagtgcaccagtctgttctgatgccccttgctgtggccttttccttagaatgttctgttagtatctgctgatttggggggaagaactgcaccagaaggagattcttgtgaagctgtttgggactatgctctataggcaagaa

SEQ ID NO: 43132 - DNA, 1030 bp, Homo sapiens
cttacgccaaatcctgacaactggaataacttagctcatggaggaggcgttgctccccctccgctcccctgccttgcctttcgctcgcccaggcattgcgctcatcctggaacagcacagatgctaccaccgatgagcgggagaggcgtggcaggagcacaccctcaggcgtagagctttagagatgccccccgccctgcccctccgggctgctctcattccgagtttctctgtgtttcgaccatgcttttgtggtctcgccgcgtcctcgggtccgcaagcgcctgtgatggtgtttggctgcgcacctccctgtgggtagcattcccgtcaccatgcgtttagtcccctcctctagctcgctgacattcagctaagattgcagtgggtccacgttggcgcccgtgagtctgttctgggtagcatcctactgtatacgtatgcctcagtttatatacttacttatcctactgatccgtgtttatttctgattttttgatagttttctagggcagagatatatatggattagtcttctagaagtaaattttatatatatatatatatatatatatatatatatatatatatatatagttttaattaggggatgggtacttttgggaatggaggtaatttatggttcagttctagatactgaatttctgattcataaggtgtatgacccgggaattccacttacactgctgagttgttctcaacggtggctgtggccggccacacctctgccagcagtgtgtaggaattcccaaggcccacatccttgccaacaggtgttcatttcttagctctggaaatagcttcttaaatcgggtagagtgggggaaggggggagattaatttttactctaattaactatattacaaatcattgaaaaagttggctaaatcagtgtaactttatttttctccatgtcctgaccattaggtagttgaattcagtgaattggacaaacccagagtccgttttttacgaaaagtattaagtatcctattaatggaaacagaa

SEQ ID NO: 43133 - DNA, 1048 bp, Homo sapiens
attgcctgtaagtctgttcattttaacaacatacagggctgggcacggtggctcacgcctgtaatcccagcactttgggaggttgcgggtggatcacttgaggtcaggagttcgagaccagcctggccaacatggcaaaaccccgtctctatgaaaaatataaaaattagctgggcatggtggcaggcacctgtaatcccagctactcgggaggctgaggcaggagaatcgcttgaacctgggaggcggatgttgcagtgagcagagatcgtgccattgcactccagcctgggaacaagagtgaaactctcaaaagcagaaacaaaaacccaacatatatgggctgttagatagtaattgtaatttcgtataaatagtaaatgagtacatcttgattaaaagctatgaattcagaattgcttttaaatatatagggggttttttgaaatttattacagtgcaattgaaaatacacttaaaatactgcaggatgcttagtgctcagtgttatgtatgaacttgtggactttacaatgcaggttgagaactgctaatgtatagaatgactaaacagctgtctttcagggtatcatttttaaaggtataaggaacaaactttaatgtattgaaatgcataaataaaatttattttttatattttgtttagagtaacagtgaatgtttattttgaaagaccagcttggccgggcacggtggctcacacctataatgccagcactttgggaggccgaggcaggtggatcacctgaggtcaggagttcgagaccagcctggccaacatggcaaaaccctatctttactaaaaatacaaaaattagccaggcatagtggcaggtgcctgtaatcccagctactcgggaggctgaggcaggagaatcacttcaacccagtggggggaggttgcagtgagctgagattgcgccattgcactccagcctgggcacaagaacaagcctctgtctcaaaaaaaaaaaaaagctttggtggtaaactgaggtctatacctttcctttaccttttaaagaag

SEQ ID NO: 43134 - DNA, 1030 bp, Homo sapiens
actctgtctcaaaaaaaaaaaagagtctaacaagatatgtcccctctaatccagcagaacaaatttctacatttagaaacgtaaaaatttattctagtgaactaatatgcataagagaagatgcatgggaaaggtgatttatggcattacttataatactgaaaaatactgaaacagcctacatgtctaaatacaggacatttgttaaataaccgttaatataacaatgcagtgaaatactgtgcagccatttaaaatggtcatgatgcgtattaatgtctgtcattaatttattaacatacttgtatttatgaacatgatttattgttaatggaaataagtagattacaaaacaggattgcagtctgcatttaaattatgtttatctgaacagtaaagatagctagtttcccagtttcttaatttccattgaataaaagaaagatactagttgcttattgctgtgtaatagagcttaaagcaatacgtttttgttaccttggtcagttctgtggggcaggcatctggatctacttctgcgctggcctgttcacaagcctggaagttagtgctggccgttggcaggagagtcagttctcggccgcttgcggggcttcttagggataccgtgtcctcatggcagctggcctcccgctaagctgctgagcagacagagcagggaggaagggcaaagcctgtggtgactttggtcatggtgtatttgtccagcccactctcggggtgaggggagtcgggctccaccccctaaagggcagcagtagcaaagcgtctgtggacataatcctgaagccaccgtagaagggagcttcaggtttagcttagtcgtaaacgctggcgctgcaaaacaaatacgctgtgttttctgcctcagcctattaggagttaaaaattgtggttttccttcttacctcttaccttctgtatcagtagttattggctacataaataacaacacagtgagttaaaaagcaagcattgtcaacatacattttggtgaatgtgagttcac

SEQ ID NO: 43135 - DNA, 1063 bp, Homo sapiens
acgggtggatcacttgaggtcaggagtttgagaccagcctgaccaacatggtgaaaccttgtctctactaaaaatacagaaacagccgagcgtggtggcacatggtaatcccggcggcggaggttgcagtgagccaagatagccccactgcactccagcctgggccagagcgagactctgtctccaaaaaaataaataccatttgcttgcctgatctaattacagacatgtaaatcagaattctttggttaatatcaaaatttaaaaataaaactgtctaatagagcctaatcttcctcttaaactaagcagcgtagcgtctcgtattcttttgttgtgattataaacagtttcttttaccttgaggaatcaagtttcagataggactttttataaataaacttgttagatttttatgtaattccgtagttacttttttttttcttttttttttctgagatggagtctcgttctatcacccaggctggagtgcagtggcatgatttcggctcactgcaacttctgcctcccaggttcaagtgattctcctgcctcaggcctccaagtagctgagactacaggtgcgcgccaccacgcccagctgatttttgtatttttagtagagacggggttccaccatgtaggtcaggctggtctcgaactcctgacctcaggcgatctgccggccttggcctcccaaagtactgggattacaggtgtgagcccctgcagcagccactttcaaatttaactttaaaaatacagttttcattgtatttaatttggggggatgccttctgtttgtgaccagtgatgctgtttttctgtttagtgatgaaagatttccccttaagataaatatatttaggttaaaaagagtctttttggcaagactaacacaatagttgattgtatcatttgtatggtaccaagtagtagttcattatgccgttatgttttattactgagccagttgatgtcttagttggtgtctgcaaaatttctcccctttaaattttctgtctttcccttgttaattgatctatatcttgagagatacttt

SEQ ID NO: 43136 - DNA, 1080 bp, Homo sapiens
ctaatttttgtatttttagtagagacggggtttcactgtgttggccaggctggtctcgaactcctgacctcatgatctgcccgcctcggcctcccaaagtgctgggattacaggcgtgagccaccgtgcccagcctaaatttatttttttgtaatgattcatatatagtgtctccaatcttgaactttttttttttttttgagacaggatcttgctttgtcactcaggctggagagtggtagctcaatcctggctcactgcagccttgacctcctgggcctaagtgatcctcccacctcagccccctgagtagctgggactacgggcacatactgctgcacccaactatttttaaaaagtttttgtagaggcagggtctcaaactcctgtgctcaagtgattctcctgccttggcttcccaaagtgcagggattacaggcatgagccaccttgcccagcctggacctttaattttattttggatgaaatttacaaaaataaaatgtccatacactaaagactggaacagtctttgggggagaagagggttctgtttaagtatttttcatttatttgaagttttccttttattctttcacttccttctacaaaccaagtcattttgttcaaaacttagttttatttatgaaaaaaaattttcatcaaagaaattgatttcttcattgaaatttttattgagataattgtagattcatatgcagctgttagaaatgatacccagagatggccgggcgcggtggttcacgcctgtaatcccagcactttgggaggccgaggcgggtggatcaggaggtcaggagatcgagaccatcctggctaacacagtgaaaccccgtctctactaaaaaaatacaaaaaattagccgggcgtggtggcgggcgcctgtagtcccagctacttgggaggctgaggcaggagaatggcgtgaacccgggaggcggagcttgcagtgagccgagatcacaccactgcactccagcctgggcgacagagagagagactccatctcaaaaaaaaaaaaaaaaaggaaagaaatgatacccagagacccctgtcca

SEQ ID NO: 43137 - DNA, 1135 bp, Homo sapiens
ttttactgtatatatgtatgtgtgtatgtattttttatatatgacagaatgtgtgtgtatgtgtgtttagctttagaaacatttattctggagccggtgtagaaagagatggactaaaagggcagtttccagactggagaaggaacatgggcttttggttgacttacataatgatatggtttccagaagatctagaaagccgtattataaatataatgttcatatttctttttcttctcttttttttaagatactgagtcttgctctgtgacccaggctggagtgcagtggcaagatcatagctcactgtagccttgacctcctgggctcggtgatcttcctgctctagcctcctgtagctgggactacaggtgcatgccaccatgcccagctaatttttaagatttttacatagatagggtcttgctttgctgccgaggctgatttcaaactatggcctcatgcaatcgcctccctcattttcccaaagtgttgggattacaggcgtgaactgcctcgtctggctgatgatgttgatgtttcatgaagcataaggagaaagctcactgttaagacatgtgtcttaactgtttgtgaagaaggtaaaagaaagacactaatgacatttttattgtttatcctacgttatatcttgtgatagtttctttaaatagctttattttgttgattaatcagcaattgtactatcttatgacctgcttttttaggtagagttttttgttttgttattttaacaattcatttaggcccctgacaaatatttattgagaacttactatgtatgtactaggtattgctctgcttgctgggtatacagatagtgaataagacagacaaggttcctgccgtgaaccaggatgctgaggtggtgacaaaacctgtgagggccacagagtaatgtgattacagctggaagggcctatattagagatggtgtttaggggaagggctctctgaggtggttacagtgaaaagagtttaggcaggattttccaaccttggtgctgacatttttgaacagataattctttgttggggggaactgctctgtacattggaggatgtttagcaacacccatggcctctacccactaaatgccagtagcactccgtt

SEQ ID NO: 43138 - DNA, 1035 bp, Homo sapiens
aggtcctactatgctggtgagattgtaaaatggtattgccattttggaaaacagtgtggcaattcctcaatgataactctacttctaggtttatgctcaagagaaatgaaaacctgtatccacaacaaaacttatatatgaatgttcatagcagccttaattcataatagaccaaagtgggagcagcccagatgtccatcagtagatgaatggaggaattcaacgtggtccatccatacaatggaacattactcttacttagccttaaaaaggaatgaagttctcacatatgctgtaacataggtggatcttgaaaacatcatgctaagtgaagaaaaccagacacagcatattgtatgattccattatatgaagtgtccagaataagcacatccataagatagaagtagatgagtgattgccaggggcaagagaagggacggcaggaaacggggggtgactgcgaatggagacggggcttctggttgtggtgatgaaggtattctaagatcagtggtgatggttgcatagctcttaatatattaaatgcatatttagtgggtgttaccttttaaagaatgaattttatggtatgtgaattacatagctgttagtgtttttaaagtctttactagcaaaatgtcattttcactggattctgaccaattgctccctcactcctccttttattgtttaggaagaaaggcgaaggttgaaaaatgcaataattatccagtcatttattcgaggctatagagacagaaaacagcaagtaagtttgttttaaaatgaggagattagtagggcatgggagagcttattttaaatatggtatctttgtacaccttgttaattgaagtcaatgctgacagtagtattcttcccaataaataattttatttgttctaattattgtgaagatttatagataggtgagtttttaggtaatttttaaataataaaatacaaacatgggcctcaccacagttgaaaatcaaaatagaaggaagtcatgagagatcctttttttttttt

SEQ ID NO: 43139 - DNA, 1065 bp, Homo sapiens
attactgtcagaactagtctttattaactgatttttccaaaatacttagctggaccaaaggtaggaataaagaacctattagaagagagaaccaagaggatcctagatgccagtaattcatattttttctaacttatttctttaataaacttttagtttgaaaaacacattgtatacattctttttgtgaagcaggagtttgcaaactttttatgtaaatggcgagatagcaaatattttagggtttgtggtccacatatggtctctattatgtatttttcttgccttttgcttacaactctttaaaaataaaggaatcatgcttcactcaacagccgtacaaaaaacagccctagggctggtttggcctgtgggttgtagtttgcaaaacacctttaacgtaacttttgaatgtatttgtataagcaaataattttgatacatgatatatgtaaatataattattcttttcccaacttttatttttaaaaatttctaataccagaaacacctgaagcccaggagttcgaggctgcagtgagctgtgattgtgctactgaactccagtttgggcagcagagcaagaccatgtttctttttttattatttatttatttttatttttgagataagagtcttgctctgtcacccaggctggaatgcagtggcgtgatctcggctcactgcaaccactgcctcctgggttcaagcagttctcctgcttcagcctctcaagtagctgggaccacaggcacgtgccaccacgcccagctaatttttgtatttttagtagagatggggttttgccatgttggccaggctggtctcaaactcctgacctcaggtcatccgcctgccttggcctcccaaagtgctgggattacaggcgtgagccaccgtgcccagccaaacccatgtttctttaacaacaagaaaacactcctcctcatctttcctctttaatctcagtaaggtctcatgtattttttaaaatacagtgtgtgacagatgacttttaatggtctgcttataggtagagagcaccctgtaagcagcccgtttttc

SEQ ID NO: 43140 - DNA, 1035 bp, Homo sapiens
ttcaagtgattctcctgcctcagcctcctgagtagctgggactacaggtgcacgccaccacacccagctaatttttgtatttttagtagagacggggtttcactatgttggccaggatggtctcaatctcttgacctcgtgatccacccgcctcggcttcccacagtgctgggattacaggcttgagcccctgtgcccagcccaaactgtttttcttactctctcactcaacactgaaaaattctgtgagcagaaatgtggggttttttttcccacacaccaagcaattcttcagtggacaccaactaggtattctacaattcagttcaattctgatgccgtccacccggagataatgtcagatcccatcatctgagggcttagtcctgcaagactacacccacttcagaggccgattacaagtagtaggttgtcacctatacttctgaccaacctgcaaaaatgggggttcctcagcccctccttgggattggtaattgactaagacagttcacagaactcgggaagtcgaggtgtgcgggaatggggagcttccatgccttctccaggcactccacactctcggcacctccctgtgttgagctcattgtgtcttcctgttgagttttatggtgcttcttctccagtgtccctcccacagacagccccttggaagttggtgcgtggggctgaaagttccaaccctctgatcacttggtttttctggtgaaaagccccattctgagtcccctagatggcctcaccataagtcacctcaagtatgatcacaaagggctggctatgaataacaagagactctttatctttcaagaaattacaagagttgtaggtgctttctgacatgaacggggacaaaatctaaatatgtttcctattataacacagttagaattttaaaaataagatctggtcagaaatgcctctctgcgtgtgaggaaaaatggcgtcttcgttttccattttaaaaaataatgtttaactaaaatacgttttaactgattgttttgcaaaggg

SEQ ID NO: 43141 - DNA, 1115 bp, Homo sapiens
aggcggaggttgcagtgagccgagattgtgccactcagtccagtctgggtgacagagcaagactgtctcaaaaaaaaaaaaaatttatgtaatactctcacttattttgcttaaactgtgatctcaaattaaaatgaaaatgccattagatgatgatagtttcactatgtatggttgtcttagtgcagcttgatgtaaaaaaaaaaagtaggaaatgaagtttttttgaaatgtaaatactgaagctactgttatatcataggcaaaaaccgggtattcagagtttactgtgttaggcaaaatggatgcctactgttgactggatccctagaggatttcacactaagtgtactgtgatgtagataattttgagatgatgcctagctttctttgcccgaagaaaaatgtgatttcgtatatgtttgtagtgtagaggacgttccagttgagcacatttatggagactggttgttctggtatgttctaggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcaagtgtccgtgggcgtctgtgccagggggtgccagccagagaacataccttcctccctgggaattgctctcctcttaagttttgtctgctcttttctggtagagattgatgtaggatattctactgtccaagcgtttcataaaaaataatttgtgtttttcttttctaaaccaacaaatactgagaccttttcctggcccgtgaggctctcaagtaccctatctgtaatattttctgtagtaccttatgaatgtgagtttattcacccatctgaaaggctggactcatacctgcattagtgaaacactatgttacatatctttttaggcttttttcatagtactcgtgttttatggggtttttttttttcttcttcttcttcagacagcatctcactctgttgcccagagtgcagtggtgtgatcatagctcactgca

SEQ ID NO: 43142 - DNA, 1047 bp, Homo sapiens
tctcctgaccttgtgatccgcctgcctcggcctcccaaagtgctgggattacagacatgagccaccacacccagccttcatagtacccttttaattagattgtccttgacaatttatccctaaaagtaaatttttgtttttcagcctttgaaataaacttttggttcagacaaaacaaaacctgcaagttaaaaatatggcctgtttgtgcttaaataattgtgacaataatcttgaactgttttctctccctccaatttgagtgatatgttagtggtttcttgagaatttaacagaaaagtattcaattggatacagagtaaaatatatgtagtagttctgctaggacccaagggactgatgttgcataggcaaaagctgtcagtaagtaagcaggtctgacgttaattcacgttaccctacagaattctctttgtttttataaaatgccatcccatcatatgaaaagagtgatttctgttggctaagaaagcattctttgaaatgaactgtaagtaaggaacccatcggttgaaatggccttgtaaacactaatgtggccaactaatgaggtgctgtcttcactcactggtgtttattaccatcggaggaagtagatgtcagtgaaactgtggctcctagattaggtccttagctctttgccggctaattgcatgagagcaggatgtgagatctgaggatcgcagcagctgaaccaggacacttgcttttattgtcgcacaacccattgctgtggatggtaattgctggatttcaatgcatcactgccctgggctgaggtttactagagaaccgcttccaaaaggtgtttaatgggtgaaggaactttctgtgtaggcttgattttatgagtacagcacctatttcctctaagaaactactctaggaattttatttatggcttaaacatattaggttctagtatttagaaagagcaagtaggcttactctaactgttacagattttaactgctttcaattttgatttttttaaaaaagtatttgaaagatgattagtatattccc

SEQ ID NO: 43143 - DNA, 1157 bp, Homo sapiens
ttataatcaatagaattaataagctattgattcatgttaaaaattgcattctctttcatgaagttcaaataacattgatgagcttttaaacatttcagcacatagtgatcttaaaattaaatgtattttgaaatcctatctagattataaactaatttccactagctgttgttagacacatcaaataaataaaatagacttgccttcgtcagcttcagcaatatcattcatagttctgaatcttctaagaattcttagaacatttgtgaatgataattgtttcccgggaaatatgagtacacttggaagaagcatattccaccaaagtgattctaaatccctaccacgtttttaaagttttcttttaagcttgttaagaaatagtaagagaaggggcttccttttcgatccgccatctgcggtggagccgccaccaaaatgcagatttccataaaaacccttacggggaagaccatcaccctcaaggttgaacccttggatatgatagaaaatgtaaaggccaagatccaggataaggaaggaattcctcctgatcagcaaagactgatctttgctggcaagcaactggaagatggatgtactgtctgactacaacattcaaaaggagcttactcttcatcttgtgttgagacttcgtggtggtgctaagaaaaggaaggagtcttaccccactcccaagaagaataagcgcaagagaaagaaggggaagctggctgtcctgaagtattagaaggtggatgagaatgacaaaatgagctgccttcgtcgagagtgcccttctgatgaatgtggtgctggagtgtttatggcaagtcactttgacagacattattgtggcaaatgttgtctgactactgcttcaacaaaccagaagacaagtaactgcgtatgagttaataaaagacatgaacttaaaaaaaaaaaaaagaagggattatcaaagaagacatttgaggtagtgaatgccactttcccccattttaatttaaactgtagcatgagggaaagtatgttttttgaatctgtaaatcttttaattaaagaaaatcagttgccagtaagaagggctggctgtttaaattggttctggtgtcaatgctggaatgctagcgcgcctgagtgtctaaggcttacct

SEQ ID NO: 43144 - DNA, 1048 bp, Homo sapiens
aatttcagaagaacaaattattgcctttgtacttgtgtgctataagagttcgacagatcattgggtgtctcgctgtttcttttacctgtggcacctggacttagaggggaattctcagaggatgccatgctgtggtggccttgactccttgtgtgggagccagtgtcttccattgtgttctctttcataactcaagagagtccccgtggaaaactggcctgaatttatgacccggcttactgattaactcataggattgttacagctaaataaagcttaatgagtaatttttaatctatcccactatgtgggagaagaatatcacttctttacattttagaagtagagccccagactaaataaccttcagaaatttgtcttttttttttttttttggtgaaaacattctttattagtaagcagacatttgaaactttttgattacatgcatcatgcaaaatgactgacctcacacatggttgtctgttcattgtgacatcttttttgagatgattacaaatttaagatgactgcagtagtaaaaataattcatgaaaatgactctcaatgaagcaaaacactacatagcacacatgaaatactgttcatccctcctggatgtttaattctctcctaacgtaaatctctattttggaagactattatttacaaaaatggcagttgtttttgtatgtgcatctataggcactgaactgatatgaacaaaatttcaaataattttacaaggtttggttgttttttcctgttttgttaatccaaaacaggacaatgccctttgatttacaatgttcagttcttttaagaaatcattttctttggaagatgattttgacccatgaaaaagttgttttacccctggtaatctttttgaaatggggctggctgttatacattatacaggttgttttcagttaagtgaaaaggagttgggcttgtcttgagaagaattcctctaaattatggcactgagaaaacttctctgcagtggtgggctcaccacttccatcctgtggtagttctggtagca

SEQ ID NO: 43145 - DNA, 2400 bp, Homo sapiens
aatcaaactagacacttttcagtatttactacagacaaattttcaacttatttgatcaaaagatttcttaatggctgttagtcaatgctgcatcaagaaactttagtgcaaattttaccaaatgcatttatcaaaaaggggttttcatttttttctgcaaacaaaacattaacactaagtatgtaacaaactgatttgcctacaaatccaaaaactatcaacataagccagtccttcaactaaaaactcaaacatacttatcttaaggtctattcctaatccagatttgtctatattcaggttggaagacagaataacaataaaaccaaaatttatctgtaaaaataataaaaataatttgtttttttttttttttaatgctggaggtattgtccttattaatacgacacatcatctgttcccacatggtactgcatggataggaacaatattattttagttgatggagtaacacagtgttaagaatatctgcttctagcagtgtcaggctttcatctgttagctctttattcggaaatgaagtcacaagaataaagtcaagagctgcaaattcaggacaagactgtacaataaagttccggacatccaggatcctgtgtgtactattgaatctttgtatcaaacgactcccatctgctaacctgatttgaatttttgttgttggcactgaatcatcaataagaacaaccgcgttaagtattgatttatcctcctcttctggagaggaaggtgtactgactatttcaggtgtaagccttccaagtttttgcccttctccactaaaagccttgaacctcaatctaggttttatgtattcttgatcctgatggtcctccatatcccaattcacttggccaccatgaacaaggcactgaagctccagggggatctctcctcttttaacaaactccagaaattgagcatttgttggttcattgtaaggtctcaattctccatcatctaaactgaaaccattgctccacagtttaagcaaaatctgaacatcttgtagctgattttctccatgcatatattcagaccgcttacaaaaggaattacccaatctgtatcctccacctgtaaatgacattgaggtggtgtccgtgggctcttgaagactgcagctttaggtctgtcagacttggaagatttgcgcttcacttcatcttcatacagttcttccaaggccagtttatttcttgatatgtcatccctttggctgttttcaagtttctttgcaggttcttcacattaagttctgcaaatcctgtgcgctcggaggccacagcctggaagatctcctctcctgctcaccgagctcagggccgccgccctccgccatcttccgctggctgtatttgtctttttttttttatttttttcgacagggagtcttgttctgtcacccaggctgaagtgcagtggcgccatctcggctcactgcaacctccacctccaaggttcaagcgattctcctgcctcagcctcctgagcagctgggattacaggcatgcgccaccacacctagcaaatttttgtatttttagtagagacggggtttcaccatgttgaccaggctggtctcgaacccctgacctcaggtggttacccaccttggcctcccaaagtgctaggattacaggcgtgagcacctggcccagaaatttatttttaaaagtttaatagtttgttttattattgcttattgagtgatttagtaaatattctgtcagggttagcttgaaatacaaattttaaaatgtgtattttaaatgtgtatttctgaaaatggtatttcagaaatatgtatacattcacatggaaagatgttaattataatcttagtgacaaactcttagaacctgtaggaagaactcatttttgtttctatgtctacacacaagggtctggatggatttatagcagggtattaactgatgatttctgggtagataagatgccatgtggctaacattcttttgccttgttttgttttaataacattttttaaaaactcaatttctcaactgaagagaaaataagcaaataataccttttcaaattattttgaaagttcgtatttttcgtagcttttttcttactcttttttccgtatgactgttgcgtattcttagcaaataaaactccacaaaggcaagaaaaaacgttaacactcttatcaggcatatggtaaggattttaaatatctcagagatagggtatctattatcattttctaatacagcttcccttttcaacagtatagtctttttcagagtgaattttttttatttttattttattttattttatttttttgagtctgagtcttgttctgtcacccaggctggagtgtaatggtgtgatctcggctcactg

SEQ ID NO: 43146 - DNA, 1047 bp, Homo sapiens
agcttagcctagcctacctaaaacgtgctcaaaatatgtgcattagcctacagctaggcaaaatcatcaaacactaggccaattttataataaagtgttgaatgtccatgtaatttattgaatattgtactgaaagcgtaaaaacagaatggtttatggatactcgaagtatggtttctactgaatgggaatcacctttgaccatcttgaagttgcaaaatcctaaactgaaccattgtaagtcaggcaccatctgtaaatgtctcatatttcctactgggaataaagtttaaaatgaaataactgattttctgaaactggcactcaatttaagtcaaaaatagtttaacagtaaggcttgcattgctaggacttacagctttagtgggcagaagtatcatcaggggagcgtgttaaaatgcatattctcctgagacgagattgcgccattgcactccagcctgggtaacaagagggaaactttgtttcaaaaaaaaaaaaaaaaaaaatttcagcttctctgttcctgccctaagacttgggttagaaaccctggagactgcaacctcacaagcttatcaggtaatcgaggtacagatggtttgggggccaaccgagaagcactattcttcaccccagtctagcagaccacatttaaacaatctccagatggatagtgaattttgacacatcagacattttgcaaataacatctttattcatttacctcattttcagtacttgctattgaaatcagccagtttagtttccttcttcttgaagatgagggaacccatagccagctggtactgttttccattaggcatcccttgactacaacataacatagagatgctttgcccagatgtcttcagtgtgggcagtaggtgctggtgttggctgtttgataaataatctcaaaacagtctacagtagtattctgaaaacctgttaaagcaagaatccgttcttaaaagctctttgcaagggtgggggacattggacgaggaggaggagtggttcccacaggcacgcaatttgaaaacc

SEQ ID NO: 43147 - DNA, 1032 bp, Homo sapiens
gtttatgcatttatcaaatttataaactcctcttgaagtgtaatttagagctataattactttagcttgatgagataggaaatcctgttttgagatgtctgtgtgcatccaccaaacttaacaggagtttcctcctgtgatagggaaacaggaggaagtggcagggaatgaggaggaaggttcccatgccctcattatccatatgtctggagagagagagagagagagagagagagccatactatgagtgatttttttacttccttagtggttaagttgtattttttcagttccaaaaagctatttttaaaaagtaataaagcaacagcagtgccctgttaatataatcctaacatgcgaccatttgactatgttacaaccaagagatccaaagcttgtagcgctgtgccttatccttttctgttattgaagattttgattgattttgtttttgttttttgactactaaagtggatgctatatgcagtaattttatagtgttttaaatatgtgctgaagaatactgtttttcaaaatactccagtttttaacccgtttgtgccagaggttgcgaattttttgtgtgaaaaatcaggccttggcaatgaccttgagcagtagaatataaatcccacaagcttagcgttccagtaatggaacactaggcataaatgggttaacaagtggtaactaagggctatataaaatttggttaacccttgacagcagcagtgcataccagatacttcatgactttcataggttagagtgttttattctcagttatttgaacactcacagtattcatcccacccatagtgacacagctctatgctaagggatcataaatgaattcacacagggtgcctgttcctgcagtatcaccacgtagtgaaggagacatgcattcagctaatgacagtgggaaacagcaaaccacagaggccggtcctgtggaagcacacaggagagaagcaccagctgctgcgtcatctggcacttgactcacttgaggaaaacggttgttttcca

SEQ ID NO: 43148 - DNA, 1762 bp, Homo sapiens
ggactagtcatgccatatttagcaaataaaaagacaggtcacctagttaaaattgaattacggataaatcacaattactttaaaaaatgtagttatgtcccatgcaatattgtggacatactttaaagaaagcaatattttggacatacttctactaaaaatgtattatttgatataaataaatataaacatattatttgatgtttattaaaccatccattaccacagtgccgtctatcttgatatcccatccttaacataactcccttggctggactcacttttttaccttctcctttcctcctcctttctccccatctccctccaccgcctttttttgattgaccaaggatccatggtactggcatgttatattggtaacatgtgattacttcttttttcatatttaggataggaaatatgaaagaggatacactatattgaaatttttttaacatttaattgtataataatttagtagaagaatgtaaatgagaacttaattgtctcatataatttgataatgtttgtaatctgtagaaaatatatgttcttatgaacagagattgaatagaaatagatatctaggagttaggcagacctgatctttccgttgcctgacctggagcaagttaccccctcaataaagctaagtttccttggggatgataaattcatggggaccccaggattccatgggatgatgcaattaaatatgtaaatatgtcagaaaggatgacctttgttaacggttggggtgattatgaaagggctaatttcagcatggtaactattaaatctggatttatttaaagtatcaatttaattggtcacaaaaatggaaagaccagacacgaacatcttcatacaaaaagattgtacttctgttccttttagaagggtgtgtgctctgtgtggactacctgaatttatcccatacaaggatagcacatgtaattagcatagctcattgagatttcatctttgcttttgaagagtaaaatgaatgactttcaagaattagtgtattaggtcaatgacagtactttgtttcagccaaacagttaaccagacagaactaataatgaggctctccccaggctgcctaggctgcataagaaaccattaattgtaagatgttgtatgtgcagctaagcccctgagcaacaccatagagtcaagggtcaaggaatagctgactccagtttaccctgattagttcactaaacatttccactcgttgaagaaggacggtatttccatagcgttgtgataggttttaaaatgccacaagagaatcgccacttctaaattggcacgaaatacccaccacttataaaggtgcatctttgatcttgagtgggtttttactatgcagttttatctgcatgaccaaattgctcgaataacactttttctctgtccacgggtaggtcattcaaggggtgtccacattgtagtggcctgagatatcaacccaagtacccttccccttttttcttgggcacacagaatttctggtatccctgcatgccttggatttgcatttcataaaataagcatttgtatttcattgtatgtaaatgctaaattatggaattttaaagggaaatctcaacaattgattgtgtgatctttataatgtataatatatccagtatagattagatatattataaatttatatattatatatactagatacatagtatatattatacaatttataactataatataaattatataaattagtatatat

SEQ ID NO: 43149 - DNA, 1119 bp, Homo sapiens
gctgaggcaggtggcttgcttaagctcaggagttcaagaccagtctgggcaagatagcaaaaccccatctctacaaaaagtacaaaaattaaccaggcgtgatggtatacacctgtagtcccagctactcaggaggctgaggtgggaggatcgcttgaaaccagaaggtggaggtcgcagtgggctgaggtcgcaccactgcattccagcctgggtgacagagtgagaccgtgtatcaaaaaataaaaaattgtaaggaccaaaaataagggatgagaggaactgacagatgaaaaataacttgagaaaatatactgtgtctgttttatttgaatactgcctcaaccaaattgaaaaaaaaactagaaagtgaatttttgataataataacttaatttttaaagtgatctattttgcttcataaagcaattatattattttactatgtttagatattatgcaccatcaaataaaacaattagagatttctttggggcatattagaaaacatagttaactgtaaaagtatgaaaggacagctagcatgagagaggacctgaaaaggtaaagcaaaaggggacatgaaggtatgaggtcagagagagggcccagcccacggtagagaaatgtccagcaccaattctgttcaagtgtgatcaggtcaaagtgtgtgctagagcacaggggagttctgaaccaggattgcccccgacaggtcactcagctctatgtgccagcatccagacatgtgtggaggttccggcggatggggaggataggcccgctgcagtccaccctggacggtgagttctctaggacacagggttactgaggtatgaattacatgctgtcaaattcactcctttaatctacagatctgttatttttcataaacttatacagccatgtcactcccagcaggagctaccatgtagaaaagtttcatcacccacaaaattgcctctagctccattgcggccacctcttcagcagccacccatttctgttttgtcctgtcactttgccttttgcaaaaggcctccaaagggaaccatgctgtgtagtctgctcctggctccttttggtcagcacgctgcatttgagggtgctgtgtgggtt

SEQ ID NO: 43150 - DNA, 1025 bp, Homo sapiens
catgagccaatgtgcctggccggatttttaaaatttattttaaactgggcaaaggagcagctttagaaatatttaaatatgatatacattatatattatctatacatttattgataaaaatcaagatttgataccttgactattagcatttatttcagaatttatgaagatacaaaagataagatttagcagtttattctttggtaggttgtaagaggtcttttgtttctaataaccttacagctttccttgtttgttagatctttcagaggttgatttatgcagataagcaagaagttcaaggagatggtccatttctggatggaattaatgtcacaataagaagaaattacatttatgaagatgcttatgacaaactttctccagaaaatggtatatataattctttctgtgtattatttggcaggtggaggctagggaattgttttagaaaatggtggttctttaaaaattagtgtccatcatcttgttccataatgacttaaaaactgaaatgtgaggctgggcatggcagctcacacctataatcccagcactttgggaggctgaggtgagaggattgcttgtgctcaggagttagaggccagcctgggcaacatactgagaccctgcctcaacaacaaaaaaagtgagcttatctggatgtgttagcgtgcccctgttgtccctgctctgcaaaaggctgaggcgggaggatggcttgagcctgggaagtgaaggctgcagtcgaactctgattgtgctactgctcaggccttggcagtagagccagacccagtctccaaaaaaaagtgtagcaagtcagatttgggagacatgttatcaagtaatatttctaaaattgacagttactacaacagaagcctttaaaaaatattaattatttttaaagggcaagaaagtaaccagttccccacctcctgttgtctgcccctaaaatttagtttgcaagctgttgttctaaaaatctcgatggtagccatttatattctgcgtttttgtat

SEQ ID NO: 43151 - DNA, 1058 bp, Homo sapiens
gaggaccaattccctgagagtttgtgggggcggaggttgcagtgagccgagatcgtgccactgcactccagcctgggtgacggagcaagactctgtctcaaaaaataatgataatatcattgctgttttgagtcctatgttaaaatgtccctaagatcctcacaccccttccttaagccttcctgtaaggctagttgatgttattgcttgcttgtaacatctttcctcctcaccctcccatttttttttaacagagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggtaaagtaaccttcatataaaaatagacctcggaccaaaagatgttgacattttatgtttatgtgtggttgttatccaggtttaccataaaatactgtttgttttaaatttggatgctaaatgttgcaaaagcactgcacgaaacaaatttgtatggttgtaagtaggtgctatggtttgaatgtcccctccaaactcatgttgaaacttgatccccagtgtgccagtattcagaggtggaatctttaagaggtgattagatcatgtgagctcggccgtcatgaatggatgagtggtttattgtgggaagggccctggtgactttttacaggagggagcccctagctttgtgatgccctgtgccgcctccggactctgcagagtccccaccaatgagaagacctcaccaggggctgcctctggaccatgggctcctggccttccagctataagaaatggatttcagtttttattaattactcagtttcaggtcttctgttataagcagtcaaaacggactaagacagtaagttactgcctagtgactattagttta

SEQ ID NO: 43152 - DNA, 1045 bp, Homo sapiens
atcgttgtcagcacttacttagtgttgtctttttcattacagccattctagtgggtgggaattggtatctcattgtggttttaatttccctggtgactaataatgttgaccatcttttcatgtgcttcatgacttctgttgagaaatgtctattcaagtccattgcctatttttttattggattgtcttttattattaagtccctgcaatgcaatgaattatgaaatttatattctctgaggaagctgaaacattgtcagataaatgatttgcaagtattttcttctctggattgtctcttcactttcatgatgatttcctttgaagaacgaacatttttaattttgaagtctaacgtgtttttttcttttattgcttgtttttgatgtcttatccattccctgacctaaaatcacaaagatttacacctgtatgttcttctgacggtgttgtagttttagctcttacattttggtctttgatcctttttgagttaatttttgtagattgtatgagttaggcatcctcatattcttggcacccttgttgaaaattagttgaccgtacacgtaacactctgggtctgcccttatgcagtatggtcttgattactgtagctttgcagtatggggtgtgtggatttattaatagcagatgggagtagaaccgcagccttgttaagcagggataatgggaaggaatcagtctatcctggatatagaataattcccctttatttgtgtctctttgaaatgcattgtcgtagccccagttatttctttgttcagactcccagtgattttaagtgctcttcaggtttgagaaagggctccaacctgacttcactaccgtaacggtatgtgttatatcatcatcttcaggctcaccgtatttcaggtggcagatttcaggtgttgatttgatgttgatttgtgagttggctttggtggcagttttcagatagcatctctctctttgttgatggtcacacagcctacttctcagtttcagcttcccctggaggatgtacatttcataattcatt

SEQ ID NO: 43153 - DNA, 1034 bp, Homo sapiens
attgtgatatttattgggtcataatgtatttaaattttctttaatgcatatgttagtgattgtttactgtgataaagtgcaaagaggtcttcaagagtgatcctgcagaggaagaattacctcatgtcactggtcacttctcaattaaaagttccattagcaaatgattcttgcttctggtgtgggtcatgattgcattttgtcgcctgtaagtcaggctgcagacagggaataaataaacagcccaaggatgtggtaatgtcatcttgaacttttttttacagatagaagcacctaggtccatttaagccaattaagttcagaatatttattgaggttaatcctttatcatatttgaattctatttgaaaatggctttttttcttgctttaggatattgatttaattgggatggcatgcctataaatcagattatttgatatgatcttggttatatatttgaaaatttcaattagattgtataactttggcgtggtttataattttttatcgcggtagaattcagtgtgcatttaatgtattctgtagtgtaatattggcacttaacagtttatcttgagattttcaaaagttggaaagtttctttttctccatcattagcatccttttgtaaaatgctcactgaatttgctgaggctttaaacatctaaattgaggtgaatactagtcattttggttgccttagtccttaaaggggcagagcttctcttgtataataccttgttttgaaccctaaactcttttttttttctctttttttgagatggagtctcactctgttgcccaggctggagtgcagtggtgcgatcttggctcactgcaacctccacctcccgggttcaagcgattctcctgcctcagcctcccgagtagctgggattacaggtatccaccaccatgcccggctaatttttgtatttttagtagagacggggtttcatcatgttggccaagctggtctcgaaatcctgacctcaggtgatctgcccatctcagccttccaaagtgctggc

SEQ ID NO: 43154 - DNA, 1056 bp, Homo sapiens
ggagatgtattcctgaattcagttgattgctgcacctaaataagatttctcggctgggtgcagtggctcatgcctgtaatcccaacactttgggaggccgaggtgggcagatcaccaggtcaggagatcgagaccatcctggctaacacggtgaaaccccatctctactaaaaatacaaaaaattagccgggcgtggtggcgggcgcctgtagtcccagctactcaggaggctgaggcaggagaatggcgtgaacccgggaggcggagcttgcagtgagccgagattgcgccactgcactccagcctgggcgacagagcgagactccgtctcaaaaaaaaagaaaagatttctcactgtaggtttagcaccacaaggtaaattctttctgcccttggattaagtaggtcttgcttactattgagttattccttcctttttatttttctcatcacgcccaagcaatagttaaacatctgaaattcatgagaagaatggatcagtatggtattgagaccattctgttttttctgggccatgttaatttgtcaccatgaagattagaagcacacactcttgctggccccacttaaagtctgctgtttatctttggctcttatttgtgcaataaagacaacaaataatctaaaaaatagtgttgggtgcagtagctcatacctgtagtcccagcactttgggaggccgaggtgggaagaacacttaagcccaggagttcaagaccatcctaggcatacatagggagacctggtctctaccactaaaaaaaaaaaaaaagtagccaggcatggtggtgtgtgtctgtagtcccagctacttgggaggctgaggtgggaggattgcttgagcctgaaatgtagaggctgcagtgagcagtgatggcaccaccacactccagcctgggtgacagagaccctgtctcaaaataataataaaatagggcccatgtaaatccttttaaacatttaaatattcaatttaatttagatttagatttagcaaatgtaactttatgaaataaaagccaaatgaaggtata

SEQ ID NO: 43155 - DNA, 1022 bp, Homo sapiens
gagatcgtgccactgcacactccagcccgggcaacagagggagactccgtctcaaaaaaaaaaaaaaaaaaaaaacagtgttcttcacaatgtctgtcattttctgaaacaaaaagccagtggtactctagatgtttgcttttgggaaaacctcaacagctattttctcattttctccagtcgtatcagtggacgagtccttaaaatgtgaatctcaaggggtgtctgagcatgccctgttggagtgtataagttctggaatacttatttaaggatgcgcattttatagactacacatacgaagtagattattactaaatacggtaactggttggaagctgtgactaagcaaaggactcactccccacaggagcagtggctcacagttgaaacgtttctcctttgctggaagcttgcagaagcacagtcccggctctctggaagctacttactcccatgttattaattcacacagatcgctctaatatttacagtgcatgatatggttgggtgatggcctctaggttggaagggtgacttctgagttgactgtctcatggatgaatgactaccccataaagttttgttttgattttggtattccctgggtagcaccatagcacttgaatcttaaaacagtaggataaagagggtctgggtctatcacagcatctcctgcagcacagctcatagtagtcatttgcaaggtatggttagtccagccttcaccttccctctctctgtccttcctgccgtccctcattctcgggcaaaaattccagtgctgcacctccagacagtaggaaggcccgtgactgcctctgttgagagggtttctttctctaaaactgttctccacctgttctccacacccccgggggtaattagactacctctgtttgacctgggaaaataggatcactgtaaatacacatctctctgaagactggatattttctctttttttgagacggagtttttgctcttgttgcccagactggagtgcagtggcacaatctcgg

SEQ ID NO: 43156 - DNA, 1134 bp, Homo sapiens
ccagctactcgggaggctgaagcacaagaatctcttgaacccagatggtggaggttgcactgagccaagattgctccactgcactccagtgtgggtgacagagtgagaccttgtctcaaaaaaaaaaaaagttatagaaatgtcagttttctctgatcaggcaaggtaattgggagccttggaagttcctttaactgataacttcactggtcctttgtcttccaaatcatacaagtacatcatcatttattacctgcctctaatccatttaaaggaaggggtggtattttatacattgaaatataatagctagcctcctgaggcttggttaacagatggactgtcagctgagtacaagcaaaggaattaagataatgaacacaatctttaatcagaatgaagacaatggaattgaaagcccattcttaggcttgatggttccaaaccttaggaagtgaattattgagaataattgtatcatcctttaaaatgtgaaacgttaaaagaagcagatctggtaagttgaacgttcaagttcaatttgaacattctgtataaaatgagaaccagcaaacgagtctcctataaccatcagctgtaggatgacttaagtcaggctctctagcacatttgtgaaacaatctttctgtaaatggtaagagactgggacatcagtgccattgcccagaggcagcagtcttgtctgttactctgggaatattaaagctaccaggaaaactgaaggctgtgaaaagaaaagaatggaaaggtagggaagttgaaatgtctttgttcatttattttgggcttattttatattttcattgtccacagtataggttgccctcatctaaccccaggaatgcagttggggtgtttttgttgtttttttgttttgttttagaaatacaggtgggggtcttgctttatctcaaactcctgggcttaagggatcctcttgccttggcctcccacagtgctgggattagaggcgtgagccactatacccggcctgtttttttggttttcttaataaatactttttaaaaatttttttatttaaaatacactctttataaattatgattacatgtttatattgtattttgctcgtgtactgttttgtatttatga

SEQ ID NO: 43157 - DNA, 1611 bp, Homo sapiens
agaagctgagattatgggtgcgcgccacaacatccagcgaatttttgtacatttggtagagacagggtttcaccatgttggccaggctgctctcgaactcccgacctcaagtgatccgccagcccgggcctcccaaagtgctgggattacaggtgtgagccactgtgcctggccctgctttgaccctccttaagttgctctccccttctcgtactttgcccatcgcctccacataattggcggtgggtggggtgggggcggggggaggcagagaattccgcttttgcatttacaatcggtccttcatatctgtgggttctgtccacatccatggcttcaaccaattgcagattttaaatatttgaggaaaaagcaatggttgtgtctgcactgaatgtgtgctaagcaatatagtgtcacagccatttacacagcctcggcatgagatgggattgtaccagtgctctagagatcatggaagtgcacagcacgtacacaggtgatacacacatgccacgccgttttagagaagggacttgaggatccatggactttagtttccgtgggtgtctggaccaatccctgtgggtcctgaagggtgggtgtgctttgcatttcataaagcatgtgttcattttgccataggaggctattctgcagaccatcctgttattaaggtcttctggagagttgtggaagggttcactgatgaagaaaagcgcaaactgctgaagtttgtaacaagctgctctcgaccccctctcttggggtttaaggtacacaactttcatgacatttgctttaaagaccacttcataataagaaaggcagcagaacattcagtagggttaaatgaagtccttttacatacacttttgtttttatcttcagctagatttttaattaagtactggttatgatgtatatattttggtgctagttttatttggggttgctttttttgtttgttcacaataacctagtcatatgatagttacacattgtggttatgattgcctgtgaacaaaccgtacatttggagggactatttgcaatattaataatgtctcataaatctgtaacacatcttgggctttttgctactgaactgaagcaggtacaacgtagagatgttgatggagtgtatatgctactgagccttattttaccacttctggaaattaatgttgatcttacgtaatttggcttatttttagcaattaaaattgcctcaggcagatggatcatttgaagtcaggagttcgagaccagcctggtcaacatgatgaaaccctgtctttgctaaaaatacagaaaaatgagccaggcatggtgccctgtgcctgtaatcccagttacttgggaggctgaggcacgagaattgcttgaacccaggaggtggaggttgcagtgagccgagatcgcgccactgcactgcactccagcctgggtgacagagtgagaccctgtctccaaaaaaaaaaaaaaaaaaaaattgcctcaggaacgtctaatcataattcctgtattcactgtaaattaaaataaagccatattaacatttaaaaatgcacacagtggtatatatattatagaataatatataattag

SEQ ID NO: 43158 - DNA, 1100 bp, Homo sapiens
agaatctgatccaggaccacacgttgcatttaattggcgtgctctttagtttcctttcttctgtacccccattttcaaggggtgcaggcaagttatcttgagaatgttcgtcaatgtgatgtcgcagccccaccgttgggagtgtacagatggcaacatattttcacacagtgtgtttatgaatgttcagagcaagccttcataatggccaaaaacgaaataattcacagtacatgaactgctagtaaatactatagattaagagatatttagaatttaaaaggaataaatgatatctactacactgtgtatgaacattgaaaacactgtgctaagtgaacgaagcaagacacaagactacgtattattatatgtaattccactcggataaactgtcctttgaaaggcacatttagagacacagagcgggtcaggggctgcacagggctggaggtggcagcgggagcttcggagaagtggagcgacccaaaaccggattgtgggggtcgctgcggaactctgtaaatttgctaaaatcattggattgtacatttaaagggataatcttatagtaagtcaagtacacctcaattaagctgttcttaaaaattgactataaactaacacagcatctcagttagtgccctcagaactggagttgggacccagtagagaggtggaaagaagtgaggcctaagtgcagtgagtttgtttcaaataggtcaatcatcgacgccgttatgttctggaagtaatgaataataaagacgtataaacttaaacgtgttagtgaataccatcactcaatgatatcagtagaaatgataatcttccaaattgttggagagaaaaaataaccatgcaaataaaacaggacaaacagaaccaactctgtttaccagatatggggggtgggggtgggaagtaacattcagaatcgtaaaatagaaaacatagaatgagagaagcctgaatgttacaacagtgagtgcggagaaactgacgtaatgaaagaaaaagactttgagacagggccaggaaaacgctgccgcctacaagcaacacacctaaacggagtgacccagaagggtttagtggca

SEQ ID NO: 43159 - DNA, 1047 bp, Homo sapiens
gccaaggcgggtggatcccctgaggccaggagttcaagacgaacctgaccaacatgatgaaaccccgcctctactaaatacaaaaaaaaaatcagccgggcatggtggtgcatgcctgtagtcccagctacttgggaggctgaggcaggagaatggcttgaacccggaaggtggaggttgcagtgaaccaagattgcaccattgcactccagcctgggcaacaagagcaaaactctgtctgaaaaaaaaaaaaaaaaaaaaaaaaaaaaaaaaatcccaaatagactaaaagggaaaatcctaccccagtcaagaccccgcacaatcataattgagttataccgtggaaaacactttgagcatccatgagacggtcttactgttttttttatttttctcaatgttctaacatatgtgaaatttaattgatttttccatgataagtgtttttgaagttgttatatgttagacatccagtttggaaaaatcatcttaatatttaggctttccggttagcttagtatgcctggatttgccagggctgcagaattaatgtagacttaaaggaagagaatgtctttcagttgaagtactataaatagcaaaggcaggcaggcataattttaaagttatgaaactccttagtgccagattattggagaagaataacatctgctaaagctaattaaagtttaatatgtttaataaatgtgattgttacagacaaaaaatcattaaagtgctgtagaaaattgttaagttaccatcaggccacataataaattaatgatttttctcactctgaattaatgcaaattcccgttgtactgtatttaattatgcacaaaatggtgcccttgactcagatttcagtgaagaacttcatttttttacttttaagtctccaagtaggaaattcaattagcgttatgaaagaaacactaaaatgtggcatttaattgcaaaatatattttaagcttttcatttatccagtgactttgccagcagtcactgaccccttcattcagagatccttttctgtttca

SEQ ID NO: 43160 - DNA, 1032 bp, Homo sapiens
tctaacatttttatgagagatttaaaggagcaaataaactataattagaaaaaaaaagacaatggattttagcacatattatatgccacatatatattttttaatgaagtttacatttaacagtaaagagacctacaaagatcagtaataagaatcatgtaagtctcttcataggctttttttttttttttttttttttttttgagatagagtttcgctcctgttgcccaggctggagtacaatggcccatctcagctcgctgcaacctctgcctcctgggttcaagtgattctcctgccgcagcctcccgagtaggtgggattacaggcacctaccaccacccccagctaatttttttgcatttttagtagaggcaggatttcaccatgttggccaggctggtctcgaactcctgacctccggtgatccacccacctcagcctcccaaagtgctgggattacaggcatgagccaccgcgcccatcctcttcatagcattttgtgggctgtgctcttactagttttacccttaacataaattatatgctaaactcaacatataattgaaacaaaatccaactgaaatgtgggtgtggccagttgggtgcctgttgtgctttgtgacagcttcagtgcttccaaaggttcctgcagaatgggacattgctctagtttgattcacatttgactacaatggttagaaggtaattaccttttctattttttaaatttttttgaacataaactcaagattgtattgtcttcataataaaacaaaagatgacacttagaattggatgtcttggcccttcctcctcttctgtcctcccagttcagaatgctcacatctctttatatccagcatcctcttacatctgcacctatgctcaacgcactcaagcctcagcacaagcttcttcgtagttctagccttttcccggaaaatcagcttagtctgcccaccgtagccgctatgcttcgtgtcctaacaccaccttccccgggcacctgtcctaacgccaccttcccag

SEQ ID NO: 43161 - DNA, 1025 bp, Homo sapiens
tcggcctgttacacacacacacacacctggtactacaggtgtgcgccaacatgctcggcctgttacacacacacacacacacctggtattacaggtgtgagccaacatgctcagcctgttacacacacacaaacatatatatttttaagacagagtttcactcttattgcccaggctggagtgcaatgcgtgatctcgtctcactgcagcctgcaacctctgcctcctgcctcagcctcccgagtaattggaattattacaggcatgcaccactacagccggctaattttttatttttagtagagatggggtttcgccatgttggtcaggctggtctcagaaatcctgacctcaggtgatccacccgttgtggcctcccaaaatgctgggattacagtcatgagccactgctcctggtcacgtaatttttaaatataattttagctgtatcttgtgttcagttttctaggctacctttttcactcaacattacatcaggatcatttttcctcatgttattctttgagatatttttaatgggcttgtagtgtcccatcatgtgatttaccagtttactttctgttttttagttgtttacagctcttccttcgttgtgatgctgtgaacctcttgtgcataaattatcatgtgcatctctaattatttcttagagtacagtcccaggagttgtgaatgtgggtgaagcccctgctcctgctgccaggcccacctctcagagagtttcgtgtacacgtgtgcagggaagggctgacctagctaggtctctgaaacccgtgccagatactaaatctgcacaggctgcgacagtgagcagactgagggcgatctgtgccttattgtcttcctgttggaagagaacacataaatcacgtatctcaaatgtgaggcaaatagctaatggtgtttgtgtatacgaggaaggtggagtcaccggttcttcgtggccatcagaggaccgacacgcccataggtctcatgcattaagtctgcgttgagcaatccct

SEQ ID NO: 43162 - DNA, 1473 bp, Homo sapiens
ggacagtccctggtgcacatccagggaagaggagtgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctcgtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaagattgtgttggagtcctaccccaaatcattgtgattagcacagcttctgaatgttactagttttatcacaggtgtttgcatgtcaccagctaatggagtatagtaagatggcctacactcactgagaatcagaggtcctcgggaggatgcctgtcatcaggggtgggccgagcgtggctcccaggccggcggccggtgtgctcctatccgaccagccacgggtgttggcttcccgagtctcccattgggtctggcattagttcttgaaaaatttctggaggaagattctttgttctttgttttgtttgcccttttctacgttctgtcctactttctgctttctggtaattttgtacacaaacctaaatgttgacttggggttattgcagatacttctcatgaggtgttatctgcagagagatctttgttttggtatcctgagctcgttaaggcagctttatcgattgcagtggtttacaggatggtgtgtgcttttgcggagtgtgggaaaccagatactgcatccctgcccatcgtgagcctgcagtctacactctatgtatccctgccgttgacatgcaggcctccagtggtggaactgggagcacgggaaaggctgtggtggggttaatgactccttccaggaacttcctgaggaggtgagtggtgaacctgaaataattgaatacgtaagctttctcatacttgaaagaaataaacagccaaaggcatatggtaactcaaatagaaattcagggcatgctcagctctttcagatccacctgctccgggtcagcaagcatcacaactagcagggtagtctaggaagtgacgcagccaccctgtgc

SEQ ID NO: 43163 - DNA, 1062 bp, Homo sapiens
ccacgcccagctaattttgtatttttaatagagacaggattttgccatgttggccagggtggtcccaaactcctgacctcaggcgatccgcccaccttggcctcccgaagtgctgggattacaggcgtgagccactgtgcccagcagaaatgttaaagtttaacatcccattgccttagttcctcaaatgttacacacacagcagcaagccagcagtttctactaggtttacagtagagaagggaaacctggccaggcacccgagctcatgtctgtaatcccagcactttgggaggccaaggcaggtggatcgcttgaggccaggagtttgagaccagcctgggcaacatggcaaaaccccatctctacaaaaaataaaaaggttagcagggcatggttggtgcacgcctgtggtctcagctactctggaggcagaggcaggaggatcgcttgaacccaggaggtcgaggctgcagtgagctatgaatggcaccactgcactccaaccggccacagtgtgaaactctgtctcaaagaaaagtgaaaacctttgtccacacacagacttgtacacaaatgttcatagctgccttattcacgatcgccaaaggatggaaacacacaagtgttcatcagctgaggaaggaataaacattatgtggtccctctgtgcagtggaataggacttggtcgtaaaaagaagtgtgggccaggcgcggtggctcacgcctgtaatcccagcacttttggaggccgaggcgggcagatcacgaggtcaggagatcaagaccatcctggctaacacggtgaaaccccgtctctactaaaaatacaaaaacaattagccgggcgtggtggcgggcgcctgtagccccagctactcaggaggctgaggcaggagaatggtgtgaacccaggaggcggagcttgcagtgaaccgagattgcgccactgcactcgagcctgggcgacagattgagactctgtctcaaaaataataataatagtaagtaaaaggaagtgtgatacacagcagcatgggtgcgcctcagggacgttaga

SEQ ID NO: 43164 - DNA, 1027 bp, Homo sapiens
ccaagttcctacgctgtgaacattactgcttccctgtacagggaaggcagggtggtaaatccttgattcttagtgcttgctggctttttagagtgacatgaactcaagaattttaaatgtaggttttaaattcaattcagtcaattcactttgaagcccacattctcgttaaggtcaggaattgccctatcaaatttttttttttttaatttttaaaatttttcgtagagacagggtttcgccgtgttgccaaggctggtcttgaactgctgggctcatgcagtttgtccgcctcgggctcctaaagtgttgagattacaggtgtgagctgccgcacccggtccagtttggtttctgtgtccttttgatgtacacttcgtctttttgaagtttttaaactttattttgaggtagttttagatttacagaaaagttgtaaagatagtacagggattttcctgtataccattcacccaacttcccttaatctttctgtaactgtggtaactgtggtgaatttctcaaaagtaagcagttgacaccgctacagtattgttaaatgtggactttattcatattccacctgtttttctgctaatgtccttttcctgttctagaaaccatccgaggaacccagattgtatttagttgtcatttactcttagttacaggttgtctgtcccgttgtttttcttgaccggggtgtgtgtgtgtgtgtgtgtgtgtgtgtgtgtgtgtatgtatttttttttgtttgtttgtgataagttgggcctggttagtgcttggatgggagatagggtctcgttctgttgcctgtgctggaatgccgcggtgcagtcctgactcactgtagccttgacaaccttcctggctcaagtgatcctcccacctcagcctcctgagtagctgggatgacagacacatgccaccatgcacagctacttaaattttttttttgttgcacagagttctcactgtgtttcccaggctgatcttgaactcctgggctcaagcagtcctcctg

SEQ ID NO: 43165 - DNA, 1223 bp, Homo sapiens
tggacttatttgaattaggatgctctctttattttattattagaggaccctattgctcagtgaaatgatgttctgagataggaaagaaagggtacctgataatagtgccttttgatcccattagtcacagcaggcattacatctgggaaaagcctgtgggtttaacttcacattttatttatattcttggaaaaccaaagcgaacctttaaggtttccagagaggccttttattttagcagtgcagcaagtttttcctttgtaaagcatcactgtggtacgaatgatgctctgtagcaatagaggaggagtcctgtggtatgtagaaccaaggaaagcagacttcttgcaggaaaaatgagtgcattgaggatagtaacctgactttctgacctgtgattaaattatgatagtagtcagtcattttactctcccagggtttgaggaagtggccggtgaggacttggagcctagtgaggagttagtagagctgcccagggtggaggaggccacagaggacagccctggtgaagagaacagtgaggccttggatgtgttgatatccagcaaggacctggcactgtctagtgaggacgaggcctgcacaggatgtaactggggcctgggcgagcccttcagcgaggagctggggctcatatccagcgaggacggggccagccctggggacgtagaggagctcggcgaggagtgcgaggagccgctgagtgaggaggagcacagcgggccagagctggggcgctgccggcaccaccataaagtgtcaaggagctgcccgagtgggactgacttaaaacagtgtatctagaataaaatggtttcctctagtgccttgatactgtccttggtcagacgacctcagctgccttggagatagaactgaagaagcaagagagggaggtggcagccctgaagcacaggccgggcgtctcgtaggctctttccctagaagccagagcacagaccctgaagacagccttgagtttgatccgtaccacaaaccgggggcttaaactaccaaaatgtaccatctcccagtcctggaggctggccatgtgagacccaggtattgcagggctggttgcttctgaggctgagatgtgtcccgtcttgctccaggcccttccccagctgttcttctccctacatttgcagacggatggcccatccgatgttgacatcatctcctttgtgtctgtctctgtg

SEQ ID NO: 43166 - DNA, 1027 bp, Homo sapiens
caccgtgccaggccgttcatttctactgaaaattatcctggctagtgaggatgggtgccatgttagtgatctgcgattcttttgtgctgtttttcagtacatacttggtcgtttcaggacctttgtttcctctgacgtcctcccttaaatagggagaggaaatggttcctggaaacggtcattttgagaattttctgtgctgtgagaactgaggctctggctacccctctaaaaggcttgagccatgctgtaagagtttgtgggcagtgtttctgtggtgtttcctcccttgtattttgtggtgttggtccccctaacaggtctttgtatagtgtttggttcacattgttggcatgacagtcacctgagcaagacgttgcctgagtcctttgtcagtttgggttttcgcatcatctgtttccagtgggattttggtccctggtcaacttgtggacaactccagagattgagatagttgccgtatccttagtgctcccagggggagatgttctgggactgtaggtgcaagatgtaggaagagtgatttaaacttgaggctgcaggcagacctgatactgtgttgggctttgacaggtttagggaataccagtatttataggcagtatgatagtgtagggggacagtgaggtggaaggtgtgatggtggaggaaagatgaatcggccatctgcgagtagggctcagaaaagagcctggagcctgctgctgttctggtggtttcttccctgagcaatgaggactgtggttgggaagaggcccattcctcctgacgccagagttcctcatctcatgttggctcttttgtatttgaaatagaataatttgattgcagtgtattgtggattctttgacttcgatagatttttgtaacttttgggaaacagattactctaaccagacctgggaagtagctagaaattatacttgtaataaaaaacaattatatgggaagctgaaaatggtggtgttcatttaacaaatatggcgtgcctgctgtttagtgccag

SEQ ID NO: 43167 - DNA, 1057 bp, Homo sapiens
ttggaatatcatattttttacaattggaaaactctataaattttctaatttttacccttatttttcttattgatataagtatttttgtcttgttttccagcaggctgattttagtattttactgtgtgattatgtttctgagaaagattagttactgtgtttatgtcccaaaattcctctacatggcactgttgggttctcttgtaccttgattttactttgggttttagattctgtagagagggtgaagctcccggccctgtgatcttgaggagggtgagttgggagccgtccatgccctgcctaccccaacaccaggttcagctgcctgtgaagtcatttgtttcgtgcacatttcctagttactggtattttttaatcattaaaaatgtttttaaattattgatagtaattgtacgtatttgtagggtgcatgtgtgcagtgggtgatgatcagatcggggtgcatgtgtgcagtgggtgatgatcagattggggttaatggcagagccacctcacagttactgttttgtgttgggaacattcagagcctctcagaaaactttatttcctaagctggtttgttgaggggttttctttcatatcagtttgctaatttatgtgttcactggaagcatccacggtgttctgaggcctgtgatcatgcgcctttctcattctttacatttgtccgtgtctgaaggtttccaagtgttttcctgttggtttagtttctctcaaaagaatacctttctcatatcttattattatcctgagtttttcttcctattttggttagttgtgcttctgcagaatatttatttgcagtacttttgttcataaataggaatgttaagaattgtttttaagttcgacttgtaaaacatttttgttgacttctaagtcgttcttttaaatttctattttcattcaaaaataacccatatgacatctattttttggaaggaagggttaagaaacagcagatgttgccttgtcaattctgtgagcttgtattctactggatttttttctatcttgcttaagaaatgctgcc

SEQ ID NO: 43168 - DNA, 1043 bp, Homo sapiens
tgccttgctctctgtggggatccacagagagttcacgcagtggccctgtcagccctgaacatggagagccactgcatgtgaggccttgggggcatgtctggagagcctgtcatggcgtggagctcaccgtacagtctcctgggaccttgacagaccgcaccaggccacatcctgcgccaattaaacccgaacctcagggctgatcccgttgtggccaggaggaagaatggataatgctgggcctgggagggaccgggaggccgagtccgaggcgagagccatggggtggtgcttgttccggttctcctgcagccggtctgtccatcctgcctgctgtgactgttctccagccactttctctttttcatttttcttgctggaaagctgtagaaggcagtggggtgggaacgctccatccacagtgcaggttagaaccttggaggtgatggcttcgcctggcagtgaggtgaacagagcctccagcagtgccgggcgtgtagccagggcagctgcagcaggaggacgcccagagccttggctctgaacagatagaaccatcgaggccgaatcgggcagtcctcctgttcagaccaactgtgtgtcccttttgtgagacagctggtgacccctgctggcacatctgtgtcccagccgtgaggcggccgctccctgtccatgccggcagtgcaccgtgcccacgggaagctcggtgtgggggtttggagcagcagcacgctgcgtgactccccaggtgatgccagggagatctggataaggaggtccacatctccaccttcatcttctttcctcaagtcacttttcctggcacctcactaaccatgaggtttcacaggaaccttggggagtcccttgtgtgcttggcctggggacacaggactgtgtcggactgctggggccagaagggtttttctagagaccagacccaagcagctgctgtccacctgccacgtgtgccagccccagccttcctcccaagtgagtgggggagggaggcttctgggtgttgccgggacctggccggg

SEQ ID NO: 43169 - DNA, 1028 bp, Homo sapiens
acggggggctgtgactgggccaggcaggggcggctcttctggcggcagtgacagagctcacgctgcatcgctgtgccccggggaagacttcacagctatggatatttagggtccagttcagtgtgtcacacaccagaaactttaaatttttttctcaaatgttctactttagttggcaaagtataattcttaaaagtcatggcggagtattgggtgcaatcctcctggaggcaggaacgggcttagcaccggcaggttctggttggccctttgctgctgtgtgcgtgggtcccttcgtctctcctctctccctccaaggtgggatgtggtaccctgggagcacctgtgctgagtctctccttggtgtccaaggggctgggatggcccagggtgcacaggtgtccccgggcagcctgcagatgcttctcgacgacacggcccctttgagttcgaaggtcagatctggaagccacgttgccacacaacagcgacttcgcagcactgtcgccatgtgtcccgctctcttgccagggtccaggcagctgggaaacagcttggtttgctgagaagccacgtcctgggtgtccctgtcccagagccctcctcgctcccagcctgcaactggggcctggtcgggcgccctggcatgtttcctcctgctgcaggcgtgctcaggaagtgctgtgtgtgcatggcgcccgcgggcatggcctgtgtgctgggtgctgttttacttcactcacgtcatagaatcgcagacagcagccctgccacctgtttgttctgcaggtgagcacgtggagttcccaaggggagaactggccccgggctaggtgacccctctcagctcaacagttccatgtgatgctgagagatgtgcgtgcattctcctggtgcagccatctcagcaggggtcctggggtcccctggcaggacgcgcgggccgggtgttgacaatggggtgtcataggtcaagcctcacagcctgcgtttacggtgcttggttaaatggtccccaaaatcacgtt

SEQ ID NO: 43170 - DNA, 1032 bp, Homo sapiens
ggcacatttcctaaatatgcagcatggaacgcttggcggttctgaacgcgcatctcgtgctgctcctgtagggcggttaggacgcgctcctctggcgaggaaggtggcagcctccactgtgcacgggtcacaggcgagtgtggtgtggtgtggttgtgggtggggtgtggactggatctgcaggcttgtccctctctcgtggagagctgtcggggtccaggcagtgctcagtggtgagagccacagcacatttgaaagtccacatgtgtttgccccactgtggtccaggacatgtgtgagccacactcagtggacttgcacctgtgacatgttggtcagcgtggcggccgtcagctgggtgtggaatgcatctgattggagcctggcacccggcctaccatgattgtgattctctggggcgagtcctgagtgtgggcagggcctcaggcccccaagagggctgtgagcaggcaccttcctgtgaggcacgatgccaccatgtgaagttgtgtgggtctttggagagttctggcaggttgagggcctgtgcgtgtgggacccaggcctgccctgcctgctgccggccatgttccctctgcccagtcatgttgacaattgtggccaaattcaacatcgggcctgtttcctgcacccacgttggcacacactgagttcaagacagtttctgcagaaatgaatccagaggtgtttatttctggcacgttggatcagacgttcagagggtgggcgtctttctccatgcacttcagctggatcagtcagtgtcagccattgactttagcaacagggaaatgaaagactttcctcaataagaaatgggactttctcacgctggatggcacagagctggcaaacatgaggccagtccacaccaaggctttgcctgcagaaaggctgcactgtggccagcgggggaagcggaggagacacctgtggacaccctccccacaggtgggcacacctttgcgcaggcccagtgtgcgttctgaaggagagcccagggtggggttc

SEQ ID NO: 43171 - DNA, 1085 bp, Homo sapiens
cgccccagcgcggaggcgaccccggccccgctgccccggcgtcgggaggacaccgcgcgctcacgtggatgactgcgcccgggaacagggacttcccgaaccttcctgccccgcgccgtgaggcccacacgcgcgcggtgaccaccctggttctgagggggcggcggggccacggcgtgtggcggacccggcagtggcacccaggctgtgcgcgcgggtgtgtggggttccgaggcgcagggcgaccgccggctccggctccccgaggaaggggcacaggcgctgcccgcggtcactcgggccaggtgagggcaggggacgcgcgggggccggaggaggaggcctggtctgcgggcggcaggagggacccggggccagccgaggctgttcccagggaggcagacacctgctgtcgccgggaccctcgacacgctccgcacgcgcgggagcggaaccgggcctgctttggaggcctcccttggcgcgcttggatttactcaaaggtcaaagaaaaatgtcaaggagagcgattgcctggagagctcctggctctcctcccgggtccccgctgggtcccaggagtccccggaggggaagcaaggagccccagtgccctggagtcctgtctccaccaacctcgcccggctccctgctgcctaggcccgcgctgtcccagcagaggaggggtgggagccgccccaggcccacctccccgcgccggtccacaaggaggcccctcctgcaacctgggagaggccgggggaggcccggagggcgaccgcgcggggccgcgggacctggacagccggggagtcgtgaccgcgggcagcgccggggctgagggcgaggagggtcttactgcagggaagggcgggacgctggacagagggaccgactggggtccaccggcctgacacagaagtcgctggatcccagggcccggctgggaaacccgcttcctacccgcccgcgggcgccgcagaagaaaccgaagaaagaggtcttccctccacgcccaggacggtttcaagtgtcccacccagcgctgagcaggagggtgatgcggagggaaaaactgttggctg

SEQ ID NO: 43172 - DNA, 1030 bp, Homo sapiens
gttctggtctctctgggaaggtagaatcctaactactgtaattatcagctagcagacacagcgagcttaatctcacactgaccagcctttgtaatttttcacttgagctcccctagcccgggttctcccctaaaacactccctcacctcagtgcaaacagaaatggagctcagctgtttcccgtcccgcctgcagttactgaatgaaatctatttcaccactcgaaagtctggcatccccctccccacacttctcatctgtcagccaagtctagaaaggaatcagcctgaggtcagctctgtctacaaaatagactcagcgcagcagcattttaggcatctgccgctttgacgtagctttgacgtagcagctcacagataggactctcatctgcaaatacatgcataccgaaaacacaggtgctccctgcagccacgtttgtcacatggagtacagagtgttagaagcagcctgtgtggtcaccagccagggcctaggtgagtgaattacggtgactgtagggaataaccttggattcagtgatggaaactgatcatcctagttttcttcgttaccgttttcttcagagcacttttcctaccagggagcgtcagttacacagtcaagtaatagaatgaagacctggataggctgcatttcataatttggccctaagtaatttgataacttaaaaattctagtgtaaggaattttggaaaaaaaatgaggacagcaaaggataaattatgtcccagtcctaaaggcgggagccagccttgccctctgggtctcttagcgtgcgccctagtttggtgtgttgccatgcagggttagtgaagcacaccactctggccgttagtgctcctgctcattccactctgtaattctgagaattaatgttggtgtcgtcaacctaaagaaaatccaggcaaaattaattatagagactatcagggccacagcctgggaaacactgggaggcgctccagagaacaaaggagaggcttgagtgtttaaagagaaaaggacg

SEQ ID NO: 43173 - DNA, 1031 bp, Homo sapiens
cactttcttgtatgtaagctcagcacttgagtctactgcagcactgaagagtggaacgttgtgaaacctcaacacgctagttgagattaaggatgattgtgaaacctcgacatgctggttgacattaaggatgattgtaaaaccttgacacgctggttgagattaaggatgattgtgaaatgtcaacacgctggttgacaggatgattgtgaaacctcgacacgctggttgacattaaggatgactgtgaaacatcgacatgctggttgacattaagaatgattgtgaaacctcgacacggtggttgagattaaggatgattgtgaaacctggacacgctggttgacattaaggatgattgtgaaacgtcgacacgctggttgacattaaggatgattgtgaaacgtcgacatgctggttgacattaaggatgattgtgaaacgtcgacacgctggttgagattaaggatgattgtgaaacgtcgacacgctggttgacattaaggatgattgtgaaacctcgacacggtggttgagataaaggatgatggtgaaacctcgacacggtggttgagattaaggatgattgtgaaacctcgacacgctggttgagattaaggatgattgtgaaacatcgacacgctggttgacaggatgattgtgaaacctcgacacggtggttgacattaaggatgattgtgaaacgtcgacacgctggttgacattaaggatgattgtgaaacgtcgacacgctggttgacattaaggatgattgtgaaacgtctacacgctggttgagattaaggatgattgtgaaacgtcgacacgctggttgacattaaggatgattgtgaaacgtcaacacgctggttgacattaaggatgattgtgaaacgtcgacacgctggttgagattaaggatgattgtgaaacgtcgacacgctggttgacattaaggatgattgtgaaacgttgacacagtggttgacattaaggatgattgtgaaacgtcgacacgctggttgacatta

SEQ ID NO: 43174 - DNA, 1050 bp, Homo sapiens
attgtgaaacctcgacacggtggttgagattaaggatgattgtgaaacgtctgcacgctggttgacattaaggatgattgtgaaacgtctacacgctggttgacattaaggatgattgtgaaacgtcgacacgctggttgacattaaggatgattgtgaaacgtcgacacgctggttgacattaaggatgattgtgaaacgtctacacgctggttgacatttaggatgattgtgaaacctcgacacggtggttgagattaaggatgattgtgaaacgtctacacgctggttgacattaaggatgattgtgaaacgtctacacgctggttgacattaaggatgattgtgaaacgtcgacacgctggttgacattaaggatgattgtgaaacgtcgacacgctggttgacattaaggatgattgtgaaacgtctacacgctggttgacattaaggatgattgtgaaacctcgacacgctggttgagattaaggatgattgtgaaatgttgacacgtggttgacattaaggatgattgtgaaacgtcgacacgctggttgagattaaggatgattgtgaaatgttgacacgctcgttgacattaaggatgattgtgaaacgtcgacatgctggttgaaattaaggatgattgtgagacgtcactaaacaccccctgccctccacactccaccctccacctctcactaaacacctcctgtcctccacactccaccctctgcctctcactaaacacctcctgtcctccacactccaccctccgcctctcgctaaacacctcctgtcctccacactccaccctccacctctcactaaacacctcctgtcctccacactccaccctctgcctctcactaaacacctcctgtcctccacactccaccctccgcctctcgctaaacaccccctgccctccacactccaccctccacctctcactaaacacctcctgtcctccacactccaccctccgcctctcgctaaacaccccctgccctccacactccaccctccacctctcactaaacaccccct

SEQ ID NO: 43175 - DNA, 1055 bp, Homo sapiens
accaaaggcagacatcgcaggttcaataagtgatttaggtaactattaagtaaaaaaattaattttagtgttttctaaaatgaatcgagattaaaagtactgataactgcggtcaggtgcagtggctcacacctgctgggagcctcagcacgttgggaggctgaggaaggaggattgcttgagcccaggagttccagaccagcctggacaacatagcaagaccccgtctctacaaaaaaattcaaaaattggctgggcgtggtggcacacacctgtagtcccaactgcttgggaggctaaggtgggaggattgcttgagcctaggagtttgaggctgcagtgagccgtgatcatgccactacactccagcctgggtgatggaatgagaccttgtctctctgttaaaaaaaaaaaaaagataccaataactgctttgaaaaatataaattactacctgaaaaatgaaaattaaaggtgtatgtcatataaccttataaactgttgaacgggcatctcaattaactagaataatcaaatgatattctgaatgaattttttttttttttgagacagagtcccgctctgttgcccaggctgctgcagtggtgtgatcttggctcactgcaacctctgcctcctgggttcaagcaattctcttgcctcaacctcccaagtagctgggattacaggtgcttgccaacacgcccggctaatttttgtatttttagtagagacagggtttcaccatgttggtcaggctggtcttgaactcctgacttgaggtcatccacccacctcagcctcccatagtgctgggattacaggcatgagccaccgtccagcctgagtgaatgttttgatcttagtagggtttaatgagttctgtttacagctgagtaccattcagttctgtcagacaagtcaaggacagctgtgttctgtagctgttccctatgtatttcaggtgtccgagtctttcagtgcgcattcattttggggcttcttcctctcagttttggatttacaaccccagggtgtatcaggaacactggatg

SEQ ID NO: 43176 - DNA, 1060 bp, Homo sapiens
gggccagatgcctgcgggggagacggatcccacacctgcaggtgtccggtggggagggtggcccaagctgcggcactggcaggagaggagattcaggtctcactgagaggggctgggagtgcataagacacccaattcattagtgggctgcggggctgagctgagaagaatctgcagaagggcctcctgccagggtgggcgggaggagcaggttcgaggactgcagttgccctggctggctggggtctctccttcaccccgccacgcggactccacccaggagcagaatggcttctgtgccctgctatggctgggccctgggagcatgaggggactcagaagtttctcggtgccagggtgctggccttctcttctggaaagataaacaaatgccgtaggtatttgttgcttcagttcttcaccccgacggccgtccctcggcccactcaccgccctgcccttttgttaacaggaaggcctagggagtcaggtaaaaaacggaaaagaaaaaggttaaaacccacctaaagcagccaaccaggtaggactgtctgccggacacactgagtcctgcagggcggggaggtgcaactgactgatcacaccagcaaatcacgcttcctgtctcgccgggtgcggcggggatgtggccctgattggccttgatggtgtctgctgggcttgggtctccttgctccccgtccgctcctgcctcgcagaacgccctggcccgtggctcactcccgcttgggagcctgcctccagctttgtccttctctttgtcgttgattggggatgcaggagcattgcacatgaatggaacaggttgggcgacctgagcagcggtggggcagctctgagcgcctggccactctgggatcacccaccccatttgacagatgaaaaaactgaggcttaactgagattacagataaggactgttggaggctgaatatatctggaaatcctttataaacgtgcagggctgttggctactgtgttggaaattgcatttggctgctagtaacaccagacagcacagggattgagataagatcga

SEQ ID NO: 43177 - DNA, 1047 bp, Homo sapiens
acccccgccccccactgttgtgactcctaggccccggagggagatggggcggcggggagaaggttctccgggaaggactttgcagccagccgggtcgtttcctcgtcacacgaccgggcactttagacccataactgggacttatcttggcctctggggacttggtcctctgaggtgctgggtattgagtaagcagattccacatcttactacccgggatctccaaggccactcactccccttttgaagccccaagatttttccagggccctgggagtgcttgtctgcggcactcttctgtcctcaggatatttaccgccggggggtcagggaaggaggggaggggagggcctaactcaggcctccaggtccaggtgtggctgggtccccctggcatgagcccccctggcatgagcccagcaccatcccctctgtcctgtgtgcctccctggggcgcagtttctgcctttcggtgggccttggcatcctccctggttatattttggaggcccttgtgagctctgagtccgggatgcctgtggtcttgttctcattagagattctcatgtcagttctgggtgctgggggaggcttggaggtacggggagaggctctcagcccatggctcagccttgtgcagcccctgcccttcccaccctggcctgtcatggggtgaggataggagggcttggccctacagggcagtgttctctccctcccccggccccctgaggaggctgggtggggtctagaggcttccagcaccctctggccagtgcagtgttgggggtgagggccagttccccgctgggagtggcccctgctttgctctgtgcagtggtagagccaggaccagggctctccctctgggtctcatctgccgggacagggtgtcctaaggcctcagggctgtgtcctgcagcagagcctggcggcccagttcccacctcctcagacccaggcccccttcatgttcccgcttctgggaggcgtcttctccctgcccacccatccgagggttggaggaaaacatccggctttggaccc

SEQ ID NO: 43178 - DNA, 1052 bp, Homo sapiens
gtctcgatctcctgacctcaggtgatccacccacctcggcctcccaaagtgctgggatcacaggcgtgagccaccgcacccggcccattatttgctcttgattcttttaaaggtgcactgaagatttacaaatatcaggaaatgaacattttattttttccttaggtttaaagactgtataaagcattttaataaacatgatttgtttgtttgtttttttgagacagagtcttactccttcacccaggctggagtgcagtggcgcaatctcggctcattgcaatctccacctccctggttcaagcgattctcccgcctcagcctcccaagtagctgggattacaggtgcgccaccatgcccagctaatttttgtatttttagttagagacgggatttcaccatgtaggctagacctctgcctccgaagctcaagcgatcctcccacctcagcctcccgaggagccgggactacaggtgtgcaccaccacgcccggctaatttttgtatgtttttgtagagatggggtttcgcggtgtggcccaggctggtctcaaagtcctgagctcaaaccgtccacccgccttagcctcccaaagtgctgggattaggtgtgaaccaccacacctcacctccttcaaggtttctgactggtcctggagcttggcctgtcccggcactccccaccccccaccttcagcacctggccccttccctcacggccgttctttcccactcgccgtggtttgcggggtcacagttgttgaggaagttgcagacacctgggagctgctcttgatagcagggagtttggcgtgtgatacccattcctcacccaggagggaggggcgtgcaggtgcagagacagagagatggacccgacccgtcaggtcccgccggccccctccccagcaggcttctacagcacagcctctgtgagggtggaaatgcttctgtctgagctgctgtcctcacagtggccacgggctggggaggtgctggccacctggggtcactgtgttccagcagttgagagaggcagagcattggctgt

SEQ ID NO: 43179 - DNA, 1025 bp, Homo sapiens
tttcaccatgttgcccagggtggtctcgaactcctggcctcaagtgatcctcctgccttggcctcccgaagtgctgggattacagacgtgagcccaccgtgcctggcctccctccctcagctctttaaaaactgtgttctcggccaggcgcggtggctcatgcctgtaatcccagcactttgggaggccgaggcgggcggatcacgaggtcaggagattgagaccatcctggttaacatggtaaaacccagttctctactaaaaatacaaaaaaattagccaggcttggtggtgggtgcctgtagtcccagctactcgagaggctgaggcaggagaatggcgtgaacctgggaggcggagcttgcagtgagctgagattgcaccactgcactccagcctgggcaacagaacgatactctgtctcaaaaaaaaagtcttctctttgggtctttttttatatgcaggctctcctccccctcccctccttatcctccccatctttttcttttgttgcatggttgtagtcaaagtctagataaaatactaagtaagaaaagaaggaaagtgtttacaattttaatgtatcctgggttactctgtgatgtgaatttcaaattttgttttcttcaaaaattgaaataatttttttgtttattattatgtttttggattctagcatttccatttggctttaaaaacattgccaggtgcagtggctcacgcctgtaatcccagcactttgggaggctgaggtgggtggatcacaaggtcaggagatcgagaccatcctggctaatatgatgaagccccgtctctactaaaaatacaaaaaattagccgggtgtggtggtgggcgcctgtagtcccagctacttgggaggctgaggcaggagaatggcatgaacctgggaggcagaggcagagcttgcagtgagccgagatcgcgccactgcactccagcctgggtgacagagcgagactctgcctcaaaaaaaaaaaatttttttttctttttagttctgttc

SEQ ID NO: 43180 - DNA, 1517 bp, Homo sapiens
aagcccctagttttcctggaggtaccctggggagactggactgggacaggacaaacacattggcaagaacagtggggtcttcacaaggtggccccagacccatgggctgatggtcagaagcacccgccctgagccgtggcgggcactggctggaggtgggctggtggctggggcctgcccctgtgggagctgccgtgccgtgtggggcccggggctgcccccggggagggaggtgcagtgtctgatgtcaagtgccacctgcacagtgtcgttgaggtccccatcactcctgggagggaggtgctgttaccttctgcttacagaccgggaggccaaggctcagagcgcttaagtaacttgcccaaagccacacagcacagcaggtgcgccgccagcacccacagggtctgcccttcctgctcccttgagcttggacgacggcccctgtgaggtgcttagaccccaccccttctcaggccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggtgggtgctggcgagcactcgggcccgggtggcacaggagggtgggccctcaggcccgggtggcgcaggaaggtgggtgcttggacggtacgggagggtaggcacttgagctaggcggcatgagaaggcgggaagtcgggctgggcagcgtgggaaggcgggtgcttggacgtgtgggagtgtgggcactggcgccgggcagcatgggaagacaggtgcaggaaggcagcttcccagggccgggctgcccaggagccggatcaccacgctgtctctggggccacccagcttggccctgtcagtgggggctgccagctcgggctagaggatccaccgcccccacaatgcccagaggggacctcggggggaactggggtcctacggggaggagatgtggacggtagccggctctggggtggtttgggtagggttcctttggctgcccttggtgtggcggcggggagggtgggtgtaccccgcatctctggagggcttggggggaacccaggtaaaacccccacaaaagctatccttttgtctttgggccaggctgcagggggcgcagcggtgggcccagcctctttgttacttaggttcttgtttctatgtttatcacacgtctgtgtgcacacggtctaaagcgctatatcgttcctaaatcttgagaaacagaagtttgaggtccctcctaacccccgttgggaattggtccccatatccaaaaataagctgccggtgtcgctgcagatttacccactttaggcaccatctgacaacttcccacgtggaagtagaggttccagctctttccatcccctcccacgtgcccgtcccctgcctgccgtgctccgctggcatctgaccctgggtttgttagggggccgagtcgggtgc

SEQ ID NO: 43181 - DNA, 1050 bp, Homo sapiens
catcctctctcccttcctcctctctcccttcctcctcctcccttcctcctcctctctcccttcgtcctcctctctcccttcctcctctctcccttcctcctctctcccttcctcctctctcccttcctcctcgctcccttcctcctcctctcttcctcctcctcattcccttcctcctcactcccttcctcctcctctctcccttcctcatcctctctcccttcctcctcttcctcctcctcccttcctcctcctctctcccttcctcctcctctctcccttcgtcctcctctctcccttcctcctcctctctcccttcctcctcctctcccttcctcctcctctctcccttcctcctcctctctcttcctcctcctcactcccttcctcctcctctctcccttcctcatcctctctcccttcctcctcctctcttcctcctactctctcttcctcctcctcactcccttcctcctcctctctcccttcctcatcctctctcccttcctcctcttcctcctcctcccttcctcctcgtctctcccttcctcctcctcccttcctcctcctctctcccttcctcctcctctcttcctcctactctctcttcctcctcctcactcccttcctcctcctctctcttcctcctcctcactcccttcctcctcctctctcccttcctcatcctctctcccttcctcctcttcctcctcctcccttcctcctcctctctcccttcgtcctcctctctcccttcctcctcctcccttcctcctcctctctcccttcctcatcctctctcccttcctcctcttcctcctcctcccttcctcctcctctctcccttcctcctcctctctcccttcgtcctcctctctcccttcctcctcctcccttcctcctcctctctcccttcctcatcctctctcccttcctcctcttcctcctcctcccttcctcctcctctctcccttcctcctcctctctcccttcctcctcctctctcccttcctcctcctctcttcctcctactctctcttcctcctcctc

SEQ ID NO: 43182 - DNA, 1028 bp, Homo sapiens
tgcgaagtgactggcagcgctggcccagtgttatgtaagatgttatttggggaactgggtatacacactgtcctatttttggaactttttggaagtctgaaattattttgaaatgaggaaaaaaaaatatgctttgtatgaaactatagtggaatagattgagtcgattctcgtttcaaaataacttcaaagagtttccaataggcatgatgccggcatgaatggtttcagcaggtcacaggcagagaagccggaatcccaaaatagcgccattgtgtggacaacctgactccttacaaacgtgcagtggcttcccaacgctgcctttgagtttctgggtctggctgctgaatgtgttgtgcttaagaatccagacaccctgctgttcctgccagagcttctcacgagatatttcgggtagttcatcatctgtcatgtgcagaatgcattttatttctcatagacgcttgtcatgataagctggccacattattaaaaggctcccaaagacaatttccagagcgttttccaagcgttccccttgggcatgaggtaaaccggaggtagcgtggtcgcaggcctggcccggtgtggcttcccaggaggggaggtctgacctggaggcccagagccccccagggtcgggtctgcagccccagggctgatgcgtggggcctcgtttgcacaggccgtgtagccggagctcagcactggacctgttccacccaggcctcaggagcaaggcaaactgacttcctgaagcttcctgtatcggttcctctggccacagtaacagattactgcaagcccagcggcttagagcaccgcaagcattactattccagagcagagtccaaaaggggcccaggccagacacgatggcccacacctgtcatcccggcagtttgggaggccaaggtgggaggatcgcctgaggccaggagtttgagaccagccctggcaacgtagtgaaaccctgtctctacaaaaaaaaaaaaaaaattgtttttaacttaccctggtgtggt

SEQ ID NO: 43183 - DNA, 1048 bp, Homo sapiens
aaaagtgctgctgatctcccagtgcttctggccgtattccggtggggttgcctccgtggacatgaaggcttcgaaaaaggatctgtgggccgggcgcggtggctcatgcctgtgatcccagccctttgggaggccgaggtgggcggatcatttaagatcaggagttcgagaccagcctgcccaacatggggaaaccccgtctctactaaaaatacaaaaattagttgggtgtgatgtggctcgcctgtagtcccagctactcgggaggctgaggcaggagaatcgcttgaaccgggagacggaggttgcagtgagccgagatcgggccactgcactgcagcttgggcgacagagtgagacaacgtctcaaaaaaaaaaagaaagaaaagaaaagaaaaacgatctgtgaattactgtttctttcccaacattttattgtgacattttcaaatagcaaaaatgaaagaatttttaccctgaactctcctgtgaccatcacctacattgcaccttaacctcgtactgggctgactttacctcgttgtgggttttttccattgttgttttcagcatgtttatgaaggaaacaagtttgggtttgattgtttttgttttgagacacggtctcactctgttgcttaggctggagtgcagtggtgcaatcatagctcactgaagcctcggcctccttcctttctggactcaggggagtctcccgtctcatcctctagagtagctgggactataggtgtgcagcgccacacccagctaattttttttttttttttttttttagagatggggtttccccatgttgcccaggctggattatttatttatttatttttgaaatggactctcactgtgtcgcccaggctggagtgcagtggtgtgatctcgactcactgcaacctcctcctcccgggttcaagcgattctcctgtctcagcctctagagtagctgggactataggtgtgcaacaccacacccagctaattattattgtttttttattttttattttaaagatggagtttccccatgttg

SEQ ID NO: 43184 - DNA, 1033 bp, Homo sapiens
tgaggatttttacgatgtttgtgaaatgttctccccacatggcttctgttttacccaggttaattgagtgttttgtctgcctctaaacaggcatttcttcttccagtgtctggggcagggtctgtggccaggccgcccacaccctcgggccgcagtgggaggacggaagcctgaggcccgggtgtccttggctgcagcgtcttgtctcctgctgttcagcggcccctccctgccccgcccctgaccaactcgatctctttcccgtccaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctg

SEQ ID NO: 43185 - DNA, 1027 bp, Homo sapiens
ccacactgtgtggggtggggcaggacctcacagagcctcgggagccgggagtctgtgggaggtggaccacgggggtggggaaggggcctctgggcagttaatcctggcacctggcgcctgcccgcaggactggccatcctcatgtgacctgtctgtctcttcgtcgtagcacaggcttagcaggatggtgtcggctggggccagacccagtgcttggggacagagcttttggccactactgaggtgagggtgggctcgggaagccccaggcagcgcacccgtctctggataccctccatccccgaagcctaatgtgttccttgactttcagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcaggtgagcggccctgccccacgcggttctgtcccggacgtgcgtctcaacccctgcctgagggggtcgaagccttcactcgcacacactgtgtggaaggttctagagcagtgaggtatgagcgttcatgccaggcctgtgctgccgccgctgccctttctgtctgaatggcccagagccttcaggaactttcaggggcggcagcagagccgctgcccgtgcaggggttgcctggaactgtgcttttagaaatgggtctgatggtgaaccttgccccaggtgtacgtcaccacaggaagaatccacgggcctgggtgctgcttggacgtgggggtgaggaggagggaactcgtggtggccttcagccctcactcacagtgacaggaggcgccactgccacccaagagcgggaagacggggattgtggggtgctgggcacagggtgccatctccctggctgcctgcggcgtggctgggtggatggtgcctgcggcgtggctgggtg

SEQ ID NO: 43186 - DNA, 1026 bp, Homo sapiens
ccccaaacaatttagcagggacccaggagccacccaggtcacttcccatcacacctccctggtgtgaggccacggctggggaaggtcattcccaggctggagagactgggcaggggtcactgtccttttgggctgttctcagagcccacagcagccgtgtcaggccctgcccggcaacgcggcccccacacaggacctgctggaccaaggctgcctgctcctcccagccctggggctctcaccgcacagcctgcacacctgtgctcactgcaccgtccctgcagggcagggagggcccgcaggcaggaaggggctgtagacagaattggtgctcggatctgagagctgggctcaggccgggacagggtgacaccaaccggaacgctgccgtggccggatcgctgccgtggccggcggccaatgtggcccccttctcagggctcgtttctgtgcatgtggtgttcacagtcatcacttaggaaaattcggaaccgtggagattggtgtccagtccagggacctggtgccagagccagtgccaggctggctttatggagccccgcgtgtttgtcccacgtttcctgttggcttaaattcacaaacctgggaaatgatgatggtttttatttttgccagttctttttgttggggtatgactagcacgttacccaccttggacatctccaggaagagccagtgtgttgtggcgaagcctcacgctggggagcacggctcacacagggcccgtgtcacacagatggacgggtggggtgggcggaaaggagctgttgggtctctgctgcctcagtcgagtctacgggaaccttttaaaatcaaattagtgtcatttcttctctgtgtctcttgccaggagttaaaggcataaaggaaaaacatagttttcatgcagttgtattttctcaaacagtgtcagcttctctgtaagaatctcacggctctcttctctggaaggtgctgtggcagctgatccactttgctcctcccagcctgtagggtttggctttg

SEQ ID NO: 43187 - DNA, 1671 bp, Homo sapiens
ggcccttgggtggagacgcaagatggggcagcggctggcgagaagcgaacctagggggctcctctctggggcccaggaagagttcttggagaggctgtcctggctctgacaggagagcgggcctcccctttggtgggcgtgctgggcggggccccaggctgcaggaggactgtgatgggagcaaggggtgccccctctctcagggagccccaggagggcagaggctgcagcgcgtgttcacaggacgggagcatgagggaatgcactccgcggcgtgggaagaaacagtcgtggggaccagggcatcgcacgcggggcctgccgcatccatgcactgctgggcctggtgcccgtgttcccgcagagcagcagacaccaccactccgccggcccttggatctctcctcagtgggaagagaggctggggacgggccggccacctgccgcctcgctggacttctgccctgggattcctgagacgagagccgagcgtcctaagctgccctcgtccaggtgccccgtggcctccctcgggaaacgcactgtagcttggcctccgggccgcggtcagtgcctgcgggcctctgggtccaggctgtgggaactgtccacttcctgggagggcaggagtgagagacctgagtgggtgaccccaggcagccccagccccccacactccatcaggagaagaggggtcagggccacagccaaccagtctccgcttcctgcttgcttcccaccgcctctgcccatctggaagccctggctgcagtgggggccctcctcgtggtgatgggcctggaggttcttggcggccactggagcttcctgcagccactaggcctgcgcagcctcccctctgcccacagggcagccccacggccacctccgctctgtggtttgccttcttggactcagggcttcactgttttgaaaagcccgggtgctgcagtgaggaccccgctccgcatttctgccgggagctgtgagcagccaggccagcctcctcacggtgccaggaagcctctccttctggcccagagcagcagctgccccttccagcattgaccgtgggtgatcaacaacctggcatgggggcaggattttccctatagaaccattgaacaacacggacctgtcagctcaaggtaccttctggctttgcaggtggctagagatccatgcaaccacaggtgggcctggttgggcccctccaaaccctcaccctcttcctccctccctttcactcccccccccccgttttttttttttttttttgagacagagtctcactctattgcccaggctggagtgcaatggcgcgatcttggcttactgcaacctctgccccccgcgggttcaagcagttctgccgcagcctctcgggtagctgggattacagacgtgcaccaccatgcccggctaatttttgtatttttagtagagacggggtttcaccatgttggccaggctggtctcggactcctgactcagatgatccacccacctcggccaccacgcccggaccactccccagttcttgacaagtctgcagttcctgcactgtcctagactatggaacacctgggagggacagagagcttgtcctgggaccaccagctggacgagcctatcacccacccccgaggtagaagacctggggcgcagccc

SEQ ID NO: 43188 - DNA, 1082 bp, Homo sapiens
cagcagccactcactcacggagcgcggctgcagccggcacgtctgcctttgctcatcctcccagccctgctccgagctgcgccttctcgttgtttatgtgttctagacgctaggcttttgtgtatgtgtggtttgtacatattttgtcccagtccatagcttatctcttacatcctcttaatgagggttttgcagagaaaaggctgttttctttttaattttggtgaagtctaatttatccttttttttttttttgttctttttaattttaaggatctgcttttggtgtcatggttaagaattcctcaatgactcccaggtcccaaacattttctcctacattttcttatcaaagttttatagttttacatttgacatttaaatagatgatctatttgagttcattttttgtgaggtttaggttgttgttttggttttgttttttgtttttgagacagggtctcactctgtcatgcaggctggaatgcagtggtgcaatcatagctcactgtagccttgaactcccaggctcaagcaatcctcactcctcagcctcctgagtacctgggagtacaggtgcgtgccaccatgcttgtctaatttttaaagtttttttgcagagatggggggtctcactgtgttgcccaggctggtctcaaactcctggcctcaagcaatcctcccacctcagcctcccaagcagctgggaatacaggtatgtgccagcatgcccagcctggatttttttttttttttttttttaaatttatttttttattgataattcttgggtgtttctcacagagggggatttggctgggtcatgggacaatagtggagggaaggtcagcagataaacaagtgaacaaaggtctctggttttcctaggcagaggaccctgcagccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtca

SEQ ID NO: 43189 - DNA, 1134 bp, Homo sapiens
agcaggcctggagacagagggggcctgagtgtggggatggtgaccacccctctcaacctgagaggcacccgggtccctgtatgtgtgtgtgagagagagagagcatcatagcgcctgcactgcacagagctggcagaaacagaaaccagcagaggaatcctctgctccaaggtggctgaattagtttcacaaaagccatcgcttttgatgttgctgtccctgttagtcgggaagttctttcctctgttgcttagggccctgtcagagctggggccggcaagtcccacgcccggtgatccccacgaagtttccgggtgctctctttcacactgtcttttgcggatgttgatcccttgcctagaacaccctttctcgcttcccctcgttctctcagcaaacactggctcgtccttgacattttattttgggcatcagtacccccgggaacccacccctgaccactgtctccacacccctccgccagtctttgctgggttaagcctgtccgcacatccatctctttcccacctacttggagctctttgcaggcaggggaagtttttatgtgtgctgcagcagcctggctgactgttggatgaaaaccgtagaaggggatgtattcagtgacgtaaaaggcttttccccaaggcgagtgatccaccaaggcgagtgatccaatttccccactgagtagaaaggagagcaggcaggatggggactcagcgcttcttattgtccccggacagttgttgaagctttagagccttagatttgagtggaaagagaactgcgaggccccaggcactgcatcctcaggatggcaggaaaggagtggaaaggccacggccagctcctggccgaacctgccatgcaccatgagacgctcaaccttgggtgaatattctagaacaatcaaaatgctttcaaaatgactctggaatgtttattttcttttgtagtaatgaacccaggctttagcaacaattaacatccagctcctaggagccagatgcttaggaaaggctgctgttttcacagggtttccacgtggagagcttacgcacactgattcctatctgtgccttcctgggctgtgataagaaatggttcattacataggtggatggttttgat

SEQ ID NO: 43190 - DNA, 1050 bp, Homo sapiens
tgggcaggcacacccagcacggtcacaacaagccatttatcccccagtacgcaggcccctcccccggttcctcacaggctgagtactctggggtcacagtcttcccggacatcacctattggttgtcgggcaggggctgtaggtgtttttttagggttgtcctgctgcattttgttgcagcccacaatgcgttgcaatcctagtcagctcaggggcttttcaggtatttgacttatgacctaagtagctgggcagactgataagaacagacaaaacaagctatgttgcagacgagtaaaactttcgtcatagactaaaagtttttgggtcaggtgaaggcaactaagcgttggggggaagactggggatggggaggccgacaagcaggcatcggcaacccaggcaggggcctggtcttctgtagcttgctgacctaagcaagcaagacactgtgtcttggaagtggaccactgtgtacattatttccttcactgagaactgattttgcaaagccgagtttgtgtgactgtggagggcgagtgtccacaccaggcagcgtccaactcagcgctgtttctcagactgatgtcccggggacagtcacagacccccggggctgtcctgctccctgccgggtggcagtgaccatggggatgtgcatgagggctctaggtctgaggggtggtttgtccaaggtcatggtcagagccaggactgacacctgggttccagcctccgtgccaggggtgtggcgtgagcaccacgaggggaaactggggacatgtgacacactgcagcgctgaggggccctgttctgaggagccagtggagacctgaggacaaagcatccgtgtctcaaggctttgccctctgctaaggtgggcactgcagggacccctgagctccacagagaagcggaccttactgggagaggagcctggtgcgcaggaccgttgctggggccgcagcgtgtgctgcagcgtccaaacgcagctctgggtttgtgactgagcatggcggtgattctgccagaggcgggaagcctccctg

SEQ ID NO: 43191 - DNA, 1027 bp, Homo sapiens
gggtcggggcgggcgtcacggcagcggggtgcagggttgggggaacatcacggcagcagggtgtcggggtcgggggtcacggagcgtgacggcagcggggtggggggttgggagtgacggcagcggggtcggggtgtgtgacggcagcggggtgaggggtcggggggcgtcacagtagcggggtgaggggtcgggcgtgacggcggcggggtgcggggtcgggggcgtgacagcagcggggtgcggggtcggggcgggcgtcacggcagcggggtgcagggttgggggaacatcacggcagcagggtgtcggggtcgggggtcacggagcgtgacggcagcggggtggggggtcgtggggagtgacggcagcggggtcggggtgtgtgacggcagcggggtgaggggtcgggggcgtcactgcagcagggtgcggggtcgtggggggcgtcacggcggcggggtgcggagtcagggggcatcacggcagtggcggctttgaacaggcgactttcaaggactttcttcgctttctccacggagcttctgttttcatgagaaccaaatatgggctggggaaggaaaccacagtaaaaaaagtgtctcaaggagttgtgagaaagtaagaaagctctacgatgttgaggagcagcaggtcgatgctgtggcagattccagcgggattagggggtgggaagcagagcctgaggggcggcgggagctcagctggggcgccggaggagctgcctgcgcggggagtagctgccggccacttgtctccgaaacgggagtggaatgcggtgaggaggtgaggagggagggcagtgttgcttgaaagctctctgcccttcccttccgctgccctctggtcattgtatgtattttgaaattcacaccgaaggagggtgtaaggtgttcctgtgtgtgaagctgcagagtgggtgagaaagaggccagaggagcgccttcctctcctgctgccagtcctggttttcaggacctggttttggtcggtgggcctaggacat

SEQ ID NO: 43192 - DNA, 1033 bp, Homo sapiens
cgacgtccagctcagacccaccagcaccttgcatctccagcgtcagttcccccacggtggcagatttgctttagggttcctgtgtaactgaggcgcttcacccacagtggcctctccgtgtggctttcctggtcgacggtgtcagaaatgtttcctgcagcggcaggcaggtgcagcggcaggcagggttggcggggaggagctgggtgacaggctggtcaccgctggcctttggaccctgcggggcgagcgctttgggattgtagcaattctgtgtgaggagtgcaaggtgaccagtcgtgaggtttcctaagcagccccagggtgaccaggcaagcgtgaccctcgcgaggccccgaggagccagaagccacatctgaccgcagtttagagacatgacgtggccgtgccttgtgtccacccaggtgtgtgcagctcccgagtcacaccctggctgggcctatgcggccaaggctgtctacacggcactgctgaacctcacatccgactgctcggtgctgtctggaatgacggccttcagggcagcgtgacagaagcggttcagggccggcaaatttgttttctgctcaatgtacagcctcagcttgtccctgaaggtctccccgagaaagctgtagatgagggggtttaggcagctgttggagaaggcggcgaggttgacaatgtggcccgtgagggggtgggcatggcggaaagactgcttgcagggagcggccccaggctgcgtccgctgcaggaggtgcacgctgatgaagacgttctccggcagccagcagacgaagaagaccagcaccaccgcgaggatcatgcggagcgccttctgccgccggggccgcagcccacggtgccggtgcgccctgaccagcacccggacaatgagggagtagcacaggccgatgatggcgaagggcacgatgaagcccagcgtgacctcgagccactgcacctcccggacatccgcgaaacagaagcaggcctcgtcggtgtgctgcaggtgcacggcggtgaaggg

SEQ ID NO: 43193 - DNA, 1245 bp, Homo sapiens
ggtctgctctcagacatgtggtgggctccgtgtcacgggtaaggggtcggggtctagacggcaacagagtgtctctctcttcccgctccctggtgtgcccacctccctgtacagtgtttctgttcaagctgctgcaggggacggggcatttttcctccagactctattttcctgcaaggaagagctgctgtcctttttcttactgaagcccctgattctgtgtctgatgttgctgacgccgtgcttgctttcttgcccgtgtgcaacttcccaatcccagcacacgtgctcacttcccaagggtgaggcgggcaccgtgcctgcgggcggcccaccctcacggaaaggggcgcaggatcacagttcagtgggtcacctgttctccaggtcgcccgctgggttctcttccgagtgcaccttcctttctctcttaaagctttttaataaacgtccgctcctgctctgaaaaaaaaaaaaattttaaaaacaggtgaatggaaggtgggcatggtttgaaacactcctttggttttaccaaagaagcaagaccgtcccctgtggaagtgacagtgacctggtgttgaacgccagcgtggccggagctgtgagcttcacagtcgtggatgagcggaagaacttgagtgtggctgcagacgccgacttttcccttcttctccccctcctcttcttcttgtaagatacacaaatcaagagctgcccgcagctttagtgggactgcgcggtggagaagggaactgccactgccgctgggcccagctcctcgcttctctctagagccgtgtgctgggcacgcagctctgaataatgcggttggctttgctcgtgggtggactttggacggagtttgtgttttgccgtttttttgtgtgtttttcttttctggctggctgcacttggcactgggctgttgcctgtagctctggatggttaacgtgggtggtgcacgtgccccaaagccaggtctgtggtcagcggacatgctgcccagcccctgtggggagagcgctctgctgtgatgacttctatgggcaagaccttctgcatttcacacgctgccaaggcactgcagcttgttcctggctcggctggcctggccgctgcctcttgaaccagagagcagggtgacggtggcccagcgagccaagactcaggagcgagcctcgttttctggaggccgagcagggcttcgtgctgtgtccgcgacgcgcacctccttgcttgtga

SEQ ID NO: 43194 - DNA, 1103 bp, Homo sapiens
tgctggccatggaggggtgagtggggagggcccggcgggcgggaaaggctccgtcgcccacgcagaggtgagtggggagggcatgtccacctgttccgtgttcgcacctgcagactaaactcaccgcaccccagggtgtggagcgactgcgtgctgagctgcaagtgaaatggagtgttacactgtagcctttacgaaaatgagcagtgaaagagttttttatatgcttttaggaaccacgcaggaatggggggcctcaggggccacgcgtgtcggctggattcccaaggtgatcttcaggccggtggttttcagcctgttgggattaggaccacttgaagggtcttaattcttttattggattaaggtattttaaaattgtttaaaacaaatacatgcttgtcatgaaagtttaggtaatgcagatatatggaacttctgtcaatatggtggattggtcaacatgggaaatcgtcccttctgcctcacacacataaaaatactggaagaggctgggcgtggtggctccgagcactttgggaggctgtggcgggtggatcacctgaggtcaggaatttgagaccagtctggccaacatgttgaaaccctgtctctacaaaaaatagaaaaatgagctgggtgtgatggtggggcgcctgtgatcccagctacttgggaggctgaggcaggagaatcgcttgaacctgggaagcagagttgcagtgagccgagtttgcagcactgcactccagcctgggcgacagagcgagactccgtctcaaaaaaaaaaaaaaaaaaatgcctgggagaaatatcacagccgaattttctagcatagttaattcaaaagcaggtggtaaagaagagacccagcagccgctccagtgaggggggtgcacactggatggcccccatcggcatcaaagcgggtgcacacggtaggggcgtgtgtgtcagcagtgacacggcaacccgggtgatctcagacactcaggcggcagagagtggaactcaactgccctcctagccgagagccacttgtccttaaaatgggaggtacaaaatccttttagctggcggagacacatggcagggaagctggg

SEQ ID NO: 43195 - DNA, 1035 bp, Homo sapiens
agaggcccagtggttgcactttgagtaaggaacagcccggcccttgtatgggccagtggccgcacagtctggcctgcaccccttgggaagttggcaggactctgggtttattgtgggaaatgatcagggccgtgtccttgctacagtgggaaagcttgccatgggcaccgctgcactgcgggttaattaggagaagaatagggcatcagtgagcaacaagaggacatttaacttgaaatataaaattagtatctatgtcgacgggaagttgagccactgagaggtttgtacttctttctgagctcgggcctctccattcgctccctggagacaagtttgagaagagccccggagcagagcgtggcctcctgccgtccaggccgggtcctggagcccctttgcccctcgaagcctgccatggctcagagtttctgcaccgctccttgcctggcagtcagagctggcacccgcgggtaggaattacaggcacaggtggtggcttgggatgaggcacgctgtcggaaaatcagtgctgtctaagaggaggtaatgagtctgtcctgggaaatgctcgggctgggacgaggtgggtgtcgtaagggccgcccgggaaggagtcctgtggagcgtgagatgtgaagtagatgagctccgagtccctgcccagcgctgccatccgattccagctgttctgcatcctgtggggcgtggtgacccatcagcacctcgtgatgcttacagaatcttctcagtgtggacggtcgaagcaagtccgtgcccctgccatgtgggtcgcacacctgctccgaacaggaacagcaccagcctgcagagaacaggagcagctgctgctgcccgggcggcgccttctgggagcgggcactcctggctttcagggcattggttgctgggggacagtgtgaaaacacagtactcagcaagccagtgccatcagggcgctcactcgcactttctcttaaagcaagtttatgtttaaaataacggtagattcttagtaaattaaaaaaaaaaaaa

SEQ ID NO: 43196 - DNA, 1030 bp, Homo sapiens
caatggttcacgcctgtaatcccagcactttgggaggctgaggcgggtggatcacaaggtcagggttcgagaccagcgtggccaacatggtgaaccctgtctgtactaaaaatacaaaaattagccaggcatggtggcaggtgcctgtaatcccagctactcaggaatcaggagaatcacttgaacccaggagggagaggttgcagtgagcccagattgtgctgttgcactccagcctggcccacggagtgagactctgtctcaaaaaaaaaaaagtatccaaaacacactgggctttgaacataataccaaattatctatctatctatatctcactgttaaaggtattgtttacatgttgcctttattgtagagtggggtccaggcacccactgggaggcttggaacagatccccagaggataaacggggactgctgtataatttttgtagcacagagttagaagtgtgtgtatatttctagaaatgcaaataaaaccaaggcctgaagagtaaaaaaatatttacatgttgaaataatattttgaatatgctaggttaataaaacattaaaatgaatttcacttgggttttactgtgactgctcaaaattttgaaactgggtggtcagctcggtgctgtccctgttagatggcgttgtctagctctcccaccaaaggccaaacagccctggcacattttctcagcggggagaggcggcgcctggttcatgcattgcgttttctgtcttcgatttgacggagtattgaagtataaaacttaagagtgctctccctctccctctccctctccctctccctccccctccctctccctctccctctccctctccctccacggtctccctctgatgccgagccaaggctggacggtactgctgccatctcggctcactgcaacctccctgcctgattctcctgcctcagcctgccgagtgcctgcgattgcaggcgcgcaccgccacgcctgactggttttcgtttttttttggtggagacggggtttcgctg

SEQ ID NO: 43197 - DNA, 1045 bp, Homo sapiens
gcagtgcatggagccctccagcagtggctcccaagggtggcggggctccccgagacaccactattgttgggggccaggggagagactcacgcagaggcccccacccagaagctcccaggcagtgccctcacttcctgggccagggccgagggtgggctgacctcctctcccacgcggggttgggtcagcaggaagctgcttgtggacagaggccttctgttcctgccccagggcctgtagccagacctctgtggccgcctctggccggaaccctccaggacgggcgcgggagggggctgcctgtccacctactgcagggggactgcccagggccccacactttccttccagaggcccagtgtgcaaggtgggggctctgcggcctcccctccccagtcgtcaccgccccctgcccaccccctcctctcctgagctctgcctggccatgtcctcgctgtctctgaggtttgctccttccccgagtcccctctctgccatcccgactgtgccatctggtccctgtctctcttgggcctccctccaccatctccgctggggtcttcctctctctctccagctctctctgtccgtccacctgcctctccccactccctctgctcccttctccgtgggattctctcctgatgtgctggatgtgcctcggctggggctccttcccttccaagtcctgcacccccccgccctccccactccatggcggaatcttgttccaggaagtaaacagtgtgatgtcggccacccaggaatttggaggggggtatacattcccaagagcccccagaggcgccggggcagaggccggctggactccatgggctgaagttgatggtcgtgggtcagttagaggggtggtgggggcaggtgtggccgggcaggggcacgcacggtggagagttggccagggcaaatcttgtgaccgacacacagacggcaaattcattccttcagccagtgttgaaagaataagttactgccacagaaatctcaccaagcacagaacaaatgcatcacacgcatttatagg

SEQ ID NO: 43198 - DNA, 1026 bp, Homo sapiens
ggccccccgcccagggccctggcagccctcggggaggccggaggtgcgtcccccgagggctggctcttgggagtcccgaggtctggtcactgcggccaggatgttgtggccagcgtgacgtgcagggccccgtttcccccacagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtctgtgtgctctctggtgtcccatgtcgccctctggccagtgagagcctcaaggaccctggccttggcttcccagccccacagtgcagggagttgagcagggtccggggtggtggagaccagggccaggctgggctctcccttgggccagcagttcccgcaggtgttgagggtcgggggatgctgcccacttggccgcccccgccccacgtcatggtctccctgtcgagtgccggccctgggccctgccgggcctcaagtcctctgcccacggggtcggcctctgttgagtgagtccggccttgtcaggctgcgtgggggactggcccagctgactggtctctctctcctgcactaaaaggatcaacaaggccctgagagcctcaactgtgggcgtccctctgtgggagctgagttggggtcccattccagaagagtccgagtagccggtggtgctgctcgtcctgcc

SEQ ID NO: 43199 - DNA, 1053 bp, Homo sapiens
atccgttctgaggtgctccgcctggtggacgccggtacggtccaggctgggcttgggcaggggctgctgactcaggggtcccgggccccttgcctgctccttgtgggcctgggcagcctccggctgtggcagaggagaagactggccgggtagcctcaggggatcctgcagaccatatgtcctggccacagcaggctgtgctggaccctgggaggagacctagggcagcctgtgctggccccgtccgagagggtcttactgtcaggctcaggggtctagagtgagaaacaggtcctcgatggaaaaaagagaaagtggtctggggttggagaggaggaggagaagtggtggggcctctgggtgggtccctgaaggatttgggggttggagctgcagccggggaccccagcaaggactgagcaaggggcctgggcccacgtaggtcagtagggctggtgcctgctcacagtgaggagacactgggggcagcttggtgagtgagtggggctggctctggaaacccatgactgccaaggggtctaggctgttgtgtgcccccggaagccaccgatggcttcggggcaagagcgccctgagcactgagagaagatagtcacagcagcctgcgtgcagcttcggaagtgtactgcgccgtgccaccataggccctctggagcgcccacccacccctggggatggggcccacacagctgccatccagggtgcaaggtggtcccgacacgctgcccccttgtgcggccccaggtctcgggtggggtcaccgagcccacgtggcccagggtctcaggtggggctgccgagtgtgcactgccccaggtctcgggtggggctgccgagtgtgcactgccccaggtcttgggtggggtcaccgagcccacgtggcccagggtctcaggtggggctgccgagtgtgcactgccccaggtcttgggtggggtcaccgagcccacgtggcccagggtctcaggtgggtggggtcactgcacacaggcagccccaggtctcgggtggggtcccgagtgcgcattgccc

SEQ ID NO: 43200 - DNA, 1048 bp, Homo sapiens
atgtgcccggttttctctctcctttctctgcagggcaccctcccccaggagacttcattgctctgggctcaaagggtcaggccaatgaatcgaaaacggcgtccaccctgctgaagccagccccttccggcctgccttctgagcgcaagcgggatgcggcggccgcgttgtccagtgcctcggccctcaccggtctcaccaaacgccccaaactctcctccacaccccctctgagtgccctggggcgcctggctgaggctgcagtggcagaaaaacgagccatttctccgtcgattaaagagccatctgtggtgccaattgaaggtaatgagtctgtggacatcccccgagaacacccctcagctcatgccgtccatcaggtgttcagggaaggccccctccaggcctagtgctgcccgtatggccgaggtcctttgggagagcggatgtttgtggcttgttcttggaagtgcttctcacgtagatgcccttatcccgtgtgtgcatctgcgtcctgcactgccagtggctgccctttgagaaccgggtcactcccttattgagttgtttgtctcatgtgtctgttggacgccccctttgtgacgggcactgtctgagccctgggggtaaaccgggcgtgacgacaccccaggtgtctgttctcaaggttgcccatcctggtgcgttcctctctcaacctgagcggaggcgatgtgtacttggttcctccttccctcctggttaccaacagagaagagttgatcccctccctgttttcagttgaaaagcagcagaacagtaaggacatcaacgggggaatgtaagcttcaccactgtcccgttctcgcagaaatgcctttaactgtgtgcctagaatcgcccctgcccctctgcgccattttcccaacgaccatttctcaaggctccgtgactccctgggagtcgctctggcagctatcgcaccagccccagcaagcctcatggtctgcagtgttttgtttctgtgggagcatctcttttgggtaatttctttgtaggagtcaaaaag

SEQ ID NO: 43201 - DNA, 1030 bp, Homo sapiens
acgtttgaacagatgtgctgtcatccaggctttgttgttccactgatagagcacagacagagaagacttagcatcattcttaagggccccaagagctcatttaccgtctccatattagcagtaagcctgttctgctttcttatcattcatgtgttcgttggaatagcccttgtgatttcctttacgaacttctcctttgcaggctagctgtgtggtgcaagagacctagcttttggcctcagttttcaacatgccttcctcactaaacctaattatctctagcttttgatttaaagtgagagacatgtgagtcttctttcacttgaacacctagaagccattctagggttattaatgggcctggtttcaatattgttgtgacggtcgtgtctcaggaaatggggaggcctaaggagaaggagagagatgggggatggctggtcagtggagcagtcagaacacacacatttatcagttaagtttgctctcttatgggcactgtttgtggagctccgaaaccattacaatggtgacatcaaagatcacagatgacagagtaccataaaagatatactagtaatgaaaaagttggaaatatatacgacacagacatgaagtgaatccacgcttttggaaaaatagtgccaatagacttgccagacacagaccttaaacttgtaaaaaatgcagtgtctgtgaggcacagtcaggccacggatgaagcgaggtgtgctcatgtgaacacagggcgaattggcttctgtgagcacgctgtatctgcttcacgttacttttaatctactgcgtcttcatagttaaaatgtgcttcttaaaagcaggatatagctgagtcttaaatatgcatagaatctgacattctctgccttttcactgggccatttacatttaaattgattactactttgattagataagtctatcatcttgttatttgttttctgtttgtcctgtctgtcctttgttcttttttcttccctctttttctgcctttcttggattgaatttttta

SEQ ID NO: 43202 - DNA, 1024 bp, Homo sapiens
acagccctgagcacccccgcctgcctgccactgtctcgacggggagggccgaccatcaggggtccaggcagcacttcataaagcaaagcttcacccggctaagacgtgtgggctgcttgggggctctgtgtctgcaaaacagtacctgtgaaaataaggaaccgtaggagacgtgggctggaaggacggctggtaaacatggcccctcctcacttggagatttgtgctgccaataacgaggacatggatgaggggcctcccacagagcagcgcttcccaagtgccgctgagtgaagaagccctcgacagcctcgcacagcatcagctccctgaccccgcatgtgcgtacgtgtgtgtgtgtgcatgtgtgtacgtgtgtgtgcatgtctgtgtgtgcacgtgtatgtgtgtgtgcatgtgtccgtgcatgtgcatttgtgtgtgtgtgtgtgtgtgtgtgtgtacatgtacacccgtgctcacaaacaggctggagaactacatgccgtcgcctctgtgcccccgctggtgtgattctgagtgactgggtgatgggtgatgagtgttatttttatatttcaaaatagtgtgagaaggaggctgtcctattgaggcacagaccagtgggcaaggaccttggtggtggggggcacacaatcctctgggggacctgggctgcccctgtggggatgtggcatcccttgggatgctgtgggcagcacagtcacctccagggcccctggcttatcctcagcaactcagaattaagtgacatcttcgtccttctctggaccagttgttttccagagcaggtcagacagagctcagcttccccatctgccaggattcagcgctgggctctcggaaccaggagcgcaaatcgctggtgctcggggtccatggtgccccttgagggctcacacagccttcccatgacccttgtcttctactcctggtagggtcttgaatcccaggagatcttgctctcccataagaaaagcagctgtgaaagcacagccgggcc

SEQ ID NO: 43203 - DNA, 1076 bp, Homo sapiens
tgattttttttaatgttaaacctaacttgcattcctaggataaaccgcactgggtccctttttatacaattgatagattcaatttcctaatttttagtgagaatttttgcatctatgatcttgtgcaatattcatctgtggtttagtttttcttgtaatgtgtttgtttgccttggtatcaggatgatgctagcctcaaaaatgaattgggaagggttccctcctcctcttttttctggaagaatttgtgtgagatatttcttccctaaatatctgatagaattcactagtgaggtcatctgggcttggcattttctctgtgggaagctttttaaattatgcatttaatttaatagatatagaactactcagatgttttttgagtcagttttggtcatttgtatcttcttgagtttttgcttattttgtgtatactgtcaaatttattggcataaaatcattcataataattcattattatccttgtattacccatagcatctgtagtgccatcccttcttccatttctgattttggcaatacatatcatctcttttttcgtcatcactctaagttttatcgatttttttatctctctcctttcagatctgtcaggttttgcttcctatatttttaatccctattttggggtacatacgcagttaagattgttatatcttcttgatcacttgcaattgtaattataattatgcaatgtctgtcttcatctcttaaatattcttgttctgaagtctgacttgagtaatattaatatagccactcctgctttcttacaattttaatatttatatatacctatctatatttctaatcttttaatctacctgtgtctgtatatttttaatggattttttgaagataacatctaattgaatcttgctttttttattcagactgataatctatgccatttatatttaatataatttttatgacattgagtttaaatctgccatcttgtcatttgttttctttttgtctcgtatattctttttttcatttttcttgcctcttttgggctgttttttggtattccatgttttctccaacattgg

SEQ ID NO: 43204 - DNA, 1035 bp, Homo sapiens
ggccctggttcacctaaggttctgcagatggacagggtctgagcaaagaaccaggcatcctgcctagagagccctctgtcagctcagctctgcagcccagacttcccctccaggctccaggctccactcctaagctgaaccatggggctgcagtggcctgggcagggagcagcggggaagatggggctgttcccagctcaccgtctctcagttccatctcttttctggatcccaggctccccatcagcagtgagatccctgcctccacagggtcctgtgagtgactgggacgccctacagcttgcctgccctcaggggccgggtgctttctgctgaccacaccgtacttcctcttgctttggaaatggcagtgaagattgtatgtgagcatccttctggggtttggtgtggggcccctgagatgggacgcacgcaggttcaagaactacactgtttgccaaattgagggcccactgtgactgcaggaagtcagtttgtagtgagcggggaaaggccaggaggctcaaggaggggaggactttggggcagcctggccatggccctttgtcatcactgtgtcgagtggcctcccttccttctgaggctccagctttcctcaagtttgggctctgcagggaggtcctagcagctccccagctcctctaaccaggacagcctcagtttctgggggccctgcagagacatcatgacctggtgcagggcttcccaaagctgtctgtggccccatctgcccagcctgggtcaccacaggtaggatccaggaacccgggtgttggcaggctcccaggaaacatggatgtcatcagcccaggtttgaggggtgctgattaggaacactgtgaggatacggaaggtgtgtccggttctcacctgtcactcctgtaggagttgtggcgagtcctagttggcctattccagcaactcttgtttaaaggaatatcctttcctgattgaattaccttggtacttttgttgaaaatcagtttgccggccaggcgaagtggctcacacctg

SEQ ID NO: 43205 - DNA, 1029 bp, Homo sapiens
gatctgggagacacactggttccagcaggctcctcattccttgctgtccagggccttccccggctcagaggcctgcagggtgggcgtcagggccagaggcgtggacggcacagattccggaactgcacaaacatgtggcgatgtcgacctaccgggtttgtcatatggatgagggggaaaggtatacaggtccagcctccccgattcgaaaacctgaagtcgggaatgttccaaaatccacagctttttttattgtgggtctgtcactcaaaggaaatgcttaatggagcgtttccgataccagattttcagattagggatgaatatttgcatgagatgcttactcaaccagtaagcacgtaatacagatattctgacaacctgaaaatctggaaatcccagacacttggtcccaagcgtttccaataagggatactcagcactcacctgtgtgtatatgtgtaagtctagtacggtctcgctttgccagatgacagggatgcatgctgaggaacgtgctggtgggcagtgttgtctttgcgggaacttcctagaatgacttgtacgagcctgggccgtgcagcctcccgcacccttgggccgcatggtttagccggctgctgccaagctgcaaaagtgtgcagtgcgtgactgtgctgaatgcagtagaccaccgtggcgcagtgctaagcatctgcgtgtctgtacgtgtttaaatatggaaaaggtgccataaacatgatgtatgaagggtggaagacggtgcacctgcgtagggtgctcaccgtgaacggagctcgcagggctggcgggtgctctgggcgagctggtgaatgagggtgagtgagtgtgaaggcctaggacatgagtgtgcacaactggagactataaatgccgtaccacttaggctacactcaactattaaaaatactgttcttttcttcaataataaatgaatggctgggcacagtggcctgtgcctataatcctaacatttggggaggctgaagtggggggatcgcttgagcc

SEQ ID NO: 43206 - DNA, 1051 bp, Homo sapiens
gttccgcaagagcgtcttccataggccactgcatccttgctgcctggaacagtgcttcatcaatcatgagttccgcaagatcgtcttccgtaggccactgcgtccttgctttctggaacggtgcctgctgctgggtcctccttcccactgcaggacgtacagcgaggctggagcctgagacggttccctgcaccctgaggctcacgtagcccggccgacctggttctgcgtgggtatagctcaggccccggggaagggcggaagtggacaggcagtgccctggggctgcactcctaagatccgtcggtacctttaaaaggttctctgcttgctctcatctgcgtgtgccccgtaacactcgaaggagtaaagaggatgtagagaaaagtaccgcgttttccttttccctccttctgaaaggcctgggccccggcatctctgtccctatccccgtgggtcacagctgtgtgctggctctccctgccctgccaaggtagaagcattttctgcgtttcaggctgtgaactgggcctcttgagataagtgctgtaaatgctcctttatcctgacatcccggccctcagtactgtaaagcctctctttcctgctagctagcctttacctaatggagcacaatttatttttattctgtcctcttcacagctgcctcctgtgattccaggaggaggcaggtgtggggctaaggtggtgagggggtggctgttcaggcaccagtgtcgtggatgccttcagccccctggtacaccccactgggccgggccctgggcagccgccgctgcatcctctctgactcccacttgaacacctgctgttcttcctcctctcttgcccctcaccgaggccttgagagcccatcagtaccaggcctgtgtccctgcatccctgcaaggtggtagcaggtacctctaagagggccggttctgcccaaagcaggggtcccaggggtgtggaggaggggcccgaggagggccggtatctaggcagaggggagttgctgcttcctaggcaggtgctcctggtcagtgtggcc

SEQ ID NO: 43207 - DNA, 1030 bp, Homo sapiens
aagaattctttgttaaatccaaggttaggagggtttcctcctctgttttcttccacaggttttacggttgggctttgcgtgggtcttggatccattgttacttagtttttgtttatggtgggaggtggggcccagcttcattctttggcatgcgccagcccattgtcccagcagcatttgttgaaaagactatttttccctatcgaaaggtcttaacacctttctcagaatcacttaacatgaacgtgtggttggttcctggactctccactgtgttgttggtctgtacgtcggtcctcatgcccacaccacaccatcctgattgcagtggctttgtagtaagttttgaaatcaggagactgagtcttcctcccgtgttccccctttgcaagcctgtggtggctcttctgagcccctgcagttccgtgtgagtttcagaatcagcttatcagttcttcagggaggccggctgagtcctgggattgtacagaatgtgcagatcagccctgggagtctctggtcccgacagcgccgggtcttctgatccgagacatgggatgtttcctaatcacctagatcccgcctagtttcctcccatgctgttttgctgcctgtgtgtttgaaatggctcctcttggtggggtgggtgcaggagtggtgctgtttgtataggacatagggccgtcctcccatcccgacactcggctgccctggagacgggcctcagcacagggctcccattacccctgcacttccagcacctgctgaaatgtgtggcgcgcgggctccgaggcatggaatggtgtgcctgactctgcgctgcccaggctgtggtcacagcagcaggctggaagtttggctgtcgcccccagccaccttggggcacggtcctgtctcacctggagcagaggtcctgggcccccaggggctcaggcgtggcctccttctggaggggccgggaatgtcccctccacttgctgagtgttggcccaggaggctcctctgtgggatgccagctgctcccaccatg

SEQ ID NO: 43208 - DNA, 1051 bp, Homo sapiens
gtatgtttaggagtccctagaacgcccccgaagcgagcttgtgtgatgtgtttcattgttaacctgagatggtggtttttggaaggaagatcacagacgacaagtcctttctcaccacgtcccatcagggagcccctgacatccacgcaacagcaggtggacctgaccgctggactgaggcgttgacagcggacctgactgccggactgaggcgtggacagtggacctgaccgctggactgaggcgttgatggtggacatgaccgctggcattgacggtggacctgaccgccggactgaggcatggacagtggacctgaccgctggactgaggcattgatggtggacatgactgctggcgttgacggtggacctgatcgccggactgaggcatggacagtggacctgaccgctggactgaggcattgacagtggacctgaccactggactgaggtgtggacggttgacctgaccaccagactgaggcgttgacagtggacctgaccgctggactgaggcgttgatgtggacaagaccgctggtgttgacggtggacctgaccgccggactgaggcgtcgacggtggacctgaccgccggattgaggcgtgctctgccgggtgcctcgtccgcgaagctgtttgcactttctccagtctcttccttggaagcgaatccctcagggcacaggcgacgctccccctctggagggatgagttctacatgtatgatgtggagttctgtgagggaggtgtctcctcttccccatttattcacttcttcatttattaccagcagtgtggactggagggagtttgccacgtgctctgtgttctgatctggtgcacgcaccaggacttgtttattaccagcagtgtggactggagggagtttcccgcgtgctctgtgttctgatctggtgcacgcaccggaacttgtttattgccagcagtgtggactggagggtgtttgccgtgtgctctgtgttctgatccggtgcatgcagcgggacttgtttcgctgcgtgatctccccgcggccggccgcgccct

SEQ ID NO: 43209 - DNA, 1047 bp, Homo sapiens
aatcaagaacaaaatcagggaaaaaaaagctcctaacacttggaatttaaaaaacaaaacccaaacagaacaaaacactgtgtcttaaacaattcttggttcaaagaagtacgattcaaaagtgcataagatgtagaaaataattgtcatgaaaacacttctcatcagagcctgtgggaaccacctaaattcacaagtttaaatatttatatcattgaacaagaaagcatgtaaatatatggattaaaccttcaacccaagaagtcagagaacaaaaggaaagtaaaccttagtgaaacaaaaaggtaggaatttgtaaagatcaaagcagaagttaataggaaagtgaaaaatggtagaaataataaataagtccaaatacctgttatttgaaataaaaccaataaaacatatgaattattcacagttctaataaaaaattgatagaaagtatcaccatccaaaataggaaacaagactaattacctggagctattgactgagcaggagcatgcgagagctttcaggcgtgctgagaattctgtgtcctgatctggacggtggatacgtaggtgaagacatgtataaaaagccatcaggctgtgcacataagattgagaagtttactgcgtgtaaattatgtatacctcgatgggaaagaaaagcaaaaattaaaaaattgagaattatgagttttgtctgatttctataaaaagaattatgaattatatctcagttccattttaataaacttaaaaatctgtgggaaatgaatgacgttttagggaaatgttacctatcaatcccaactccagaagagagagaaattttaaacagatcaattactgtagaaaaacgttgtcccaaaattgccatggctgctctcccccaccacaagaggaaagaaacagaagatgcatcaggccaagccagtttcatgggaaaattctaccagatcttcaaagcgcagatactttgagcactgtgtaaaccagttcagactgtgggaaaaggaggggaaggcattctggaagtgttgtattgaca

SEQ ID NO: 43210 - DNA, 1033 bp, Homo sapiens
gggagctgccccgctcaggccaccaggcaggcaagggaggaacggtcgcctcctccagttttcatttcattccggcctcaaggggttggaggaggcctacccatgctgcccggggccgtctgctgagtccccgattcaaatgctgatctcatccacaaaccctcccagacacacccagaaagtgttttgatctgagtaccccaggtcctgtccagtggacacatggaatgaaccgtcacagactataaagttcaacagggaggatgatgtatctgactagttaggcacccaacataggagatacagtaggtactgtctagtaggaaagtatcggtgtgaaacaaagctgagttataaaagcaaccagggtaaaacatgcacacttttctaagcctcgagagaattacacgcaaaaaagtaaactagattaaaaaggccacagaatgagatagatgtaaaagctacaaaatcgaaagcataacaacataatacaacagaaatagacacaaatccagttatagttggactaaactctcctattaaaaggaaaggacttcctgattggattgcaaagcaaaaccaaacatgttggaaagtacgggaagcaaaggcatcctggtgaagtgaacctggaaagcaggagctatgatctccatgcagtgtgagttcaagccagaagccgctcagaaacaaaggtgggcgcttttcacagtgaggttcagatgggttagccaaataacacatcaccgctgttgggaaaagcagaaatgaggaaagattcaaggcgaaattgtcaaagatgccagtagcaggatttatgtcctaatctgcgatatagcaagtgggcaaagaataatggaaaacagaaaaatacatatgtgcgtaaaacccatatcccccaaattagagaatatactcatgttaaaaggagtgcatagaaaacattcacaaagattaattgtgtattcggtaatagagaaagcctttataaattaaaataagtagaactaatacaacttcttgtgattgcagt

SEQ ID NO: 43211 - DNA, 1024 bp, Homo sapiens
gaggcccagggcgggggtctccgaggtcctgagccccatgcaccgtgcaggtcatgggtgcagggtcactgtccccagcagggagctggactgctgacatcctggccccacaaccagacccagccttgctgctccatgaggcctgttaggaggaggcggctggcttttcattgctggcttttctacccttagtgtggggtcaagcctggtgccctttggggagtgtgtcggggcaggagacccttcctgcctgggtcggggtcctgcttgggggtggccgtggtggaggagatgctctgaggtggggcctctgcctggaaggtcacctgattctgttctttaagcacgagcctgccagggagagtgaattgatttcctctgactgaaagtcccatgctgaacctttccctccgtctctccccagttccacagtccctcttgggcccacccctgtccaccccattcacagtcagtttcctgaggcaggttttaggaatggaccttggttctgtgaagcctcccgcagcccactcggtcttcgtctccatcagttgtctccatcactgggctctcggcctcgcggggcagccacactggcccctgcccaccctctggctgcccacttcccagctcctgggtcccgttgctccccagagagtggaggctgcggggtggtgggggttgtgttccctgcagtcctagaaatggggcctggcccaccacagtctcaggccgaatcctgtcttgtcttgcaggctcagctgtcgcaggccctggaggagctgggaggccagaaacaaagagcagacatggtgagtcagacgcgggagtggctgggattcagggcacctggaccctgggtctgggcagggacgcctgtccccataagcctttaggctgcaggcgccagtgcatggctgcctcttctgtcgtcggaagctgcgttgagcggggaagggtgtgtgaggagcctgagtcccatctctactagtgacaggtggcatgcgccggcggggagcacagc

SEQ ID NO: 43212 - DNA, 1113 bp, Homo sapiens
gattataagatagactattattatatacttaacaaagtctaataaaattaatacttcttttccttctagacaatccaagggtcttaaaatcctttcttctgtttacattttgctccattcgtaggctattgctataaagtactttattcatacacttacgtgtttgaaaagatactgtttttgtatattcatttatatgtacacatttctaaccctttttattcccctgtgttgcaacctgtatctctgagcatccatctgcaatcgtttttcttctgtctgcaaaataccccttgtttcctttgatacagatttaatgctgaggaattatctaattttcttggggtccggaacatatttaattcacttttatttttgaagaacagttttgctgggtataaaatcataggttatcaatgcctgtcctatccaccagcctacaaccctttgaacctatcattccactgtcttttgactcccattggttctgctcggaaacaagctgtcagtctcactgttgcttcttttaagttaatctgtcttcctctcctcttccctagctcttttgattgttctctttttggcaggagaagtgttgttgaaatgttcctctagatctataattttttaattaataaagtttgttttcgggagagtttaaggtttacagaaaaactaagaagacagcatagagctctcatatgattctttccacagcacagttttgtctgttactaaagtcttacattactgtggtatatttgttacagttcatgaaccagtactgacacattatttttaaccaaagcccatagtttacattaaagtttactctttgtgtggtgtctttctatggattttgataagttcataatatcatgtttccctcattacagtgtcatacagaatagtttgcttctattctctggaagagattttggagaattggtatcatttctcactgaagtagttggtagaattcatcagtgaagccatctaggtctggtgctttcctttttgggaggttattagtgatcaacttaatttctttcatagatacagcctgttttttttctggctgaacccagggctggggtcgtcgccaaagtgact

SEQ ID NO: 43213 - DNA, 1090 bp, Homo sapiens
attagccttatctgttcatgaaagaagtgaagcaagaaatgcatttggtgacactttgtcagtgctttgttcgagctgctatacggaaattattaatagtagaattgcattctgttacaatcgccctctaattcagtcaccatccattgaactggactttttacccagttagcaaggtaatgagtttggatgactctgaaaactttgtgacctccaccccgggcgtcactgtgggctgggggaacctcctcaggctgtgtgtggaccttccgtggagcgcggggcggggcgtagcggacatgcacctgtacacagctctgggttccgcgtttctggggcactctctgccagccaggggtgccctgcagaaatgaggctaggattacacggggagcagcttgggccaaagactcgatttccatctgctccctgaatgtggtgagcccggtgtccacaggactgtgtaggaggggacagccagcatctgccctttccagagacctttctcctggcactcgtgtctgggcgctagggatgatcttgtttctgttccttggatttttacttctcttcagctccatctgaagcttttcccctctctcatttcattgtaatcataactcgcacatcaacctcaaattaccctctatcaatcactctcttgcctagaaacttgctgggctcctcctcttctgctgccctgggtgtgtcatgcagagtgccctgcgcctgccaccaactcccaccgcccttgctctcccactgccagaaagttaggcctccaggcctctggagtccgagttgggctcacggttccatctgagtgtgtttgccctgagctgtttgtaaatgggacttacaaccacagccaagctcttcaaattatggagttccgtttaaaaaaaaaaattactgccttttaatctttttattagagcataacagacatacagaaagtgctttgtcctgagagtacatcttagagggctatgatgaaatcagtccatccatgtctcagctccacggtcgggaacacggtgtcaccagggctcccaagttcacctgccggctcctccacctcccccaaagc

SEQ ID NO: 43214 - DNA, 1060 bp, Homo sapiens
taccccgctgcccgactagggtgctggagcatggtgtctgagagcacgcgtgtgcgtcagtgtgcacatgcgtgcacccgggtgttcatgaacacacccgtgtcggtgctcagtgtgcatgcatgcacacatgagcattactgtgtgcgtgtctgtgctgcatgagctctgtgtaggagacgtgtgtgcatatctgtgttgagtgctgtgtatgtgtgtgtccatacgtgtgtacttgtgtgcgcatgtatgttgtgctgtgtgagttctgtgtgcacatgtgatcatgtgagtgtgcacgtgtgctttgtgagctgtgcatgcacatctgtgtgaactgtgcattgagcatgagtgtgcatgtatctgtactggtgagctgtgtgcacgtgagtgcacgtgtgtgattgtgcatgtgtctgtggagtcagctctctgcatatgtgagtgcacgtgtgtgagtgtgcatgtgtctgcagaggcagctctctgtatgcatgtgagtgtgcatgtctgtgctgtgtgagctctgtgtgtgcatgtgtctgagcatgcacatgtgtgagtgctgtgtgcgcacatgtgtgtgcatctgtgcttaccattctggaacactggttcttttatgcattttggcttcttttcccacgagaccctcatggaacattaagcccagcagacaaggccagccccaaccattgtgatagttattaaacagcaataaagcaggatctgtatttacagacccagagtgtgctcagactgggaggtattaaacatcatccatcatcaaatggaaaacagtcagatgcagggagtgtagaatggagttaatattcttttggttaacttcacccataaagagctaaactgcccccaataaaacaccaaggggaggaagggaggttcttccagacggaagcaatcatcggcacggtctgcagacaggcccccagggtttcctcgtgccggtgggttttctgcagcttgttacgcagctgcggctcagagcaagcggtgtctcagggtccctttccacagttctcattgcctgctttgc

SEQ ID NO: 43215 - DNA, 1077 bp, Homo sapiens
taaactaaatttcttgagtgccatcagaaggcccgtgagctggtgagctgcccccgagccttttgccacccatggtgggcatgagccacctactgagtcggctccgagtcagcagaggccatggagtgggggcccccactgtgcagggagagggtctgaccctgggcggggcaccgggaagggaggtggaggcctgaggccagccctgctggaattcctctcttctagggggaggaagcctaggagctggaatcagaaaacctgttagaacctgagctctgtcactctctcacttgtgcctggcgccagctccctttccctctctttgcctttgcttcctctctggaagaatgaagcatgcacgcctcaccccatctgcacggggagccgattcacagattacatgagggaatgctttgaaaatatttttaaattgtaatgttcaaatatatgtgtgaggtagttcatcatcaactcactcaacaaacatatggttagttctattctaaggtgatgtgtgttcctaaaagtcaccctgctacacaaaatcacattaaaaataagatgggaccctgatgaaaatggcagcatggttgacgcggtcagtggctggacacaggcaagtgtgacaatcggcacagctcttcgcctcgagaaggcctggcgctggcttggggaagtgggagtggtggcttgtgagtcactgtggagtggggagagcacctgaagctggaggggtgtggcacagggggctcagccaggctcgggaggctcccatcacagctccgttcagctgagtgcggttttctgcattcgtcttggaggaggttcttcacagaggggcggagggggactttttggccatcactcaacatcctatgggacagccccttcctggctgacccacctgcctgccctgtgccaggccttatgcagtgtggttgatgcttattaccattcatcaaatttatttcctgacaaatcctatgttaaatacctggcatgggacctgcagtgagtgggcattcgatgtatagcggtcactgctggcattcgtcagagtaacttctcatttca

SEQ ID NO: 43216 - DNA, 1022 bp, Homo sapiens
tgccccctcccagcagcctgccagcctgcagattccgtagcgcctagaggtgccagctccatgggctgctgccctgttctcagaggcctgggtccaggccctccagggtccccatgcagacaccagcatggcctccctcagcagcctcagttcctgttccatggggcccatctctgagtgtctacattttaatgatgtcagcctctgccccgtgttcccacagcccaagggctgggagctgcttcctgaagtcactgcgtccttggcgcctgagggtcttccttctgctctcggtgacctcagtacctgcacccgccgtgagattctctgctcatgccacacgcgtggcttctttgcttgagattcccaccccagtagaatggaggcccagcgagcccaggctggctgcggtgttccgtgctgccatctctgctgcctggaacggcatgtggccgtcctcacccacatcccgtgtgctgaacagactgggtagactcgcctgccagtcaggtgtgagtggcaaacatcccggacatggttcttggcgagcattccacagtgtcgtctccttgtcacgtcttggtgttggatttttacagtctagttctgttgttcagaagatttcagtgtcagccatcaggccttggggatgtggccctgatgacgcgggcccgagtgcttgcacctggacggtcctggagtgggtgtctctctgctgcccacgccgtccctcagccgggaatgtgtgttgctctggttcacttctcccatctccgttcatgatgtggatttcactgccaggaaggagaggtttgcttcacaacctggcggatgagcttttccagcctgtgctcagccccacgcccctatgcctctgtctaccctctggggtgctgcagaacacacgcttcacgctacatcctgcagccactgcatttcctcagaccgggtctgtaaggaagcccaggttcagctgctcgatgcttgacagccagacacgagaggcgagagtggcggaggaa

SEQ ID NO: 43217 - DNA, 1868 bp, Homo sapiens
acctcctccatgctcttctcaaagtgatgttgctttttcttgttttaaaactttttcctgaactcagcttgtaactcttaggattcctggccacatctcccgtcttcctgcacgtgatttctctgccacccttgcttttagtcgcagaagataacagcaattgtgctgggcgcggtggctcatgcctgtaatcccagcaatttgggaggccgaggcaggtggatcaactgaggtcaagagttcgagaccagcctggccaacacagtgaaaccctgtctctactgaaaatacaaaaaaaattagctgggtgtggtggcaggcaactgtaatcccagctactctggaggctgaggcagaattgcttgaacctgggaggcggaggttgcagtgagccgagagcgtgccattgcactccagctctgggggacaagaacgagactttgtctccaaaaagaaaaaaaaagaaaaagagcaattgtggctggcctgtctccctgcctgcagcgtttacggctttcccatgggcagaggccgtgtgtggctccgtccccagccggctgtgctgtctctgtcgtgctccttggcactgactgactgacctgtctggagcctccaattaaaggtcactggcagcacttcccctaattaccatgccataaggacttggcaggttttgtggctgtggtgtgagcgagggcgtgcctgtgcttcagtgatgcgttacccagtgctgagttgttgagctgcaccttcctttggatgggatgcattttggggaggaggacggagaatctgagcttcttccctaccaggcatcttgtcctcactgggcctgtggggagggaggggctcatccttaggagctcagttgcttgtctttaggagctccttggggctgctggccaggagggagggaggtgacgggtcttgccgtcctcccccgcagcgtggagtcctcccgggcagggtgggattcctgggggtaggtggagctgcgcacggaggtgatgggtctcaccatcctccaggccttcatacatgcctgatgggcctgtgaagttggcgggagtgggcagtcggcgccctcgtacgcacctggtggtcctgtgaagctgcatctgccgtgagcgtccagtgggtcttcagaggttaggcggtcactggatgacccagcaacttcccttctaagtgcgcacccaagagaattgataacatgtttgcacgaacactcgtgtcatcgttcatagcagcattgctcatagtagccaagagatggggccaacccaaatgcccctcagctgtgactaaaaacaacacggctgtccacccagcgaggagttattgagccataagagatggaggctgatgtatgctgcagcagggactggccttgaagacatgatgccaagtcaattcaacagtatgaaaggccaccacctgtatgatgacattaatatgaagtgcccagaataggcaaagtcccgaactcaaagcagggcattcctgagacactgccgtggcctcatgtgctcactgtgggcagaaatatcagagtggccactgccctgggagaaccaggtggccgagaggcaatggcggctgcaggcagggacagctacatgcgctgctctcctggggtgtgtactgcgtggctgtgcggcggggagacagaccacacggtgaggtgggagggtggagcttgttagcaggcaccgttacttgctccgttacacttgtcttttgttaaccttttctacctttgagcttctttgaggacagtcaccattgtgtctgctttgcctggaatggtggctgatacacagtgggtgcttgaggtgagcgtggagttacggttctgagacccgtgg

SEQ ID NO: 43218 - DNA, 1029 bp, Homo sapiens
gctgcgttctggacccccgggcccctgcccaggtctgcactcagctgtctctcagccagggccaggagggtctccatcacgagtcctcctgggggctgaagggtgactggctcccagctgagagagccggctgcagcatggactcatgacagctggggaggggcagccctgcagaagggactgaatggtgactttcctctctcaggtttcgtggaggccctacagcccatgcgggacaacacgttccagtgcagctgcaggcgtcttttgcgggatgggccgagagtgtgacgggctatgctagcctgggtctggtgggctggagaggagggaggcggtctcctaggagggatttgtgcccctggcctgccttctccccccacccctgggagagtggagctcacgtgtcctccttggtgttaggcagggttggagagggagcctcggagagcctgctggcttggcacaggtttccaggagcgcatgtgggaagggcagggtggggccgggcctgggaaagggggagagtgagtgaccatggccgtctccagggatgggcatgtatatccgatagagaaggaagggcagggtggggccgggcctgggaagtggggagtgtgagtgaccatggccgtctccagggatggacatgtggatccgatagagaagcggcctgccgtgctcgcacctttcacgcaaggcaccgacgcagtggaggggtgctgccgatgtgccagcactaagggcccaattcctagcctaggcgtaatggggcaagggccctgtgctgggggtgggaggcgggactgtgtgctgggcagggtggaggggcggggctgtgtgatggctggcgctgtgtgtgatagataggtctggggggtggggcttcgtgctgggcagaatggaggggcggggccatgtgtggggcaggggcggggccatatgtggggcaggggcaggggcagggctgaggtgttggtgccctttggttgtggggccgcagctggatagggctctgggactgtgctc

SEQ ID NO: 43219 - DNA, 1072 bp, Homo sapiens
gtagcttttattaattggtgaagcccgtcacagatctgaaagcatcttaatagtctgaaatgatggctcttcagcaagaaaaatttgatttgggacaaaagggagacacttgagacccaaaatgacttggctgtgttgaggatgggaaggaggccttcatctgccgcacgtctgagtcactccagagttttctccactgccagtgtgagtcagagcgaatcactgttgggttgtgacttcagaagaagtgaactctgtctcaggctgtattaatagaagtagatgcttcacaggagaggaggtgtctgtgcgagtcacagccctgcggggtctgatttccgctttgggcgtggcttctgagccgggacctcgaggcgccaagggaacaggagcagccgggcagctgctcgcttggttgtgcctgctgtgtaccgaggcgtggggcatggcggcacggctgtgagcgcacagtccagccacagaaggaggcttcaagaatctttgcggtgctgccatctggacatctgtgtcattgaagtcacaggaggaggcttcaagaatcttcgaggtgctgccatctggacatctgtgtcattttgataacgtgtgtgagatcagtggaggggagccttaggaaaatcggctgtggtttaataaactgaacttcccgctgctttgagccggagcctcctggactggaaaggcgtgggcctcatggccacctccggcctgcgcagctgggtctgcactctcacaactgtgctgagcccacgcttgtgcccttactagtggcctgacctctgcgctgtggagaagggtggatattgtcgccaactctcagacttcttgtgtgtgttcagaaagtacccaaacggattcaaaggaataattagcgtatcctgtaagatatgaatcttaattcctaaattacatatttagcagattgtccaaaatagcacttgtaatggcaacattcaattagtttaaaaaatgtatattattgcaacactcgccatgagttttatttagaggtttctaaatataatgctataaaaacacagaagtgtttaaa

SEQ ID NO: 43220 - DNA, 1066 bp, Homo sapiens
aagctcacctgggaggggcgctgggtggacggcggccgtcaccacccacactgacgccatggcctgcacatgtgcagctctggacagatcctgcgccttgacttcccagctgcgcctgggggtgagctttagcaacccttcacccgtgcacctgcacaggtggcagtcgtggctctggcactggggctgacttgccagctgcttggaccaaggctgcatccttcctgcctgagtctcacctgcctggagcaggccagcgtcaactccctggtttgtgattctgggacctggtgattggctgtttttttttttgaaacagagtctcgctctgtcgcccaggctggagtgaagtggcctgattttggctcatggcaacctccgcctcccgggttcaagtgattcccctgcctcagcctcccgagtagctgggacctggctgattttgtatttttagtagtaacggggtttgtccgtgttaggctggtctcgaactcccaacctcaggtgatctgcctgcctcggcctactaaacttttaggattacaagcgtgaaccactgcacccagccagggattggctgttttaagtaacagttatcaaggtgctagataatattttaagacactttgaggtatgagattaggcaaggcacacgaggtggacaggtctgacgcgggcagtctgagcatttctccagcccccgcgggtttcctctgtcccagccctctggccacatgcggggtggccactgctccgacctctcttggtgatggcttttctgtggatgacatgagacagtggcagttctgcttgtccctccagacaagccaggaagacacttttaaaactcaaggccttttcccaagagttcctctgtccctccagtctccccctccccaccccagaagctacttttaacacccagggtcttttccccagtgtcttggtgcgtcttggctctctagcccttctgtgcgcctttgccggtccctcaggtgtccacgtgtccccacatctggctgctgcacgggtctgtgttcctgctgtgccagcccctgcccggtgc

SEQ ID NO: 43221 - DNA, 1027 bp, Homo sapiens
taaaaagcgttttatttatcgaatgtctctcagtgtcagggcctttcatccatttgttctcatcatgaagttccgagaggtggacactgtcttaatctctcaggtgcgagcagaagtctcttgcttgaggtcacagccgctggtcggagtcagttcagaccggctctggggccattgccagctgcgtgcctgcgtgggtagtggggttctgaggccccagcaactccaccctaggctttctcattcctagcaggcgtctgctcccctgacgcccacagtgccggctgctcttgcacgtttcccggagtgcaggggtctttggtgggcgtgagattgtaattgcaggtgggttcctgcgggttcctcctctccgcaggtgggttcctgtgggtccgctcctctctgcaggtgggttcctgtgggtctcctcctctcttgccttttttccccaccctagaccccaggtcgtttctgctccctcattgcccacctacaccaggttcctgacgtctggaccttggtctttcctaccggtcggtgtggtcgggcccgctcccccgtgtgcagctgctcctccgtggcacagcacgaagcagcttcccaagaggctgtgtgtccattgccctcaggagaatcccctctggagcaagtgtgctgggctgtccctgctgccctctccttgccccttgggtgctccatcaggggccccactctacagcctcctgtgtcttgctggggctgggtgagttgccgctcctttgtgcccctctgatcacttcagattttcgtccatctcccccttgtcataagtaggggagggcggggacgtcttctctgtggcactcccatgactagcaaaggcccgtgggctcatgccagccctgagcacctctcttctggaacaagcgggtcaggccagcactgtggaagactgtccccaaagtggggtcactgagaggccccctccaggagagtgttcagatgtcttcatcccacccgcgtctgctctgttcttccctgggaacga

SEQ ID NO: 43222 - DNA, 1029 bp, Homo sapiens
agaggtgtggtgtttggtctctcctagttatttacggaacaagagctaagaggaagagagagtcgcggacacgctcccagcttcggcctccggggcttaactttttccccctggcataataaactgagagggtcctgacattttattttcttttacaagtaggagtgataggacacacctttggaattgagtttatgtttggaatcattggggtcccagagagagagagaggcccaagactatgtgggaagctggtctcctttcccagacctgccgcagacgacgtagagagttaagctctggcctctcaattgcttccttattccaaatttctcggtctgttcatctggtgtgcccctggggaactcctgggagttgggggctgtaatggcgtggagagagctctgggcttggggacttggcctcgaggtgctgtgtgtccaggctagcttttctctagccccaggacgtggtgactgaaatatttcagcggggaggcacctgaatgctgctggcacagctccctggacctctcaggtgagctccatggctgcgcccagccaggcacctgctgcgggccgaaggcagggcagggaaatccaagaggagggcatttgcctcctgacatgtggaggtgcttttgatgcagtgaggcgcatcggggcagccaggtggcatttcctgcacccacttggtgctggagtctgtctgcctgcccaggtgcttttaaccccatccctgcccctctgttgggtagtgttttcttcacccttctgctgggccccagaaggacagctttttggactggttgggagcttcctggcagcgggtgccatgggaaccatgagtccgtctgcacctgctgacccagctgcctgcctgtgtgcccctccgacggtggtggctgtgttgtgcaccttccttgtgtgtagacaggatcctgggggaggccgttggctcgagcctggggtgcagagagcactccttggactgtctctgacatgcgtgtaaaaataactgcatttgttt

SEQ ID NO: 43223 - DNA, 1025 bp, Homo sapiens
tgtcaacctgagatttggaggggtcgggaaccacacagtaacagtgtccttccatgggtgaatggataaaagatggtatgtccattcactcaaatactgttctgagctaaaaagaaatgagctaccaagctgtgaaaagacgtggaagaatcttaaatatatattgcacagtgaaagaggacagtctgcaaaggcggtgtactgtgggatttctcctccgtggtattctggaaaaggcagaactgtggacacagtaaaaagatcggtggttgccagggatggacaagagggatgcgcaggcggacccagaggatttttggggaatgaacctactcttcacgcggccgtgatggtggacacgcagtcgcacgcagcagtggaccgactgcacgcggccgtgatggtggacgcgcggtcgcacgcagcagtgaaccgactgcacgcggccgtgatggtggacgcgcggtcgcacagggactgcagacatgcgttcgtctaaacccgagaatgtaagacatgacaagtgagcccacgtgtccactgtggacttgggttcatcagttgtaatgaatggactgcagtcgtgcacggtgcaggggaatctgcctgggggctgaagggtagatgagaactctcatttctcctcagttttcctgtaaacctataattgcttgaaaaaagaatatctgtaaatttaaaacaaaaattagcaagtaagatgaggctagagagagctgtcccaggggtcagattgagacaaaatgcagttggggccagcttcctcctgagtcagcctcactgactgcttggagaagagagggaccacgctgagcgtcaggaggcagcgccgcggcgggtctacgaggcacatctttcaccagcctttccattagaggcacctgagcagccctccatcatttcacgtgtgcatggtcaggcccttgtggggggctcacaggacttgtgtgactgccagttgccgaaagaaggaagcaggtcccttgtcatgaccagagagaccccag

SEQ ID NO: 43224 - DNA, 1048 bp, Homo sapiens
cagtgagcagatgccgagccggaagccatcacctcccttgtttgaggaagagaaaatgacaccatatctcggagttagctgctgggccaccaaccagcctggagcaagaaggaattttcctagcattgagctatagttttgaccccttttactggtgaagcacagttccaaacgctgctgtgagctggactgaagtttctgtctgaatgtttctgcgctcttaggactggaggctggaagccccacggtggcacctgtgctgcattctggtcttggggctggagttggtagaggcaagaagcttctggaactctcagtgtaggacttactgctttccagggttgcgaggagcctgcttgttagctttatgcgggtttgctcaggtgctgcactggaattcctgtcttacagcagagagagtgtctgtggggctgcttgaggattcagcgggatgacgttggtaacgtgcctggtgcagcagctctcggcagtccccgggacgtggtgctgtgacgaagggtccggggctggctgtggagccaggagcaggcagggctctcagtgggcagcggggcagcctacagggcactggccgtaaggcgctccaggagggtggggtgcttgagtgcattgcagcctgggggttgggtcagaaccaccaaaccttgcctcctgtgtgtttctcccttcctttagccgtggacagatggggcgtcattggtcactggtgtgagcagagcgtgtcagagatcctgggcctctttaccttggagcaggagcttcatggcagtgtaggggagcctggcctggtttacgctcaagcctcgtttcggctcttagaatctgagaatggacctcctggttgtggggctgaggacagggcatactgttcagaatcagtgggtggatctggtgcgccctctgctcacgcttcacacagggcaccccggggctgccctgtagcctcccttccctttccgggccctcttagtctccttggcccttagggacccaagcacccctctgcctggcgtccccagctctgccg

SEQ ID NO: 43225 - DNA, 1061 bp, Homo sapiens
taataatttattaatagccagaaggaggtttcttattttgggggctgatgtcactttgaaaattggcttttagaagcatctggttgtgttggacataatcacatcaatttactgaaaaacctcaaatgataaagattgccttttgctttcaaagccgctgtcagatgaaacaggcattaaaagtgatttgaagttaaagcgttcacactttaccaggcgatcctcatcattttactttggaaatgaaacagaatgaactattaaaggaaaggaaagttgcctgtacttttctcccaccaaacagggaggtgcttcctaaaattatttgccttgaccagcagcagcaggcccatctctgtgtccagggccacacggaagggaacattcgcatctgcatgctgcccatgttgccttcgctgtggtcagagatgtggattgagcccatggggggattggtttgggaatggggtctctgtctcagggagcagcctctacagtgggcaggtggtcctcacaaccccagctgtggctggcctctcaggacctgtgggctccctctgagagctggggcacccgccctggggaagggtgagtcttggggcatcccatggacgcgcttggtgctccgtcctgttctgtgaaatggggtcttgggggtgagacgaggtcctcagtactgcgctggtctgggaggccaaagggagaagctgccctgaaatcctgggttctcacaagcgtttccagcttgctttcatgtgtgtgtctgtatgctggcttctgtcccacgtgtggcttattgccctgtgtgggcttctttagccaaggtgcaggctccagatggcgctggtcacccgtcgccaggagcgctggagacgcttccctgagatggggcagtggagaggcgcaggaggcctctgggcgtgaggttggagctcccggtccctcttgcctgcaggtcctggggggcggctggtctgctccttgctggtcatgtgacttgggcaggcacctggtcctctcttcatctctgtgagctgaaaggtactggcagtaacgactgg

SEQ ID NO: 43226 - DNA, 1071 bp, Homo sapiens
ccatttcatcttttctttttctgatatggagtgctctgaaaccattgccttaaacccattctgtttccactagctaaagctcatacacttcatccccagagagcccattttcttttatttatttatttaccatttatttatttttatacataatattttacatatttatggagtacctgtgatattttcttacgtgcacagaatgtggaatgggcaagtttagggtatttggggtaaccatcactttgagtatttatcatttccacgtattgggaaaaattctggttctcttctagctactttgaattatacaatacactgttaactctagtcaccctcctcttctgtggaacaactgaatttatacctttcatctaactgtatgttcgtacccattaactcaactctcttcatctgtggttccgctcacccagacctttcaatccactagttcctgtcattctactctctgcctttaggaggtgaatttccacagctcccatgagtgaagacgtgcagtttctttctgttcctggtggtttcacctgacacggtcacctcccattccagccacgttgttacaaatgacaggctctcattctttctttttttttgagatggagtcttgctctgttgccaggctggagtgcagtggcgtcatcttggctcactacaacctctgactccctggttcaagtgattctcctgcctcagcctcctgagtagctgggattacaggcgtgtgccaccacgcctggctaatttttgtatttttagtagagatggagtttcaccatgttggccgggctggtctcgaactcctgacctcctgatccacctgcctcggcctcccaaagcggtgggattacaggcgtgagccaccgcgctcggcccagctcttgttctttcttacggccggatagcattccactgtgtgtacatccccattttctttatccattcgtctgtcgatagacacaggttaattccgtatctttgccatctttgctgtgataaacatgggaatgcaggtatctttttgatacagtgatttcctttgagtaaataccc

SEQ ID NO: 43227 - DNA, 1135 bp, Homo sapiens
acaagccctgcagagacagcctgtgtcgcttgggttgtgttccctgccttccgcagggctctggctggagccccagcctcagcagttttggactgtggtcctaggccctgtggatttctattctttgaaagcttgaggtgtcttgtttgctaattagtttgatggctgttgctgtttcattcattttccacctcggagtcctctgggtctccagtttttcagactcggtgaaactggcactttgggcttcagctagagccccaacatctgctattagccccaaaatagctgtggcttgggctggagctgctctcgcctcggaaggaaagcagtaggccggactccccacagccctctgctgctctgcgtgcagctgggcttgagtcaaaattcagctgcagatagaacaaaaagactttcttccccttgaaaacccaccagttagaatttaaaaggcttcgcagctgaagcccgcgtgttcagcagcagatgtcacagcttggactgcagttggaactgtcactgccgtgtcatctccgagctgaggctcctgaggcctctgaatgccttccactttgtagttggtgaagtgcgggtttcagaatggactgtcgggagttattcttaggccgtaataatacttggcacggctcctcctggttacgagcacttagctaatccccagagcacccttggtaaacatctctgagtagctttaaccacacacaggtcaggaggcttctggaaaataaacactcttcctgccagttggaggtgttggggctctggtcttggatttgatgtgtggcgaaggctgcaattgtttaataacccttcatgattcaacagctcttcaagaactttcctctgttcttgtgtggagctcgtgacagccagtggtggtggagctccagccctctcttcccacaggcacaagccgggttcctgagtcccagggcttctcgggaggtgtctgccctcctctttcagacaccctctgccctgtgtcccagggccctgggcctgtgctgcactgagcagagactgtaggggaccggctctcccactcctcccagatgggcagcgtcttccgtgtcgggagcatgctgtgctgcttttctcttctcagtctctt

SEQ ID NO: 43228 - DNA, 1028 bp, Homo sapiens
gctgaggcaggagaatcacttgaacctggtaggtggagcttgcagtgagctgagattgtgccactgcactccagcgtgggggacagagcgagagtccgtctcagagaaaaaaaaaaaaaaagaaaaagaaaatagttttgatgttacaagactgcctagaatggtgtctgcagaccacacttagtgaactgttgtcctagcgcttagtccctcaaggcgagaagaggctcacaagttggactcacatgtgatcctacagctctgtgacatgcttttcaaaaatattgtacaggataatgtaaatccatcctcactacaaagaaagctcaaacagtacagaattaaagtgaaactttcttggatttctctgctttttcaaattctgctgtatcccaggttaacattagcagtttgctataagtccttacataatttttatgtgcatggacgtcttacgtacataacaaatggcatcatacggcctgtattgttatattattttcccttggattgagttacttgaaatgtctggtgtttactctttagtagccattattccatcgtagaatgcacatattttaactatttccttattagcatacactacagttgttgccaattttttctttttgctattaacacacagatttagtgaataccatttcattaaacatattttttaagtgtatctgaaacattctttttattgatgggaatgctaagacatagagtatgaatatttaacactttaataatttttgccaaattacgttccaaaattatacttctgttaacagtacttaagattgcccatttttctgataacattcattgatgttgttagtgtttccgatttttgccctttacttaaagtcagctgctgtattcttagcacagtgctttctgtgacagatgtttcagatgacagtgcttcctgcctgcaggctcatctgtctgccctggtagctttcaggctctcaggcaccctccctaatggaccgactggggtcaagggctctgaaaatgct

SEQ ID NO: 43229 - DNA, 1105 bp, Homo sapiens
aatcatgtgtctgtcctttctccagtatggtaaggtcgtaattactgtcacttcctaatactctttgaaagaacatagtaagccctccagctttttctttgtaagaattgtcttggctattttagtttttttattttcagataaattttagatttagctttcagtttgttttctttccccccatttactttttatttcgtttattttttcttgccttagtgcactcactgggacctccagtgcagttttacctgggcatggtgagaatggctgtcctggccttgtcagccttagagggaaagcgtttagattttcctgaagcatgaggttagttttagggtcttgcgagatactgttcatcaggttgaggaggatgcttttcttttccccgatttgttgtattgggtcaaatacatatacaataaaattgactgttaactgtttttaagtgtacagttcagtagctttaagaacattcatattgctgtgcaaccatcaccaccatccacctccaaaactttatcttcccaaagccaaactctgtacccattaaacgctcgctccctgtgctcccccgttggctctaggacccaccattctgcttcctgcctctgtgattttttactacagtagggacctcatagaaggagaatcatgaaatatttgtccttatgtgactggcttatttcacttaacataatgtcctcagggatcatccatgttgtggcatgtgccaaaatgtcctttctttctaaggctgagtaatattctgttgtatggatagacgatccgttcttcttatccagtcacctgttgatggacacttaggttgcttccacattgtagctactgtgaataatgctgctctgaacacgagcgggcagatatctcttagagcccctgctttcaacctgctggatcctgtggttcaacttttaactattttaggagccactacattgctttccacagtggctgtaccattttacgttctcatcagcagtgcacaggagttccagtttctccacatcatcaccatgtgatgtgattttttttttggtggtagccatcctaatgagtgtgaggtggtgtcttgttctggctt

SEQ ID NO: 43230 - DNA, 1069 bp, Homo sapiens
tgcctgttgcgacttcctagtggcaggtggaggtaacaggctcccagcgtacttgccctcagtctggctgtcaccgtggttttgtttcgtctggaattatgtgggaatggaatcatacgtcatgcagtcatttgtgtctggtgatttcactggcagaatgttttctgaaaagcattcattcacatttgttgcttgtatcggttgtccttgttatatcgaacggatataccataatttttaatccggttttttgctcttgcagataaagattctgtgaacatttgtattgaagtctctttatgtatgttttcctgtctcttgggataatacctaggagtggggcctctgggtgatatggtatgttttaattttagaaaaagctgatgagccaaagtggctgcctaattctgtcccctggccacccgtgtgtgagaattccgctggccccacatcccgagctctttcattgaattccgctggccccgcatcccgaatgcattcattggccaccttcactttagccatcctggtgggtgtgtgcggtatttccttgtggccttcattcctgttgccctggtgactaatgatgttgaacatctactcatgtacttaacttgacggccatatatcttcttttgtgaagtgtcttttcaaagtcttttccccattttttaattggactgtcatcttctgagttggcagagtactatatatattcatgacagagtcttttgtcagatgtatggtgaatattttctcccggtacgtggcttccttttcattttcttagtgtcttttgaagggtaaaaacttttaattttgctaagtctgatttatcaattcattttctttatggtttgtgttttttgtatctgcctaacccaagcttttagaaactttctagctttaactttactgttaattttgagttaatttttgtgtgtagtgtggtcacagttgagggtcgctttcctgccccacaatacgtatgtctgtttcccatttgaatttccttggcacctctgatgaaagcctgtcagccatacattcatgggcctttgctcgaggt

SEQ ID NO: 43231 - DNA, 1107 bp, Homo sapiens
tttccactgttatccaggtgcagagagctctgatctcccacgatcggaagtaccgtgtgcgtgtcttacctgggcagaatgcagagaccttcactggcagctgtgtgtggaccctggggctctgttacacagccaggtgctgaggagcagggctccgagccaggccagcgaaccttccttagaccccctgtgtgcaggcctggtgcctggtgtcgggggcccagtggagaacaagatccggctgttgccatgggactttcgtctggtggggagtcctgaggaggatgtggatgaggtggagaagaggttccaggtgaacgcaagtgtccaccctgcattccagggtggcaggcggcccggggcgggtgtggggtggttgggtgggcgccccgcgtgctatgttagcgtagggtggtgcacacctggccggcaggccttggtcccgctcttcaccctccacctgtcgtgggtgcgccccgggaggggtggaggatggagggcaggcgtgggaagagctctgagacccttggcttcatggagagtgttgggcagttacccctcccttgccctcgggcctttgtgagtgtggcttcctggaactctgggggatttgtcaccagtgactgcagggggctctcccatccctttcatccaggcttcactgtctgccctaagctggggactggtccagctgacctggatggtgcggagtgtgggccctgctggccagcatggcgttgggaagcacctaggtgggtggtgggttgggttgtggccttaccgcggagtctgggctgcagctgagaaagccgtctcctaggaccaggaatctgggtttgggaggctggaggtcttggcccagcagttcagtggctgcccggtgtgtctgcctggcctggccctcgtctggtttccgttgtctgggaggcacccctgcccgtgccaggcggggcactgcgggggcgcggatgcggagtggaagactgctgatttaggaatcgaaactccagggacatccgtgtagcagagtgattctaagatgattaagaaaaccatcaatgatttaaagaaagtgttcactgcagtccttattgagcggtttgccgc

SEQ ID NO: 43232 - DNA, 1029 bp, Homo sapiens
cagtttcaaaaaagaacaagttatacagcttacactggccaatttcaagacacgttgtaaattgcataaattgagacactgtggtattaagtatagacatgtaaatcaggagaacagagtagaatgttcagaaatgattgaagaatacagtgttgattgttgtcaaagtgtccagataattcagtgggagaaagaatcttttcaccgagggtggtaaaccagtaggctcttcgtggtgaggatgagccttaacacctgtctcatgctggacacaagatttaactcaaatgacgcatagacctatgtgtaaaagtcacaaaatctggaagctagggtttggcaaagaggtcttacaatacaacgaacatgaaccataaatgaaaaaattgataaattagacttcatcaaaattgaaaacttctgctctcaaaagatacagtgaaaaggcagaccatagactaggaaaatatttgcgagatattaacatgtatctgaccaaagatgtgctccaggatagagaaggaactcttacaaattagtaagattaccatagtttaaaaaatggtcaaaagacttttaacagatactttattatttatttatttttttggagatggaatcttgctctgtcgcccaggctggagtatagtggcatgatcttggctcactgcaacctccgcctcccaggttcaagcaatcctccagcctcagcctcctgagtagctggggttccaggcgtgcaccaccacacccggctaatttttgtattttaatagagacaggtttcaccatgttggccaggctagtctcaaactcctgacctcaggtgatctgcctgccttggcctcccaaagcactgggattacaggtgtgagccactgtacccggcctgcttttaacagatactttacaagagaagatatataggtggtaaataaggacatgaaaagatggtcaacattgttagttattaggggaatgcaaattaagactgtaatcgcccaacagggttcttcttgctgcccagaa

SEQ ID NO: 43233 - DNA, 1032 bp, Homo sapiens
acctttcttctttgttgactcccaggttgatgcttcactgttgtggtgaagtaaaccgtacatattgtgggcatgtggggagcacgcagcccccatgcgggccttcccagagcggcgtggggtggacagcggtgataggcttcagcaggccctaagctgggcacgttctcagggacagggaaatgagtgctgaggcctccttgtttgcggagggtgccgcccagccaggcccacccaggtcgtttgctgtgtgagtttgccattgtcctgtcctgggtgcgtggtccccagggctgacatcacgcccgtgtgtttccgtgtgttaacttacagtgatgcttctcagggtctgtccggcttttcacattggctcgacccacgtgctctttctttctctgaggacacctggggttttctgagcttttccagagggttagggtcctcagaaggtcgcctggtgggagtggtcaggaggaagcctggcggttctgtcgcgtgcgggttccatgatgtcaggcagacctgctgtcctggaggctgccagaggggctgctggctttgctcaggggccgcctccccaggggcgctcctgcccgtgccgcgtgctcccgttccaagcgcacggcctccccagcaggtaccgccctgccccttgcacagcctccgtctttgtcctgttggttggccagtgccttgctgtggtgtgagggcgatgtcgctagcaaacagccgtcatggtagcattggggtggctagggagggatgacaggagccacggttggagggaagaccgaagtgatggtgtggcgggtatgtggatgtctgatgggactttgggagcgtggggcactggcacagagactgccaggtgccaggcctgagagtccgggcccatcttggctggtggaggcttttgcttctgaagccgcctcaccaagcctcctttccagggcccctggctggggcccggtctcctctgtcagctcctgggtggcttgtggcaggctctgggctgtgctgctctggagcacc

SEQ ID NO: 43234 - DNA, 1052 bp, Homo sapiens
gcctctcaaagtactgggattacaggtgtgagccaccacacccaacctaaagagaagattctgactgagtaggtctggggtgtagtctgcgactctgcatttgttaagtgccgggagatgctgcactgcaaggctctgggccacgtgaagagtcagtgactctgccttttcctccagctgagcaggtcgtacccaaaggccggctctggaactatttggcaagtcttctggggctctttgaggctcagctaacctgtaatcactagccctgtgtggtaggcagacttctgagagggcccccaggagctcagctcacctgtaatcactagtcctgtgtggcaggcagacttctgagagggcccccagaggctcagctcacctgtaatcactaaccctgtgtggtaggcaggcttctgagagggcccccagattccaggctccttgtgcacactcaccttcctactgcctcccaggtttcagtccaatactgagtaggtttcattgctgtgggattgtgcagatgtaattaaggtctaagatctgttgaccttgagatagggagattacgtgggtgggcttgatccactccctggtgggcttgatgtactcacctgagccctttaagtctgagtccagacgtccgaggccgagcagtcaagagacatagcaggagagggatttgatgagggagattggacgtggttgactttggagatggagagggccgtgtggcaagggatgtgggcagcacctaggagttgatggctgtactgggctggcagccagtcgggaaggagacctcattctccatctctgagctccacgtgagaacatgtcctggccgactgcattgatttttagtctgggagaccctggtcagagaatgcagccacctacgtctggacttccgacccacggagccgttggctggtaaataaatgggtggcattcgaggccgttgccttcactaatatgcttaatgtcatctcaaaagacgtcttcctcttcccaggctttttcaccttcccgtttcctgcccctcccctgttccc

SEQ ID NO: 43235 - DNA, 1050 bp, Homo sapiens
cagtctctgtaatcgcgtgagtcagtttccccaataaagcccttctcttgtgtctgtctctgtgtcctgttggctctgtgtctctggagaaccctcttacagtgcagttgggggacgtgccacctgagtgctgagccccgcctcccgggcgccagctgtccatctgtccatgtgcaactgagactcaattggtggcttgctggtggggatttggtggcatgcttccttgcttccattttttgtctggtaaattggcagcatggctcccagttgccattgaagaatgtggttacaggcatgggtgtattatgagctccaatgtgcgttaggggagtggggctgtccagaggctctgctgactgcacggctgatggcacgtggaaaggctgcccctgaccagtcctttgtctgtccccggaaggaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcaggtgagtggcatgtgcctgggtgggagtctgctctggggagaccctgggcccgggcaggacctcttccagtcttctgtagttgaggtgggtcggtattagcagagcctagagacagctattcgtctcccaggtctcactatgggcactcctcattttggggtcgtagctggaggctagttggggccctgagccatcctggcttaaaggcctgccttgttagcgccctgagtgggcctggcgctcagcattgcgttcacacaagtgcactcacagaccctggtgacaggatcggaaagccagttcattcatctaattgaggacagaacccaaactgcctgggggagtgagcaccaggactgtcgggaaggctgtgttggaaacacagtgctgagagtgcctgggcagcccagagacaaagccacagcagtgagcagaaggactgggtgttttgtggtctcagactgtggag

SEQ ID NO: 43236 - DNA, 1050 bp, Homo sapiens
catgcccagctaattttttttttcttttttttttttgagacagagtttcgctcttttgccgaggctggagtgcagtggcatgatcttggctcactgcaagctctgcctcccgggttcacaccattctcctgcctcagcctcccgagtagctgggattacaggcgcccggtagagactgtagtggtttcctcatgttggccaggctggtctcgaactcctgacctcaggtgatctgcctgcctcagcctcccaaagtgctgggattacaggtgtgagcaactgtgcctggctacaaatttaataagtaaatattttataatctagtttgagaccaaaaatacgtaggaaacagctgggcatggtggcctgtgccttagtcccagctacttgggaggctgaggtgggaggactgattgaggccaggagtttgaggctatagtgagctatgattgggcagctacagtccagcctgggcaacacagcaagaccctgcctctaataaaaatatgatcaggaagtgggcagagtatatatgtgtgcgtggcacagggaaagtgctgagtacattatttggcagcaacagcagctggaaggaagtgagggtggaggaaggaagcagctatcagatatggggggaggtcacaggatcctgccatgtcccactgtgcctagggaaagttgttatatgtccatcagcagaaggacatctcgatctcggctcactgcaaccttggcctcccaggttatggtggagagagcatcaatggtgtgcctgcttgcatggaggtcctggtgtgcggggaccctatggcgtcctaggtgcagtcatctgttaccgaggcagggtccagcagctatagccagaggaagtaactaccttgtgagaaggggacgcttcctaggaactgacatggttctgggctcttggttctgtaatcaactccccggacattgtgtgacatcagcgttagaaggtccaggatggccgggcacggtggctcacacctgtaatcccagcactttggaaggccaaggtgggcggatcacttg

SEQ ID NO: 43237 - DNA, 1057 bp, Homo sapiens
gtgctgggattacaggcgtgaaccaccgtgactggccacattcagtatttcgattcaaatattgaaagcattcaatggttgggcatgatggctcatgcctgtgatcccaacactttgggaggccaaggcaggaggatcatttgagcccaggagttgaagaccagcctgggcaatatagtgagaccctgtctgtacagaaaataaaaaaacaggccaggcatggtggctcacacctgtaatcccagcactttgggaggccaaggcaggtggatcacttgaagtcaggagtttgagactagcctgcctggccagcgtggagaaacccctgtctctactaaaaacagaaaaattagccaggcgtggtgacacgtgcctgtagtcccagctacttgggaggctgaggcaggagaatcacttgaatccttgaaaggcagaggttgcagtgagctgagatcatgtcacaacactccagcctgggtgacagagtgagtctccatctcaaaacaaacaaacaaataaaatcaaaataaaaaaataggttggacatggtggtgcgcacctgtggtcccagctatgtgggaagctgggacaggagggtccgttgagcccagcaggtccagaaagttgcagtgagccatgatcgtgccgctgcactccagcctgggtgacaaatggggaccttgtttcgaaaagaaaaaaaaaggaaataagaaaaagaaaatgctggccaggcgcggtggctcacgcctgtcaatcccagcactttgggaggccaaggcgggcggatcacgaggtcaggagatagagaccatcctggctaacacggtgaaaccccgtctctacttaaaatacaaaaaattaggccgggtgcgatggctcacgcctgtaatcccagcactttgggaggccgaggcgggcggatcatgaggtcaggagatcgagaccatcctggctaacacagtgaaaccccatctctactaaaaacacaaaaaattagccgggcatggtggcgggcacatgtagtcccagcgactctggaggctgaggcaggagaatg

SEQ ID NO: 43238 - DNA, 1003 bp, Homo sapiens
atttattctttttatataggtattttttaaagtttattttccaatagtacatcgctagtatatagaaatataattgaattttatatttgatgttgtatcttacaatatggctaaatcagattattagtctagtagcttttctggatttgatggaattttctatgtatattattatattgatattggttatgaattaattttcttttcttttctttctttctttttttttttttttttttgagacagagtctcgctctgtcgccaggctggagtgcagtagtgcaatctttgctcactgcaactttcgcctccctggctcaagcgattctcctgcctcagcctcccaagtagctgcaattacaggtgcctgccaccatgcctggctaattttttgtatttttagtagagacggggtttcaccatgttggccaggctggtcttgaattcctgacctcaagtgacccacctgcctcggcctcccaaagttttgggatcacaggcgtgagccaccgcgcccggtgtctaggaattttctgtgtatattatattggttatgatttaatcttcttttctatccatatgcattcttttctttttcttgcttcactgttgttttaggaaaaaccatgtttttcctgcattctcattcccccacagcagtcaacacagagggaggcttctgtgcccaaatgtgtgggggtttcccacagatcaagcagcaggcacagctgggtgtcctccactcagctctgagactgtctgcctggagatagagctggataccacaggttgggggctcagttcccaagactacctatccccccagaccctgatcacaagtctgggcctctcgaacttttgactgactggcttcatgttgaggttcccaggaccgtcttttggggttcaattaatttgctggagtggctcacagcactccaggaaatgcatacatttactggtttattagaaaggatattgcaaaagggctgggcacggtggc

SEQ ID NO: 43239 - DNA, 1009 bp, Homo sapiens
tttctttctttctctttctttctctctctctctttttccctccctccctgccttccttccttcctttctttctctttctttcttttcttccttcccttccttctttccctccttccctccttccttccttccttccttccttccttttctctctctctctctctctcactggagtacagtggtcccattatagctcacagtagccttgatgtcccggacttaagcagtcctcctgcctcagccttccagctgggactacaggtgtcctccaccacgcccagctgatttttaaatttttggtagagatggggtctcagtatggttgtccaggcttgtctcaaactcctgggtcaagtgatactcctacttcgaccttcctaggtgctggatcacaggcgtcagccaccgcacccagccttctctaagattgtgttggttatgcaagatgatttgcttatctatatcaattttatgaaatttatagctcataaatatctgtggaaaaatcatgctaggattaggactagaactgcactgaggatatagattcatttgggaagagctgacgtcctaatatgtcaatgtaaatatctgtcatctttagtttctctcagcaatgttttgtaatttattttattatatatgtgtatatattatatatacatatatatatatttttttctgagacagcctatggctctgtcacccaggctggagtacagtggtgtgatcttggttcactgcaacctttgcttccgaggctcaagcgatcctcccacctcagcctgccaactagctggaactacaggtgcaagccgacatgcccatttaatttttgtttattttttgtagagacagggtcttgctatgttgcctacactggtctcgaactcctggcctcaagccatcctcctgccttccttctcaaagtgctgggattgcaggactgagccaccacgcccggccttgtaatatcttttaaaatctgtccttaaatatttcttttttt

SEQ ID NO: 43240 - DNA, 1030 bp, Homo sapiens
ggctcactgcaagctccacctcccgggttcacgccattctcttgcctcagcctcccaagtagctgggaatacaggtgcccgccaccacgcctggctgattttttttgtatttttttagtagagacgaggtttcaccgtattagccaggatggtctcgatctcctgaccttgtgatccgcctgcctcggcctcccaaagtgctgggattacaggtgtgagccaatacgcctgggagtatgttttttctacatatgcatgcttacaatagggcacagtaagagattaacagcaataactaatagaacaattataacaatatattgtcataaaagttatgtggatgtggtgtctggtggtgtgtctgtgtctctctctgtcaaattttcttcattatgtaatattttccaacctaattgaccataagtaactgaaacagtgcaatgtgaaactgggggtcgggggggctactgtgtttggaagcagtcttcccagatgtaatcaagatgaagtcaaagtggacgagagtggaccctaaatcagtgattgatgtccttattagaagaaggaaattatggccgggcatggtggctcacacctgtaatcccagcactttgggaggccaaggtgggcggatgcattacatgaggtcaggagttcgagaccagcctgaacaacatggtgaaaccccatctctactaaaaatacaaaaattagccaggcatggtggcacatgcctgtaatctcagctactcaggaggctgaggcgggagaatcacttgtaccctggaggcagagggcgtagtgagcggagattgcaccatttcactccagcctgggcaacgagcaaaaatccatctcaaaaaaaaaaaaaaaaaaaaaccaacaacaacaacaaaaacttactcgattttttgtttttattattatctttatttatttatttatttattttttgagatggagtctcactctgtcgcccaggctggagtgcagtggtgctatctcggatcactgcaagctccacctcccg

SEQ ID NO: 43241 - DNA, 1037 bp, Homo sapiens
ctgtttccccccattcgggctttcacagtggttcagtccatccgaggccgccgccttcagcgcgggacagcgcgggtcacgtgggggcgggggcgggtcctcgccgcgtggagctcgaggctgactccggagggaccggagcggttcgctctgcgcgggtgctcacgggacgggcattgggtgcatgtggcttctatcttgttttttgccggagtggaggacaaccactggttgggggatgtcttaatcatcctagaaaacaacccagtggatcacgcctgttatcccagcactttgggaggctgaggtgggaagatcgcttgagcttaggagttggagaccagccttgccaacatagcaccaccaccccccgcacgccagccctcatctctacgaaaattaaataaataaataaaacaggtggtacccagaggctggggtggagagtggggagtgtttatcggggacggaccttcaatttgggaggatgagaacgttttggagatgacggtggtgatggtacaacatggtgaatgtacttgatgccactgaactgtatactaaacttcatattaaaatggctaggccctgcgcggtggctcacacctctcttcccagtactttgggaggccaagacaggaggatcacttgagcccaagagttcaagaccagtcagggcaacatagcgagaccctgtcttcgaaaaaataaaataaaatgccaaaaaggtaaattttatgtatatttcatcctatagtttttttgttttgtttgttttcagagatagggtctcgctctgttgcccaggctagagtgcggtggcataatcacagcgccgctgcaatcgggaccttccagcctcaagagaatcctcccacctcagcctcccaaagtgccaggattacaagcgtgaaccaccgcgcagggcctagccattttaatatgcaatttagtgtacagttcagtgacattaagtacattgccaagtacttgggactgaaggtatgtgccaccgtgcccagctaatttctttattt

SEQ ID NO: 43242 - DNA, 1066 bp, Homo sapiens
acccctggctttggggatcctgaagctcgagcactggtatggtctggggtgcatttcattccgaggcgggtgctgggagctggggcaggcagggaggttgagagcgcagccctcatggcaggggagttccggacaccagggacagtcaggcggccgtgcggggtgtgactgggtggtgcgtgggttgcgcgcggcagcttctgaaggttctttagcaacagaataattgtttcagaccaaagctctgcgagatccccagaggtgagaaggatgcgggagctgctctgctcagagcagggtggtcctgccgacgccctgcgctccgctgccctcccacctgtcccccaccgcagctttggttgggggtttcggagctccccagcacacacaccatgcgggtggggggcctgggggcggtgcaacggcagagcctggggtcaggacaggtgggaaggccgtggatggcctgccagtgttccaggtgggctcacaataggggtggaagtgacctcaggacctgctgcccacagggcccaggggtaccatgagggtccagctctgagctccggggtctccgaatgtttaggagagagtagaccgggggaggatggaggaacaggcccggccctgcaggaatgcattgtggggacactgcctccacctaggcccagacgtgagggcaggtccctcccacagagtggacgctgtacacacctgggggcaccccatccctgtccccctgagcgggcactgcccctctctctgggtgcatggccaggccctcctggaggcccctcagtatctgctcctaaggacatcaggagtgtcaggcccatctccttggtcaggcctgtcctccccgccactctgtcccatggcatcccctggccagtggcctgcagagaatgtttctcggggggtgtcccaaccccctggctgatttgccccaggcttgctggggacattaggagcacagccaacttgtctcgcagccagggtcgcggcactcacctcgcgtttgtctccagtccacaggcactgaggacccaggccttccaggtccttc

SEQ ID NO: 43243 - DNA, 1016 bp, Homo sapiens
tagaagaagctttggtttcctggacaagcccaggctttctcattcttaccagggatcttccttagatgcttgtccttgggaagtgtaaatgtgttcactgcagctctttctgcatattttagaccttaaaataattgttttttgtttcgagctagccttagattacaggaccattgagaattgagacactgcttgggacatggactggagcttcatcctcagccatagagcagcactgctgccggggttgagggagctcggggagcttttccagacaaaacctttgctccaggcgtttggcagggccataggaagagctcctttgtgggctccctgagctggaactcggccttctccgcccgatgaagcaaacaaactgtgccgagggcgcaccggcatttgtgccgtcagcaagccgggctgtgtctcagcctcacagcactcctcccacgggcctgggaaggcaaatgtgttttctgaactgtgttgagaccgtgtgtgtgtgtgtgtgtgtgtgtgtgtgtgtgtgtgtgttggggtgtcttgtgaagtcctgctaacctcttgtcagcagaatattcgagaaatgcttctgagaagagagaggaagatgacttcagaggctgcttgtggtctctcactcaaggctggtagggagccccggtctgcgtcctggaggaacggcacgctgagtcctgggccagtggccggcggggctgttggcgaccacagtagcacacaagggctctttctgaggagcaggagaccctggcacgggccccacgggagtgtctggggcgtccccgcctgtggcctcttctccccgccgcagcaccaatggctccacgagcagggctcggagctggccctctcctgcttcggagccgcgctgactgggtgtgtggcggatgggaggccgccctgagtgctcctcctcccttttgtacagcctgggtggaaaggacgggcctggtgcacttcctgcgggagggaggacatggggcctgcttccctct

SEQ ID NO: 43244 - DNA, 1054 bp, Homo sapiens
tggcagggagtcttgctctgtcgcccaggctgaagtacagtggcgacatgtcagctcacggcaacctccacctcccaggttcaagcgattctcctgccccggcctcccgagtagctgggattataggtgcctgccacctcacctggctaatttttgtatttttagtagagacgaggtttcgccatgttggtcaggctggtcttgaactcctaacttcaagtgatccacccacctcagcctcccaaagtgctgggattacaggtgtgagccacggcgcctggccttttctttgattttaataatttggtttactaagtctgttccctgtccatttgctctgcaaggagtcatcagagcctggcgcttgcagtacccccaggtccacgtttagatgatcttaaaacattgccataatcttgcacgatggccttgcacttaggcagtgccagtattcctatggtatacagtgaaggggcattcggtttcagtaactctgatttgtaatcgtcctacgtggaaacacaaagcaacaagcacaggatcccattagctctgctgcccagtgaagcatccatgttgctttgtttttgtttgttctttttctttctttctttctgtgtgttgttttgttttgttttgttgttgttattgttgttgagatggagtctcactatgtggcccaggctggagctcagtggcttttcacaggcacgcttatcgtagctcactgcatcctcaaactcctgggctcaagagatttcccccacttcagcctcctgggtagctgagactacaggtgtgcaccaccacgcctagctaactctaacttaatctaatgccaactccaatggacaagcattgccctgtcacaagcctagctgaactatgtcagaattgaactctttgagcttgatatggttctagaggctattgagcctcaatttgagcctaaatttaaaattgtgtgatcatttaatttaatttccaaacgggacatgtttataaataaaacaagaccctattaaacaattttgccaagatgattgactcaaat

SEQ ID NO: 43245 - DNA, 1032 bp, Homo sapiens
actttgcggatgaggacctggggtcccttagttcatcctgccaacaggtagagcctctgctctgtgccggccctggggacacgggtgtgaacagagcagagccctgtccttgtggggcttgtgctcggtggggagagaatcatacaggagatgctgagtggactctgaaggcgggtagccagccggaagtggtcaaggaagtaaagcgaggatggagcgtgggaaggatgggcctggggtgcagttttggataagatggccaagggcaggccaccctgagaagcttccctgccccagtcctcactgagcattgaggaagtgagccgtgcggctatccggggcaaagggtttcagttgtcaggaaccagaagtgcaaaggcctgaggcagaagtgaggatgtgcctctttgaggacctgagtttttgccatgaatgagatgggagccttgtagggttttgaacaaagcgggtgataagagctgacctaggcttagcaggctaacttgaccactggttttgacagtagactgaaggggacaagtgtggacacaaagcagccaattagaagacttgccataatccaggtgagagatggtggtggccggacccaagtgagagccatgggagcagcaggaagtagggaaattgtagctgtctctggaaggtagaaccacggcattggctgacaggctgggccagacctcaggatggtgcatctcccctagctgcaggccgctgctgctctgtggggagtgaggtcctcctgtgcggcccaggtccctctccatcccatccaaattcaggcccacaggatggtccagggtaacccacagcacctgggcactctcctactacagccagtggccagcctgcagggacagacagcctccaaggccacagtcagctcggcccacacccttgctgatctgcagaaggtgcagaagcagcttttcaggcagcatggtagcagggcctgggtaggccagctctggcttaacccaagtgcaggccgtaagcactgaaggcgctgct

SEQ ID NO: 43246 - DNA, 1068 bp, Homo sapiens
ccgtgccattgcactccagcctgggcggcgagatcaagactatctcaaaaaaaaaggatttggtgagcagcacatgtgcgtgctgtccatgggggtgcgtgaagatctggtttacttctttccaccgtcacattacttaccataattgctgatccgttccctgtgaatgcgtattcaggttgtttaccgttttccctgcgaccaacagtgctgcactgtgtgtccgtgtccacgcctccgtgcgcggcggccagggtctctccgggatgtgtacttagacgcagagttgctgggtcagttccacgcaggcccagctttgccaggggctgtcaaccattgcttctcatggaaagtctcagcaaggctattaaatgaactcaaaaactatctcccttattttcagatgaatgaaaaattcagtgtttgtgtagatggagaggagcagaggagtgatgggaaatgtctctgggattggacgtcatcaggtgtgctaagacacagacgggactgttgtgaggaaggagcttgtgctcacagatttgtagaaacaggaggcacagcacacggggccacacggggagcaccaggctccagggagcaccacgctgggtcaggaggcggaggggtacttgtgggcaagagcctcgattgtggtttctgaaaagaaatgggcaaggcagcatccgcggtttaggattggctggtttgagtaatttccccagcctctgtgctatcagggtggtccctggttgtccagtgcttggccctggggtggttggcagaggcatatggctgcctgcagtgtggagcctgggccgccaatatagccctgcactccaacctgcgctgagtcatctctcctacacgctccagcctccctcatgttttctttagtgtttcaaaaatgcgaagctcagggtcttcgtgcgtgagattccttccaccaggaaagctcctcctgcccctgctgcgcagccggcccctccttaaggtcttgtaaatgcctcctcctgagccgccttccccaacagccctcatttaagcagcctccttgactgtaggtccgct

SEQ ID NO: 43247 - DNA, 1054 bp, Homo sapiens
tattataagttgtattttctttattacaagctgtagtttgtctagcctctaatcagtggttctccgttggagagactatgctccccagggggacatttggcagcgtctgcaggcgtgtttggttgtgacactgatgggtgccgccggcatctgatggttggagatgctgctgactgtcctgcagtgtgtgaggcgctccaaaacagaattccccagcccccagatgtcagtactgatgtggtaaacaaactttgttctatgtcagatggccagttttttaatggcagaattacactattatgtaaataattgatgttcttaatgatgactccccccagaacctacaaaaccctgacatgcctgttagctgtgtagggagtcattccgtgttcattgaattaattttaatacgttatagtgaactacagtcccacttgaaacattaagagcaatcttacagtgtgctagtactttttcttctttttttgtttagtttcctaactatgaaagcaggtgttctaatacatttggaactaataattcatgtgtagtgtacttatggagacttaaaaataaaactaaagggagggaaggaggaatggaaggaggagatgataattaacaaagaattccttattcacaattaatagatgacaacatttgtcataactttagatgtttcttctatgttccgttctcctccccagtcctaatactggaaccaaactgcttagaccagaatcctgagtgaccttggatcagctgcattcattcatttgttccacaaacatctgagtgccaggggctgttttcagcattgggaataacagcagtggccaaaagtcagagtccatgttgtctgcgtaatgggcaggttagggacaaataatgagtaagtgaagaaatatataatgtctccacagagagagctgaggggctggtgtgggcagagcagagtgagtgagggcgagagagcaggtggacatggggtggctggggtaagggaggatatacagtcttgcaggctgtgtaaggattctcatttaaagtggag

SEQ ID NO: 43248 - DNA, 1033 bp, Homo sapiens
ctgcatatgccgtcaaagtcctgaattggggctgcggttgaagttggagtgtcagaacacgcttttgcccttactgctatcagccttcagtcagataagtagcctttttatataaatagttccctcttgtctctgtagagctggggaaggcggggtcccttgggtttgtgtgtatgctggatgaagcagacagaagggttcttcagggtatggggccgtctctggactacaccaggaagcctggaaaaggccctccaacaaagcctgccatagatgatgcctcggaccccacgtttttagttacaaataatatacaaatagttactgagaattaaagttactttcttcaaggccatcagagtggttggtaactgtaatgtccctgaaagactcagtgtctttaatctcctaaaccatgttgaattccagtaatgggaggccagggaatgggcagaggactgatagtgaatctagggagcacctttttatcacatctaggagggggctgagcagactctcttagggactgagggggttgagtgtttatctccttcaactcctttccaagtcattgtctttaaatctttcttttcttttggaaacggagtcttactctgtcgcccaggctggagtgcagtggggcgatcatagctcgctgcagcctttactttctggactcaagtgatcctctcagttcagcctcctgtgtagctgggaccacaggcacgcaccaccacgcctggctaatttttctgtagaaacaaggactcactatgttgcccagcctggtctcaaactcctgggctcaagcagtcctcctgccctgggcttgcagtcctttttctttttgttgattgaggctgatctcacgctcttgggctcaagcagccctcccaccttggcctcccaaagtgctgggattacaggcgagagccaccacgcttggcccttcaatctttatcagggtttgagaaggggacttccataagatatgtcttagattggggaggttaagagtgtgccaggtctcagg

SEQ ID NO: 43249 - DNA, 1050 bp, Homo sapiens
tttttacttttctgtttttttagaaaggctctcactctcttgcccaggctggtctcaagccatcctcccacctgggcctcccaaagtgctgagattacaggtgtgagccacactttctaatacgaaaacttcaaatgtatacaaaagtagagaaaatagtagattgactgtaaagtacctacagcccaactaaagcagtcatcaattctgtgccaatcctattcacctgtgccctccccatggtctccaagcaaatccaactttgtgtagttggattaggaaacgttttaggatgtatatgagtggctaaaagatgaggcctccatgtaaaaacacaaccgcagtaccattagcaaacctaaacattagtaatagctcattatcaccagatatccagtgttcagaattcctccattgtggcataattgttttgtgtgactcgacatgcattgcaatgaatctccagattctcctgtctcttgcttccttttttctcttcgccatatttgtgaaagaagctgtagaagtcggccaggtgtgatggctcgtgcctgtaatccctgcactttgggaagctgaggcaggaggatcacttgaggccagaagtttgagaccaacctgggcaacacagcaagacctcagtgccacaaaaatgaacacattagttgggcatggtggaatgcacctgtagtcccagttgcttgagcggctgaggtaggagaattggttgagcctgggaggttgaggctgcagtgagccatgtttgggccactgcactccagcctgagtggcagtgaaaaaaaataaaagaaccatagagttgataaagtcggggttccagtctctcagtaccgtgagcctgtgttaaagggcctcaaggaagatctggaggaaactgatgatgagggaacagtgcagccttgcttacacctagatagcgtcctttgtcctccctccctttttccttccttcctttccttcttttctttccttcctttcttttcttcctcccttcccttccttcctttccttcctttccttcccgccttc

SEQ ID NO: 43250 - DNA, 1035 bp, Homo sapiens
caaaaattagccaggcgtggtgtaaaaatacaaaaattagccagctactcgggaggctgagacgtatgaatcacttgaactcgggagatggaggttgcagtgagccgagatcacgccactgcactccggcctgggcgacagagcgaaaccccgtctctaaataaatcaattaaataaaataaaataaataaataaataaaataagatgtaaaatactcctgaaagggcaggttgagctgaaggagtcgagttcaaggagcgtgtctgcagggctggaagtggggcgggacctgccgtggtgcctgggcgggcctgggggctcccgagcagccgccgcccacgttcttgttcttgttttgggggctggacacacaagcgtgttcctcgggggaaattcgttggcttgtgcgtgtcagatgtgtggtttcctgtgtgcacggaaaggaggcagcagcgacactcaggatctccgcctccccccgctcagccgggcggggatatttctagaacgttgaaaacaggacttctcctggctagggaaactaggccgagccgagggcaggaacctcgtgatggaaggggggccccggcctctcgcccagcttggcggccaggcccgagcgcccctgcgggagatgggcaggcccgagtcggcagtgacagcccggggaggcgggggacagcgccaggggtcttccagaagcggccgggccaccccacgctgaggccaggaagcgcctgtcctgcgccccgcatcctgagcagagcgtctacaggagacgcggaggggcagtggcattggaacgggggggcagtggcgtcggaaggggacaagggggggcagtggcgtcggaaggggacgcgggggggcagtggcgttggaacgggggcagtggcgtcggaaggagacgtggaggggcagtggcgttggaaggagacgtgggggggcagtggcgtcggaacggggggcagtggcgttggaaggagacgcggaggggcagtggcgttggaaggagacgcggaggggcagtggcg

SEQ ID NO: 43251 - DNA, 1019 bp, Homo sapiens
cggtgagcaggactgtgcttcgctggtcaccgtgaccctctctaacgaagggctcacagcttcccggggtaactggctacagcccctggtttcggctggaggaagttctcggttacgccacgctgctctctcctcggcacagccccggagagctctgtctccatctgtgtctgcctaacaaatggcttaagcattttatctcctcagttacccattatcttaattaggttttcagttgcttttcagagagcgcgattgttgttccctgagtaagactctaattagtgtgaggcggtccaagtttcatcatggaaataataccctagagtatgtaaaaaaataatttcttccccgtctaaaaaaatggaacctctcattttgccgaaaatttggaaagtaagtgaaagtatagagaaaggaggagaaatcacctgtcaggtcacctcccggagagaatcattttcaacgctttggtgcttttcattctggtgttttcttagtgtatgcattcatttacttcatttattgatcgattagagatgggattctggtgttttctcagaatatgccttcattttctgacttcatttattagagatgaggtcttgctctgtcacccaggctggagcccagtggcacaatcatagctcactgcagcctccatctcctgggttcaagtggtactcctgcttccacctcctgagtagctgggactaagacgtgtcccaccacatctggttcatctttttatttttgtggatttggggtcttgctgtgttgcctagtctgctcccaaactcctggcttcaagtgatcctcccgcctcagcctcccaaagtgctgggattacaggcatgaaccaccatgcccagcctacattagctttctttaggttaggtttctaaagtattctgtaaatataattttcatatacaggacacctctcgcttctttcttccttttttttttcctacgtaggtcaaattctaacacccctcgtttcttaattcggtcccttt

SEQ ID NO: 43252 - DNA, 1054 bp, Homo sapiens
attgtaccaagagactcgccccgcccctgtatcataagcctttaaatggagtcaactttttaattatatatataaagataaatatatataaatatatatataaactttttaaaactgtgaaaaatagctatgaaattataaaaaaaaacattctgacgtgcagaatattattttttatttcctgttagattatagtgtctagcaccggcttcaccggcctcccagtccccagcacaccccccgcccaccccaccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggtttttttttttatgtttcttttggaattttgtttgttggcaaattctgtgtgatcttttttcataaaaaaaaagaaaagatttaattggaaaaataaaattgtctggagtggtttatttcaggggctggagtaggggtggtgtctgggggcattctgccatatcagggcaccaagaagcaggattcgactggaagaagttgggtgccacgcgtgcaggggcggtgaccccatgcagccatctaaatgagctcatcggctgggcacagtggctcacgcctgtaatgccagcactttgggaggccaaggcaggcggatcacttgaagtcaggagttcgagaccagcctggccaatatggtgaaaccccatctctactaaaaatacaaaaaaaaattagccaggtgtggtagagcgtgcctgtaatcccagcactttaggaggccgaggcgggaggatcacttcaggccaggagtttcagaccagcctgagcaatgtggtgaaaccccgtctctactaaaaatacaaaaattagccgggtgtggtggcccacacctgtaatcccagctactcgggaggctgaggtgggaa

SEQ ID NO: 43253 - DNA, 1037 bp, Homo sapiens
ctattaaaaatacaaaaattagccgggcgtggtgacatgcgcctgtagtcccagctgctcaggaggctgaggcaggagaatcccttgaacctgagaggcagaggttgcagtgagctgagatcctgccactgcactccatcctggcgacagagcgagactctgttttaaaaaaaaaaaaaaaaaaaaaaaaaacccaacaaaagtcagcatctttatccacctgtcccggttccacaaagtgctttgttttacttcattattcgggagcctctggctgctccctgcagacggggtttcccctgctggacctcacagcctgtcatgggagcccatccggggtcagccacctggtgtcggttgcttccgcccccatccctgatccccgggacagaccagggtcttggaagctccaagctggggaccccaggcctgatgagccactctgtcctctgccccacaggtgctgagccgtccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtggtaggttggcctggtccccagggcagggcggtgggcggatctccttcgtgcatccaaactcagggcttgggaacctgccgaagtgcctgcctgctgtctgtaagaactctgagccgggtgcagtgcctcacacctgtaatcccagcgctttgggaggccaaggcgagcagatcggctgatgtcaggagttcaagaccagtctggccaatgtggtgaaactccgtctctactaaaaatacaaaaattagctgggcatggtggtgagtgcctgtaatcccaactacgtgggaggctgaggcaggagaatcacttcaacctgggagctggaggttgcagtgagccaagatcgcaccattacactccagcctgggcgacaagagcgaaattccatctcaaaaaaaaaaaaaaaaaa

SEQ ID NO: 43254 - DNA, 1054 bp, Homo sapiens
gttttcctgcagtttcagcccaaagaacttcatttagcagttttgccttgtagagctgctggtgaggaattttcttggtgttccttttttttttttgaaacagtctcactctgtcacccaggctggagtgcaatggcgcgatcttgacttactgcaacctccgccttctgggttcaagtgattctgctgcctcagcctcccgagtagttgggattacaggtgtgagccatcatgcccggcctcttagtgttctcttacctgaaaatgtttctatttcaccttcattcttcagtgttgtttttactggatatagaattttgggttgacagttttttttttttctttgagtccttagaagatatcctgctctcttctggcctctggtttctgatgagaagttcgccattaatcagacgattgttttggaagtgataggttacatttttcttgttgttcctgggggttcgtgtttatctttgtcagccgtttgactgtggcatgcctcgtggcggatttgttgatgtttattttgcttggtgtttatctgacacccaacatctgcaagtttctgtttgtcatcaaatttgggaagatttcagctattgaggaaaagcaaatattcaagcattttttcttgttctttcttttcctgtttaacatacattttaccatttgttatctgacaggtctctgaggctggttcccccacacccaaactcataaactcactcgcttacttttctcttaatcatatccattcagctcttagatcccctccatggattttttatttctgaaattgtacttctcagttttataatttctttgtgttgtttgagacagggtcttgctctgtcacccaggctggaatgcagtagcacaatcatggctcactgaagcctcaacctcctgggctcaggtgatcctcccacctctgcctcctgagtagctgggaccacaggtgcatgccaccatgactggctaattattgtattttttgtagagacagagtcttgctatgttgcccaggctggtcttgaactcttgacctcag

SEQ ID NO: 43255 - DNA, 1064 bp, Homo sapiens
cttgtacgtctccctcagagctcttgggtgacaaggtacatcgtcaatgagcagtagtattttgaaaggaatttttttttgtgaacaataggtctcaacagcaggcttaaaatattcagtaaatcatgctgtgaactgagatgctgttaccaaggctttgttattccctttttttttttttttttttttgagacggagtctcgctcttttgccaggctggagtgtggtggtgcgatcttggctcactgcaacctccgcctcccaggttcaagcgatttttctgcctcagcctcccgagtagctgggattacaggcgtgcaccaccacatgtggctgatttttgtatttttggtagaaacggggtttccccatgttggcccagctggtcttgaactcctgacctcaaatgatcctcctgccttggcctcccaaagtgctgggattacaggtgtgagccaccacacctggtctgctgttccattgatagagtagtggcagaggtgattcagcatcttttttttttttttttttttgagatggagtcttgctttgtcgcccaggctggagtgcagtggcgtgatctctgctcactgcaagctctgcctcctgggttcatgccattctcctgcctcagcctcccgagtaggtgagactacaggtgcccgccaccatgcctggctaatttttttgtgctttttttttttagtagagacagggtttcactgtggtagccaggatggtctccatctcctgacatcgtgatccgcctgcctcagcctcccaaagtgctgggattacaggtgtgagccactgcacccggcctgttgttccactggtagacccctggcagaggagatttagcatcattcttaaggaccctggggttttcagaatggtaattgagcattggcttcaacttaaaagtccccagctgcattagcccccagcaaaagtcgggctgtcctttgaagcttttaaaccaggcactgacttctcctctctagctatgatagccttagatggcatcttcttagaaggctgttttgtccacattgcaaatccat

SEQ ID NO: 43256 - DNA, 1087 bp, Homo sapiens
cagattgtttcttcttactctgtttcttggccagtctggctagacgtgattagtttcattggtttctactctttgttattttcttccttctcattcctttgggtacacaagcatgtcttggagatactgcaggattgcttccaaaccataaagcgaatatcacagtaaagcaagtcacgtgaatgttttggtttcccagtgcatataaaattacgtttaaactatactgttgcctattaagtgtgcagtagcattatgtctgagaaaacagtgtacataccttaattaaaaaatagattattggccatgcacggtggctcacacctacaatcccggcactttgggaggccaaggcaggaggattggttgagctcagtagttcaagaccggcctgggcaacagagcgagaccccatctctacaaaaaataaacagaaaaattagccaggcacggtagcatgcgcctctggtcccagctacttgggaggctgatgtaataggatcactggagctcgggaggtcgaggctgcagtgagccgagaatgcgccactgcactgaagcccaggcaagagaatgagaccctgtctcaaaaataaaagaccaaaccaaaagcatatgtttacactatcctgtagtctcttaagtgtgcaatagtattatgtctttttcttttttgagatacggtctcgctttgtcacccaggctgaagtgtagtggcgtgatctctgctcactgcaatctccacctcctggattcaagtgattctcctgcctcagcctcccgagtagctgggattacaagcacacaccaccacgcctggctaatttttgtatttttaatagagacagggtttccccatcttggccaggctggtctcgaactcctgacctcaggtgatctgtccgcctcggcctcccaaagtgctgggattccaggtgtgagccaccgcgcctggacgtaatagcattatgtctaagaaaacattgtacatatcttaaaaatagtgtattgccaaaaacgctaacgatcatctgaacctttagtgagttgtaaactttttgctgatggtgggtcttgcctcgatgtt

SEQ ID NO: 43257 - DNA, 1013 bp, Homo sapiens
ctctgtctctgatgtctctggggtgctccgagctggtgtgttcactcttggcacgtgtgagggaatgtccgttttatttatttattaattattactattattattattattttgagatggagttttgctgtttttgcccaggctggagtacggtggcatgatctcggctcactgcgacctccgcctcccgggttcaagtgattgtcctgcctcagcctcctgagtagctggggttacaggcacgcaccaccacacccagctaatgttgttatttttagtagagacggggtttcaccacattggccaggctggtcttgagctcctgacctcaggtgatccgcctgcctcggcctcccaaagtgctgggattagaggcatgagctgccgtgcctggtctgggaatggtcaaatgggcaacttcactccatcgtgcctgtgtcgaaaactccactgtcctggatgagagaaacggactcatggagcagtgaggaattcagtgggcctggctccagcaggacggtggctgtgggattcacctggctctgcagagcgctcctctgtttattttttataatctgcttttctgcaattctgggtcagagagagtgcagggttcacaaggaggtaggggtgtgtccagcagggagttgctgagctggacggaggtcgaagcgagaacggtctcctcttgctttttcagtttcgattgtaggggtcgctggcatgccctgtgggtttttttttttttttttttctttagatgatgtcttgctctgtcgcccaggctggagtgcagtggtgtgatctcggccgcactgcaacctccacctcccgggttcaagtgatcctcccacctcagcctccggagtagctgggataacaggccctgtccactacaatacaatacaaatagaaaatacaacagtttgtgtattttttaaaaatacagacggggttttgccatgttggccaggctggtctcgaactcctggcctcacgtgagctgcccgcct

SEQ ID NO: 43258 - DNA, 1228 bp, Homo sapiens
ccaggtgtggtggtgtgtgcctgtaatcccagctatttgggaggctgaggtgggagaattgcttgaacctgggaggcagaggttgcagtgagctgaaatcgagccattgcactgcatcctggcaacagagtgagactccatctaaaaataaattaaataaataaataaataaataaataaataaataaaatacagcagcagcaaacgtttgtggccaaaatataaagccactaacacagtgcaagacacacagtgagtgagtgccaagtacagatcggctgtttcgatcacctgtgaagtttcagcttaaagcaagcaagtggggcttctaagccatgtctgtgtccccactgcgcacgggattccagagaccagcaagtggctccttcttcgttttttttttcccttactggaaaagagagactggaatccttcttcgtgtaaacttgtgttctgaactccccctgccatcctggtggatttccttggcgtttctgatctttgttcttggcacgatttggtaaataggtatctgaccgcacagagatgtgtgtgtgtgtgtgtgagtgtacgcgtaaaagcgcacaagaaagaaaatgctttcttccttctttcaccttaaactctcattctgcctcattcacaaatatcccagaattccagcactgttgttttacaagatccatctccccacgcccgtcactctgccatcactgtccacgctcagggtccagagcccaacccttcagggccatgagggtggacctcagcctgcgagccttgtctggccagggtgctgaccggcagtgtgtctgcgtttcaggctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcaggtgagtaacccagtcttccaggtgtgtgagatctttcagggaggtgtctggagggtgtgttaagagttcacgctcccttcgcaggccctttgttcctgtacagaaaccttagaagtggttgtcttcaatgccggaatgactcttctccaatcttccttattgtacagagggggagattaaggcccagaggaggtcagagacctaccgacgtaacacagcctcagagacaggag

SEQ ID NO: 43259 - DNA, 1056 bp, Homo sapiens
tagtgtgttttgtgtattgactgaccggcccaggtaggcattggtggtcgccgagctgactccctcccatttcctcataaaagacatgcctggcttcctcctgccctctttggggccttttgagaccctaaaatgatgacgcagtgaagcaggaaggtttagcaggtagtgagtgcgcccaatgccatcgaggtgtggggccttgtgccccccatctggccccccttgtcctgactgtgagggtccgtgcagggccggggtcctggtggaggtcccccatcagccctggttcgaaggggctcaccagagctcctcacccccagcgctgccttttggggttctgcgtggaacgctgtgcttatgacacatgggctgggatggaatgtctgtctctggcctgggacggggtgggcagcctggaccccaggccctgcatgaggttctcctcggactcggggacccttggggggacagggcaggtgcgggcgtcggggagggggaaactcgtgccgtgctgaccctgcctgccggccccttcccagcaggagcggttgaaggcgcaggagcaccgggcggagatggaagagaaggggagcaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcaggtaggatgcagctgagaccctcagggtctcactctgcccctggagcggtaaaactgctcatccatcttttcattgacccgttcg

SEQ ID NO: 43260 - DNA, 1042 bp, Homo sapiens
tgtgccaccacgcccggctaattttgtattattggtagagatggggttttaccatgtctgccaggctgaactcctggcctcaagtgatctgcccgcctcgtcctcccaaagtgctgggattataggtgtgagccactgtgcccaggtgtgtgttttaggttttgacggtcattggtcttagcttctaaggtgtcgggtgagataataactggggtgagtaggcggcagccagttacttgatttggggagccaggtcttgagctcagcctagggcgagaggcagggagacccccataccgcaggttggtatgagggattccagtcaagtctttcgagaggccagtgagctctgggcctaactcagtgccccctggcaccctgaggcttgcatccttcttggtgaaacggggggatggcaactgctcggtccttgggtgtgggtgtgagcagtgggtggggcaggggggcactgtgggggcttggagtatagtctagagatggaaggagaccaggcaggatggcctggcatgggctgtgcttcttcggggtttattttagagcctcttttgtgagttgcgggatgccttgatcctctcctcaccctaatgtgtatctctttgcgttggccctgggaacattggaaatcacatttatggctggacagggtggctcatgcctgtaatcccagcactttgggaggccaaggcaggaggatcgcacgaggccaggagtttgagaccagcctgggcaacatagtaagaccccatctctacaaaaaagagaaagaaaaaaattagtggggtgtgatggtgtgtgcctgtggtccctgctacccaggaggctgaggctggaggattgattgagctcaggagttggaggctgtagtgagctatgattgagccactgcactacagcctgggtgaacagagagagaccctgtctttaaaaaaaagaaaagaggccgggcacggtggctcatgcctgtaatcccagcactttgggaggccaaggcaggaggattgcttgaggcctgcagtttgag

SEQ ID NO: 43261 - DNA, 1031 bp, Homo sapiens
gccaggctacagcttgcatttttttcatggaggtgaaattcacgtggcatacaattaaccatttgaaatgtgtatactttagtggtgtttggtgtattcatcctgtgtaatcaccagctatctatggtttcaaaattgaatatttatttatttgagagagagtctcactctgtcgcccaggctggagtgcagtggcgtgatctcggctcactgcaccttccacctcctaggttcaagtgattctccttcctaaaaacctcccgagtagctgggactatagggacacgacaccatgcccggctaatttttgtattttaaatagagacggagtttcaccatgttggtcaggctggtctagaacccctgacctcaggtgatccgcccgcctctgcctcccaaagtgctgtgattacaggcatgagccaccactcccagctctgaatttttgttttaagcaaggacaaatggcatttggctagaagcagacacggactctgaccttgtagtaggtgcttttagcttctctgagctccagggtttgtaaccataaataataacaataatcatagaccaggctcaatggctcaggtctgtcatcccagcactttgggaggccgaggtgggaggatcgcttgagcccaggaattctagaccccagacttcgcaacatagtgagatcctgactctacgaaaaagaaaaaataaaaatgagctgtacatggtggtgcacacctgcagtcccagctactcaggaggcaaaggtggggcgattgcttgagcccgggaggttgaggctgcagtgagtcatgatcgcaccacctcagctccccaggtagctgggactataggcgcctgccaccacgcccagctaatttttgtatttatagtagagacggggcgggggcggggggtggttttcgccatgttggccaggctggtctcgaactcctgacctcaagtgatccacgatccacccgcctaggcctcccaaagtgctggtattataggtgtgagccatcgtgccggctgtg

SEQ ID NO: 43262 - DNA, 1038 bp, Homo sapiens
aatatatttttttttttgagacagagtctcactctgtcgccgaggcttgagtgcagtggcactgtgtcgcctcactgcaacttctgtctcctgggttcaagcagttctcctgcctcagcctcccgagtagctgggattataggcgtccaccaccacgcccggctagtttttatatttttagtagagatgcggtttcaccacgttgaccaggctggtcttgaactcttgacctcaggtgatctgcctgcctcggcctcccaaagtgctgggattacaggcgtgagccactgcgcccagccgcataaatattattttctaatttttttttttgtctttttgagacagggtctcgctctgtcacaggctggagtgtggtggcgcgatctcggctcactgcgacctccgcctcctgggctcaagtcattctcccacctcagcctcctgagtagctgggattacaggcccacaccgccatgcatggctaattgtttttaatttttgtagagatggagtttcaccgtgttgcccaggctggtctcaaactcctgacctcaagtgatctgcctgccttggcctcccaaagtgctgggattacaggcatgagtcactgtgcctggcctaaaaaaaatttttttgggatggggtcttgctctgttgcccaggctgttctttttttttttttttttttttttgagacagagtctcgctgtgttgcccaggctggagtacagtggcatgatctcagctcacggcatgctccgcctcccgggttcatgccgttctcctgcctcagcctccggagtagctgggactacaggggcccgccaccacgcccagctaattttttctttttgtttttagtagagacggggtttcaccgtgttagccaggatggtcttgatctgctgaccttgtgagctgcccgcctcggcctcccaaagtgctgggattacaggtgtgagccaccacgcccggccaaccaggccgttcttaagctcccggcggtcctcccactttggccttccaaagtgttgagat

SEQ ID NO: 43263 - DNA, 1087 bp, Homo sapiens
aaaaaaaaagagggacacagaccacgcagtaaacaaaatggtaaaggtctggtctggtctgagaggtgaggggctgtatcagcacagcccacccccacccgactgatctggaggggtgacctttttcctgcatgcaaagggcagaaaagtgtggtgaaggtggacggaacacaaaagtcagagcctggcgtatctgagctggcagaatggctggagctggtgggaggggatgtgggggaggtgggatccttcaggtccctgaaagccagtcatgaggtcttggaattttaaactgaggaatgaggaggcagtggagggttttaagtggaaggagtaattgaaattgagggacatttcacagaactggtctggactcttaaaaaaatgtcaatggcatgcaaggcagaggaaggcggagaactgttcctgattaaaagagactggaaaaatgcaactgctaaaggcaatgtatggctctctattggatcttgggatcagggaagaaattgctacaaagaacatcattgggacaattgacaaaactggaatatggactgtagattagttgatagtatcagatcactgttaggttttatgaagtggataactgtgtgtggttctgtaagagaatgtccttgttcttaggaaataagaatactgaaatgtgggccgggcgcagtggctcacgcctgtaatcccagtactttgggaggctgaggcgggtggatcacgaggtcaggagatcgagaccatcctggataacatggtgaaaccccgtctctactaaaaatacaaaaaaatagccgggcgtggtggcgggtgcctgcagtcccagctactctggaggctgaggcaggagaatggcgtgaacctgggaggcggagtttgcagtgagccgagatcgcgccattgcactccagcctgggcgacagagtgagactccgtctcaaaaaaaaaacaaaagaaagaatactgaaatgtttacgggcaagggacatagagtctacaacttgtcctcggaatggttcaggaaaagaaaaaatatctattttatatctataaatatacatatataatatatatattt

SEQ ID NO: 43264 - DNA, 1039 bp, Homo sapiens
cctctggcctcagcctgccaaagcgctgggattacaggtagaagccaccgtgcctggctggaaggaagaaaatgcagccgattaaggaagtgcccagtgcagtgcccagcacatagtaggtgctcaataaatgtgaactcctgcccttgttattccctgacctatccctgagctgctgagctgggctcaggtccggctgtgtttgcagccacctgccaccccgagagtgcaggactggagcccttcggggagggttgggcaccaggacaccaggagaaaggctggcggggacctaatgcagaaggcaatttatggtgcaaacacagcacttgtgcgtggaaggaaaagattttctttgaacaaacgagactctcagccctgtttcccagtagcacgattacttcagaactgtgcagcttccacaaaacaaaaaaatatggtgagggatgaagggaggtgagaacgcccttgcagctggtggaacaaatgtttcggggctgcagaggggcggcaatgtgcagatagcgaggccgggcttgggatggaggcccgggtgcacgtcccaagcctctgccatcagattaggcctgagtctgggcatggtggctcacggctgtaatcccagggctttgggaggccgaggtgggcagatcgcttggggtcaggagttcaagaccagcctggccaacatggtgaaaccccatctctactaaaaatacaaaaattagctggtgtcgtggcacatgccggtaaccccagctgctcgggaggttgaggcatgagaatcacttgaacccagaaggcagaggttgcggtgagcggagatcgcaccattgcactccagcctgggtgacagagcgagaacctgtctcaaaaaacaaaataacaaagttatgaattgaggcattatttgagggagggggaggaaggggcgtggtaatgacagactcatggtatctctgtgtcttcaactattggcctttgtatttgcagagtgtttcatgattatattaaatttcacaatgtctaacaattaata

SEQ ID NO: 43265 - DNA, 1073 bp, Homo sapiens
ctgattccagcagtgcccgatggtgggacccacaccagaccaagccttcgcctcccagaggcctcctggccctcctgtcatggcctgtgagagccacacccctaggccccgtctcctagtctgcaggccgcaggaccagctgcccacggccccagggggcaggggctgtagatgagggtctcagaggtggtgggagcaccccccccacccacagttcctgggcatttctttagagctttaaaatggcacctggagaccaccaggcgcggcgatcagatcgggtggtgtggtgcctcctgggactgaccacttcttgctctccgaccaggcaggggcgagtggcctgggaggttcccggaccctcagggggcctgtgtctctgggcaccgcagctccgccccactccttcctccagaacattccccactcgggctagagaattgcgtctgctccaggaatgcatcctagcgtgtgtacgatcgcgcctgggtgtcctgttctcatgagcaagcggttttaaccagcagcataatttatactcatagacaggactgggggaagggctgttcctgaggctggggtgcagtgccttggaaagcacccctgaaacagtggaccttgtatttttagtgtcccctgcaaccatcctctgacttagagcaagaatttccgctgctgctacccccgagatgggcttcaccagatgttaataacgtgcttattttctctaagtgctattttggcaccagcgttagttgcaatttatattctgcagcatttgatgctgggaaaagaacccaccctaatggtccccaattggcagagctcggctgttaagcagcagaccatatgctgcctgctggaggagcgtggtcagcacttgtccccgtgcctgcgtgcgtgtgcctgcgtgcacgtgtgcctgcgggtacctgtgccctgtgtgtgcacatgtgcctgcatgcgtgtgcctgcgtgcacgtgtgcctgtgtgtacatgtgcctgcgtgtacctgtgccctgtgtgtgcacgtgtgccttcgtgtacctgtgccctgtgtgtgcatgtgtgt

SEQ ID NO: 43266 - DNA, 1044 bp, Homo sapiens
cccgcctcggcctcccaaactgctgggattacaggtgtgggtcaccatgcccggccttgttctgctaattattaaaatattaggagggaaggtagaagtaagtgtctaacctctgaccctcatgagcctcatgggtccttacgggccatgtcctttggtttccgtgtggctttctcttttggaggatggagggtacttctttgttcccagggaagaaaggtgggacacattccagcacacctgtctagggcctggcgagggcttagcaggatgggaatcctgtctggagagggtgaaaggactgtcgcagtcagagttcccaggaaacctccgatacccgtgtggggtgtgcagataggctcttcctccatggccttcacggttgccatggtagcagcctggctttgcaaaactcagagcttccatccaggcaaatatgtacaggaagcaggagcaggctggagccagagggtcgtgtagacacagtccccagaaagatgatgtagtggagatgattccgggcactctctcctcggcgtggtctttacagagatcagctgctctgagaggctccccttggtaaagccttctgccttcctttgtccccgatctggggacttcatgtctcattaggtccagctcttctccctcttcatcgtataaaccaaaaaggcatcaggcattttgactcaggcccacattagggaagaacaccttgtaatttgccagatatgaactacagcaatggaaaaggaagtgtgcatggccaggtgcagggctcttgcctgaaaggctagcgttgtggagggcagatcactcgaagccaggagttcaagaccagcctgaccaacagggcaaaaccccgtctttactaaaaacacaaaaattagctgggcacggtggcacatgcctttaatcccaggtactcaggaggctgaggcacgaaaatctcctgaacctgcgaggtggaggttgcagtgaaccaagatcgcaccattgcactccagcctgggccacagagtgagactctttctccaaaagaaa

SEQ ID NO: 43267 - DNA, 1053 bp, Homo sapiens
gcatttgcgaatagtcaagtgtgtgggccttttacctcaagagtgctggagatttatagtctcaccattttattttattattttttttttttagacagaatttcactcttgttgcccaggctggagtgcaatggcaagatttcggctcaccgcaaccactacctcctgggttcaagctattctcctgcctcagcctcctgagtagctgggattataggcatgcgccaccacgcccagctaattttgtatttttagtagagatggggtttctccctgttggtcaggctggtctcgaactcccaacctcaggtgatccacctgcctccacctcccaaagtgctgggattacaggtgtgagccactgcacccggcccagtctcaccattttttgaggtgacagaacagagagctgaaatttctgaagctacttctggattggcaacagcgtaatgccctgtggcatgtcagtgacttctctccccctagagagtgagttgacaggtttcactgtaggaaccatttaaaagtaagggagcagtttgtactttgttctgcttctgagacaaggctggatggaagtcagcaactgaaatctagcacgcatggggacggacaccttccaggtggctttgcaaggaaggcaaggaaacaaacacagaacccggtgactttggcctgtgggctcagattttcttttggattctttgccaacagacccaaaggtctcaagattattatcacacttgctgggcttggaggaggtggtggccggatacatttgtctactggttcttgagaaagctgtttatgtgaagaaatttcagctcccatcatgatagggtcatctggaattgaatttaatcttctgctttattcattaatcattattcaggcagcagaaaatgaataaaggaagacggaagtgctttctttatattgcaaagtgaagacctcatgaacagccaaaacaccttaatgtattttgaggacaaaagggcatcataaacttaaccagcaacctccatgatgacgtgaagaacgtggcctggcggg

SEQ ID NO: 43268 - DNA, 1043 bp, Homo sapiens
ggttgtctgaagattaaaggaggggatgtttgcaaaactcttagcacctttaaacttaggtccttggaaatgctagtggattcacttatcttctccttccttagatgcttggaaagtaagacactggcatttctgtcattcttgatttcctggtcatttgggggcacttaatttctctgtgttggtttcctcctctgtaatgagatctgttaatctcaggatttcacaaggggcaggcagagaggcttgtcacagccttttagaactagaagaaacttaagatgtcatttaggtccacaagtgccaatatgagagtctttctacagtatctttgtccaaaagtagatgtgagtggactctttggtttctgaaaatcccacatcatgtccccttaatttcttttctttcttttcttttctttttcttttttttttttttttttttgaggtggagtttcactcttgttgcccaggatggagcagtgacgcagtctcagctcactgcaacctccgcctcccaggttcaagtgattctccctcctcagcctcccaagtagctgagattacaggcgcccgccaccatgcccagtttatttttgtatttttagtagagatggggtttcaccatgttggccaggctggcctcaaactcctgacctcaggtgatctgcccacctcaacctcccagagtgctgggattacaggcatgagccaccgtacctggtcttcctttaatttctagattttgattttgaacctggtgtttctataacattcacttgactgtggtgatgaatccaattagaataatcagggctctgcttttatcttttaagatagggatccccagtccccatccccaggccacacaggaggtgagcactgggccagtgagtgagcattacgacctgagctctgcctcctgtcagatcagcagcagcattagagtctcaggagcgtgaaccctgttgtgaactgctcatgcaagggatctgagttgcacactccttatgagagtctaatgcctgaagccatctctccacg

SEQ ID NO: 43269 - DNA, 1017 bp, Homo sapiens
attgagcatttctgtgccaaagggagtaagaaagagaaagggcaaccacggccctaactgaccatcagtgggatgagagagtgatggtgactgctgtgaggaacatgcggctctgcatgagcgacatgggtctgggcctgaccaggccgtggtggggtcttattggcggagatggggagaactttactccaggcccagagaatgacacgagcaaagctgggtgaagggtcagcaagtagacaggtgtgtccagagcagaaggaagcaggactttgaagataaatagaccctgttgagggctttgcaatgcagaacaaaacaaggagggtggattttattttggagacttcccctacccccgtccctggagctgttgctggcgtaatggagggacacagtgggatcacatgctgcttgtgggagggtgaattttgtagatccttgaaagggagtgggagggagggagagatcagatatagaatatcaagggaattggaacaccttgccaatgtagtcactatggcaagtcatttctagtaacctggggacatgccgtcctcctacagccctcccagagcccgttcgtacaatgttgcaggtatttgctgtgattacttttcccattttccagaagacctaggtgggatttggcctgaaggaacctggttctaagggcaggttgggggcaagaggggagacgtggggcagtagtcaaaagcgaggatggcagcagccaaggaagaggctttggtgaagagcggccgaagcgagaccataggacacgatcttgggcacgcgtgtctaggaggctgccccggcctgctcctccttcctgtggtgtgtgtgggtgccctggagtagatcattgggcagttgctgctttgctgcattcccaccggccagtgaatttgttttagtcctcaggtgctttacataaggaggaaaccatgtaaccttcacaagttttttcccagtcatttaaaaaggcttgttttccagccgaaggcatgtcgaata

SEQ ID NO: 43270 - DNA, 1004 bp, Homo sapiens
ccacaattttttttttttttttttttgagatggagtgtcgctgtgttgctcaggctggagtgcagtggtgcaatctcagctcactgcaacctccaccttccgggtgcaagcgattctcctgcctcagcctcctgaatagctgggactacaggcacatgccaccatgcccggctaattttttgcatttttagtagagacggggtttcaccatgttagccaggatgatcttgatctcctgacctcgtaatcctccacctgcttcggcctcccagagtggtgttttgttttgttttgttttgttttgttttgttttgttttgttttgttttagtttttgttgagatggagtttcgctcttcttgcccaggctggagtgcaatggtatgatcttggctcaccataacctccgcctcccaggttcaagcaattctcctgccccagcctcccgagtagctgtgattacctgcatgtgccaccacgcccggctaatgttgtatttttgtagaggcggggtttctccatgttggtccgtctggtctcgaactcctgacctcaggtgatctgcctgccttggcctcccaaagtgctgggattacagggtgagccaccgtgcccagcctaccgcagttttttttaaagggcatatggttcattttttccctctgccaagagggatgtgcagcatgagtgagaacaaagtctgttttgaactactgaggtttgagtttgttccagcagcataacctagcacatcctgactgataaggatcataaggaccataactgcccttggagttggagaacaggagcagatttgagaggtagaggattagaaggtgatatgttgcatgtgaaggtggggagaaagccagaggtctcacaggcgtgtctggtttggaccactatgtagttgatgatgctgtttacaaaactggaaatggaatccaaaagattcaggagagattacttttgttttggacatgttgagtttttaggggagacatc

SEQ ID NO: 43271 - DNA, 1035 bp, Homo sapiens
acttccatgctatataacactggaagccctagctagagctatttggcaggaaaaagcaaaagcatctatatccgtgcaagttcacagataacatgatcttatacatagaaaaatctgcaatttccacaaaaaaacttgttagaattaatatattcagtaaaggtgcaggatacaaaattagcacataaaaatcagttgcgttcctgtacactaacaaacactccaaaaagagaaattaagaaaatctaatttataatacatcaaaaaagttggaatacttaggaacaacttaaccaaggagtgggtaaagacttatacactgaaaactataaaaaactgctgaaataattaaagaagacataaataaatggaaagacatccctaaaatgcatatggaaccacaaaggatcccaaatatcctagacagtcttaagaaagaagaacaaagctggaagcctcacacttcctgacttcaaaacttattacaaagctacagtaatttaaacaggcagacatgtagaccaatggaacataatacagtgctcagaaataaatccacacatttatgatcagctgatcttcaacaagggtgcaaagaacacccaccgggggaaaaggtagtctctgattaatggtgctctgtaaactgaatatccacatgcaaaagaatgaacttagacgctgataccatatctcatatcataacacaaaaatcaactctttaaatggattaaagacttaagtgtaagacctgaaactataaaaactagaagaaaacgtaggtggaaagcttcatgacatcagtcttggcaatgatttcctgggtataataccaaaaacaaggtgacaaaagcaaaaaacaggcaagtgactactaagatgctttcagcaaaggaaaccatcaacagagtgaaaaggcagccggtggaaaggaattgaaatcctttgggaaaggatctcagcatgttcctgtgttcattgcagcattattcacagtagccacaagatggaaaccacttactgacatgttcgtca

SEQ ID NO: 43272 - DNA, 1016 bp, Homo sapiens
agcagctccagagggcctgtgatacctcagacaggcaccagaagaagcaagagcttgcaagctcctgaaaaaaggaaaacaaaagcctgagcacttatattagcctacgatttagcaaaatcttcttgcaggaagcctattttagaataaagtatgagtatctcatgtaatttattgagtactgtactgaaagtgaaaaagagaatgattgtatgggtacttgaattacagtttctactgaatgtgtatcactttcacaccacagtaaagtcaaaaagtgtaaaaccattgtaagttggagaccatctgtatatgcacccgacatcagtgcacccaaatatgtgaagcaaatattgacagccgaagggaaaaataacacaaaaatagtaggagattgcaatacctcactttcaatcattgttagcaccaccaggcagaagattagtaaggaaacagctgacttgaacaacactatagacctaacagacacatacaaaatattctagccaacaggcacagaaaacactttttctcctctgttgcgcatggaacattttccaggatggagaatattagatcataatacaggtcttaacaaatttaagatcaaaatcataccaagtatcttttccagccacaaggcgatacacttagaaatcacaaacagcaagaaaattcacaaagtatgagaactaaacacactgtccgggcatggtggctcccacctgtcatcctggcactgtgggaggccgaggcaagtggatcacctgaattctggagttcgagaccagcctggccaacatggcaaaactctgtctctactaaaaatacaaaaatttagctgggtgtggttgcgtgcgcctgtaatcgcagctacttgggaggctgaggcaggagagaatcgcttgaaccagggaggtggaggttgcggtgagcagagattgtgccgctgtactccagcctgggcgacagagtgagactctgtcacaaaaaaaaaaaaaaaaaaaaaaaccaca

SEQ ID NO: 43273 - DNA, 1025 bp, Homo sapiens
ttgctttatgtgcatctttaaatggccttcagatggaaccgtctggccattttaagcaggaagcctattcattagagaaccacatggcaggtaatctactttggctggttaacttagacctttcactcacacgtggtcagcttcagttggatgaaggcagcaacaactatctaagggttgaaaggttggagtactagcctggcttactttgcaggagtgacttctctagaactgctagcatgtcagatcagctcaaacatgaggtcatatgaagaggtgggcagattgaagtccgacaggcttccccactgcttttgccccagggtgcagatattagaacagaggctaccacttgtttctgtagaagaaaaactttgtccttcattttctgtgcctccaaatgtcacttaacctccagaagagttgtgttggtaaacataatgaagggattaaactagaaatgaattttgacagtttatagtgagagcttctgatttctgtcatgtggaacttcatgtctgtagcatttcagtatttgaagttcttaatattgttgcaaatataaaatgaattggggagagatgaacctctcaaacatgttttgttttttcaagaaatcatatctactgttccatctgtatttcatgtagaggtgtatttatgtatcatttacttgagaaaacacgtaaaaacagaccattttaaagctagtccgtgtctggtttgtcgccacatcaaatatgcacatgtaatgagttgtctggaactcaggcctttccctacagacgcgatttttgctggtggctaattctcaggtcagccttcaaaggtttgcataacctcagtgcacaccagtgaattctaggatggagaattaccactgatgacaatggttttataggaaaatgtactctgaattcttgtcgccctctgtaataggaggagtttgctgctttttttcctctctttgggcctcaggcgttgtgttccgtggactgggcaggctgtggtggtagggaagcggg

SEQ ID NO: 43274 - DNA, 1074 bp, Homo sapiens
accatcctggctaacatggtgaaaccctgtctctactaaaaatacaaaaaaatagccgggcgtggtggtgggcgcctgtagtcttagttactcgggagggtgaggcaggagaatggcgtaaacccgggaggcggagcttgcagtgagccaagatcgagccactgcactccagcctgggcgacagagcaagactctgtcccaaaaaaaaaaaaaacaaagttgcttcatttctcacatttcagaattacctaattatcttttattgactgttgtcagagaacatgctgtgtgatttcaagccttcaaaatttgttacggcatggcatacagtctgttttgtgaatgttctcatacacttgaaaagaatgtgtattctgcagttactggataaagtgtcagttaggtcaagctctttgatagtactgttcaagtctatccagctataagtgggttcatcttgcttccttaaggtctgtcaatttaagctgtgtgtgtgtgtgtgtgtgtgtgtgtgtgtgtgtgtgtgtgtgtgtatttgcctgcctcggcctcccactactggacccagcctttttttttttttttccccctaatagcgacaagatctcactatgtttcccaggctggtcttaaactcctgggctcaagtgatcctcctgcttcagcctcccaaagtgctaggattacaggcatgagctaccgcacctggtaattttttttttaatcaaagtctggacattatgaatgaaaaaactggaagttccaaatgatactcctccattgtggtttaagttttttaggtgtgcaaattagagtaccggcaaatcatcttgatcctgtcatggtttgctctttattaagtctgttttcattttgctcttaacccttaagatttggctctcctaggatcttagatgaaagctcagtgtttaccagcattcctctactttggttgggcttgacctttaatctctctcaacaggctgggagttgtggctcatgcctgtaatcccagtactttgggaggccaaagcaaatgcatcacctgaggtcaggaattcgagaccaccctgg

SEQ ID NO: 43275 - DNA, 1065 bp, Homo sapiens
atgtcagcaaggtcaggtgatggtagcgttttgtaggccatggtaaggatttcggtttcaccatggtgagatttgtggtttaaaagaaataactcaaatgccgtatgaaaacatgtcaagggatggagcctgcaaggcagtacttgggctagaagcagaagcatgtcctttggtcacagaagattcagttctaaaaagatcgttgaaaacgttgattttaccctccacacatgaggatgtacttacttatctgtcctagtttctaaactaattttcattggacagttgaagaaaatcttgatgttttatgttaaattgtttagcccgcccactgaagattttgagtttaatttttgatttaaaacctttcctattgtaaaaatacacagataataggattcttagagctgttaaactctagactaattgtttgcatatttatatccataatgatggatgttattttaccatattttgtccacatattaaagttaacacaattttcgttttctttctctgaactcatcatctgctttgttcttccttaatagcatcaccatcctgtggtcacctgatctcagcgtctaggtcaactttgattcctttcttcttgccctgatggccagtgacatacacagatcccatcgactctaactctgcagtcagtgtcttgtattcttctcctccccctaggtactgttggctcttgtttcctggcaccggttgtctcctacatgccatcttacacattgcagccaggttgatttttctaaagcacagctgtcattgcattgcttcccattggctagaaaataaaatctgagctctgtttcagttatctgttgatgtataacaaaccaccctaatacttactgcttcatagaataattttgtttgttgacagttttatgaatcaggagaattgagaagtgctcacctgggccatttttctctggtcgacatgttgtcagcagaggtggccagtgctggagcatccgcttccacaatgtcttcttcgttcacatgccttgtcaaagactgctggaaggccgggctccactggct

SEQ ID NO: 43276 - DNA, 1050 bp, Homo sapiens
tgacctcaagtgatccacccgccttggcctcccaaagtgctgggattacaggcgtgagccactgtgcccagccatgggacccactttactcttaatttccccaattcctagaacagtgtgtggcccacaggaaatccgcagaatatatttgcagaatgaatgaatgacttgccaaacgaattagggcaaatcagtagatatcgagtaaacatccacaaccacctgccccatacccttttcagctctggggagatggtggctccttgtggggtcggatatgggggtctcctttcctttcaccctcctgcctcgtgggggagtcaagtctccgcaggcggagagcccggatgcaggcgcgactaggcggccctctctatggtgagccccccggtccctcctccgcagtacccggagtgcctctatggttcttcctgtccttagtcgggagggggcgctgtgcgcaggcgcgaggtgacgccgcggcagggccggaaggagtgcagcggctgccacggagctcgcagctgcggcttctgaggagtaagcggcgcggtagcgaaggccgccgaacctgcctggctagccggcgacttgagtgacgagtgagtgtcggctgcggggcgcgctcgagctcctgggcgggtctgtgaggcgacgcggcctctctgaggggcgcctctgtggagctccgggggtgggggcgggggcgcgggccgtgagggccgccgagctgaggggcgcgggccgaggcccgggcgggatcgggccaaggggctgggctgggcgtctcgagcccggtgcggtggcgaggctggagcgacaaaggcgctgagcggccgggtggccccctctcgccacttcgcgaagtttcgcgggccggcccctcgggtctgctgcgcgagggcaacagcccgggagaccgcgcttccctcccccgggcccgaggccgccgcggaggcggtgtccgtgcacccgagcgcggcctggaggagcggcgggaggcgggccgtgcctgtgaaccccagcccaggcgggcggcgtttttcctcc

SEQ ID NO: 43277 - DNA, 1059 bp, Homo sapiens
aaaaggagagattataaaatcaaacacaatgtacgtttcagttttttaattttcatttttagagatagggcctcactctgtcaccgaggctggagtgcagtggtgcaatcatggctcactgcagccttgaactcctaggctcaagcgatcctcccacctcagcctcctcagtagctgtgactacaggcacatgccatgacgcccggctaattttttttttaaattttttgtagagacagggtcttgctgtgttgcccaggctggtcttgaactcctggtctcaagtgatcctcctgccctcagcctcctgagtagctgggattacaggctgtactttttagttgttttaccaggatgcatggcacattgggaagtgagaggactgtgaccaggagccaaaagctctgcgttcctttctgtagaatataggaagacacctctttacagatcattctgtcaacagtgcttcccttgatttgtgcgatgatgtgagaaccttgcgttggatgttgtaacttgagctgtgtaattcctataatattaaagtaatgtagaatattgtgtttgtgttttttaaacaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcaggtagtgatggccggttacttcaacgcctcttattgctctagtgattatagcgggtttccattgtcccttccagtagaatggagaataaaatcttagaattgattttttttttttttttgagagggagtctcgcactgctgcccaggctggagtgcagtggtgttgtcttggctcactgcaacctccgcctcccagattcaagcaattctcctgcctcagcctcccgagtagtgggattacaagcatgctccactacgccaggctaattttttgtatctttagtagagacggggtttcaccgtgttggcca

SEQ ID NO: 43278 - DNA, 1030 bp, Homo sapiens
aggatttctactatcttgcaaaagttttttgtataaaatgaaaccttggctgggtgtggtggctcacacctgtaattccagcactttgggaggtcgaggcgggtgggtcacttgaggtaaggagtttgagaccggcctggccaacatggcgaaacctcatctctactaaaaatacagaaactagctgggcttgtatgagagcgcctgtaatcccagctacttgggtggctgaggcacgagaatagcttgaactggggaggcacaggttgcagtgagccaagatcatgccactgtactccagcctgggcgacagagcgagactctgtctcaaaaaaaaaaaaaaaaagttattttaatggagtttaaaatattttctccttacaggttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggtaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagt

SEQ ID NO: 43279 - DNA, 1034 bp, Homo sapiens
cggaggctggggctggaagagccagatgatggttctggaggcggggcctgtttgttctcgtccacttcctggcactcagctgcagggtgtgctggcaggactcactccccttggggtagcagctgtggcctcagcaggcacaggaggtatctgctggtgttcacaaagaggagcggagggctgggggccaaccccacagcgaaggccggtaggaaacttcctggggcctggtgggtgagactccttcccggaaaggccggaggggcccgcagggtttgcaccttctcatggctaggcctttagatgtccaggtcaaactctgacccttcaccacctgcctgctgttctgggctgtctgtatgtctgccgggggctcatcactggcagggctggtgaccccggaagtggtgggcgggtccctcgagggtgttttggtcactggtgagttcagcactctattgggaatttccagttgtacatgatcctggtacctccccgggtagtgctgaagagtgtgcccgatggggttgctgcattccctgcgcagtacacagtcattggaccaccggggagaggcaggggtggcctggcgtgggggtccggctgcagctgctgccctggacatggtctctgtacatgttttttttttaaatgctgaggaaaatatgaagcttaaaatagaatttgttcaaattgtgaatcctggccaggcggggtggctcatgcctgtaatcccaggcatgggattttgggaggcagaggtgggaggattgcctgatgttaggagttcaagaccagcccggccaacatggtgaaaccccatctactaaaagtacaaaaattagccgggcgtggtggtgcacacctgtaatcccacctccttgggaggctgaggcaggacagtcacttgaactgggaggcggaggttgcagtgagctgagatcacaccactgtactccagcctcggcgaaagagcgagactccgtctcaatataaatagtgaaccctgtttcagtgaatagtcgagcttagac

SEQ ID NO: 43280 - DNA, 1063 bp, Homo sapiens
ttaatacaggggagggctgtgattgaagttagaggtactttgtttctggttgacaaagtccatcaactgttgggtgctggtttgtgatggtttctttgccagctgaggaagccttcctgcttatttctaggttttagaccattctgcagcattgactttgttgaaaatctagattgttcttaagtgtcagatgttaatgtatttagaatgacattaatatttagatgcccatgtaatgagtaaaaaaattagagaaataaaactatttttttttacttcaaggtccttatgttatggccaatgttgcaacaaaaatttttcaagaattggtagaaggtgtgttttacatacataacatgggaattgtgcaccgagatctgaaggtaagtgggggcgatgaaatcattgaaagcagtgggagctttgtatcagggacgacttgatgttggttgattaaactaaataagattacatgtcctagttcatttgcttaggaggttataattactgtcagataagtcattgttcgatagatccagagtatggaaacattaggtcgaatttttttttttttttgagacagcatttcgctctgtcacccacgttggagcgcagtggcacgattacagctcactgcagcctccaactcccaggctcaagcgatcctcccacctcagcctccctagtagctgagactacaggcatgtgctaccatgcccagctaatttttaaatttttttttgtagagatggagttttactatgttgcccaggttgatcttgaactcctgggctcaagtgatcctcccatcttgacctcccaaagtgctggggttacaggtgtgagccactgcacttggttataagttgaattttaaagtagtaattttggggcatttgaaaatcctctgtggagtataagtactttttttcaggtgctctgagtactgctataatcaggggtgctaaatgtatttagtgctgacagaaatgctcatttattattgcagacttagaggtaaactctatttctataattattcatcttaaagtttaacaaaatc

SEQ ID NO: 43281 - DNA, 1056 bp, Homo sapiens
gctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggtagattactttcccagaccctcctaatttggccagtattggtgactgtgcaggtgtgtggccttctctcgccctctctcagctctggcgcttctgccctgcgttcagtctcttgtactggccatgttccccttgccatggggcctttgcgtttggttctcccttcttcacttagttaactcctccacgtccttttctggcctccccgacctggccatttacagcttcagatcatcttgagtgtgtaccctagagttggcggcctcactcacactctgtttgtgttgtatgttagcatcatgctataaagatatatttatgcaaaacgattttgcagcatgactttaggtgagtcccagtaggattagcagctcagtattcgggatattctttttaattttaaaattggttttatgttagttgtagttttcaggaggctcttgttgagggtcatactgatacaaccctccttccatggccacgctgccaccatgctttccccagtattttaagtagtaatattaaaaacatgaacattaggccgggtgtggtggctcacgcctgtaatcccggcagtttgggaggccaaggagggcagatcacctgagatcaggagttcgagaccagcctggccaacatggtgaaagcgcgtctctactaaaaatacaaaaattagccaggcgcgatgctgtgcgcctgtaatcccagctactcaggaggctgaggcaggagaatcgcttgaacccgggaggcaccgtactccagcctgggcaactagag

SEQ ID NO: 43282 - DNA, 1050 bp, Homo sapiens
gtaatcctagcactttgggaggtggagttgggcagatcacttgaggccaggagttcgagaccagcctggccaatgtggcgaaaccccgtctttactaaaaatagaaaaattagctgggcatggtggcacacgcctgtaatcccagctacttgggaggttgaggcagaagaatcacttgaacccgggaggtggaggttacagtgagccaagatagttgtcactgcactctctgtctcaaaaaaaaatttcttttacgttattctagagaacattctccaagtttaacgtgtttataaatatagtatttttcctattgaggtttttgtatatattgctattattacacgttattctctgtgtacactttaaaattgccattttattaaagatgtttctaataatagtttttcatattctttttatagtactttgccagacgtttatcaaaatggggctgctgtcttctttcacttgtagtgacgagtttagctcattgagactacatcacaacagagctattactcacttaatgaggtctgctaaagagagagttcgtcaggtaagccctaaaaaatatactttgggtatgacaaaaatatactttaattttaagataattatattttaaagcactgtgaaattctgattataaaacaagtttttaaaagtataaactctaggccaggcatggtggtgtggctcatgccttaatcccagcactttgggaggctgagatggatcatttgaggccaggagttcaaggctgcagtgagccatggttgtgccactgcactccagcctgagcagcagagtgagaacctgcctgaaaaaaaaaaaaaaaaagagaggagaggcaaaggagaggccacagatggactgggatcttgagacaatttcaatttatttttgttttgttttgtttcgttttgagacagagtctcgcactgtcatctgggctggagtgcagtggcgcaatcttggctcattgcaacctctgcctcccagattcaagggattctcctgccttagcctcccaagtagctgggacca

SEQ ID NO: 43283 - DNA, 1019 bp, Homo sapiens
ggtctcaaactcctgacctcaggtgatccactggcctcagcctcccaaagtgctgggattacaggcatgaacaaccgcgcccggccatcctctgcctaacttctttctttatgcctgggtcttggctgtcttctcaaaggaaggaagccatcctagtcccacttccttgcgtattgatttatttgtactattggacacatcagaaaactgtttctcctctgtctcacggcatctttctgctgatcctccagcttccaggattcagctccaaattcacttccagaaagcctttcttgattaacccaactcagcataactattcttttggtttttatctgcttacatttaaatatttcatgtttcattaattagaatatacggttttgtcattatgagacaggtttaccattaatttaaaaatattttcctttttaatttttagaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagcgtaagtaagaataaatgaatcttgctaaataaagcttgtaaaggctgggctccgtggttcatgcctgtaatcccagcactttgggaggctgaggtgggcggatcacccgaggtccggagatcgagatcggtttggctaacatgacgaaaccccctctttactcaaaatatggaaattagccgggtgttgtggcaggcacctgtaaccccagctactcgggaggctgaggcggagaatcagttgaactggggaggtggaggttgcagtgagccgagatagcgccactgcactccagcctgggtgaaagagtgagactgtctcaaaaataaataaataaagcttgtaaaaatactgtgttgctgttctcacttattcatgggaggtaaaaattaaaacaattgaactaatggagatagag

SEQ ID NO: 43284 - DNA, 1052 bp, Homo sapiens
acacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccgcctgggaggttgtcaggttgctgtggatgtaaggataggaggtgcccagtgctccgctcaaggaaggctggatctgggccccacctacagagagggctcagggctggaccgggggcattgtgtgcttgggccgacccgggccggtggcagacgctgttctctgtcgggagatttgcgtccccaggaccctgttacacagtgggctgttgggttggtggctggcttttcctctatggacttcctcttcctgccccacctgcataggcacacacaccttgaatctgcaccctctggagggcatctgtactcctgtgcaaaatgcccagtccagagacaaaacctcagactttgtgcacctaggtttccttctcagcagcggagactgttctttgagttgccttgaagtg

SEQ ID NO: 43285 - DNA, 1039 bp, Homo sapiens
gtggcctttctgaaaacgcagtggtctgtgcaggtccagggccccctcttggacccgcgggctccctgtgcacggagcgcagactcacggggcccttctgcttctaggagggcgtgtgaagacctggaagcgccggtggttcatcctgaccgataactgcctctattactttgaatacacaacagtaagtaagggccaggcctccttgccgcctcccagcagtcccggagctgccctggggccgagggaccctcaggctggtgacccacagtgagccccgccgtgtactttcctcttgtaggataaggagcccaggggaatcatcccgttggaaaacctcagcatcagggaggtggaggacccccggaaacccgtaagctcttcctcctgaaccttctctcctgccagccacctgggagccatcctcactgcctgcagggaacctgccccaagcccccctgaccgcctcccctctctctttctccaccagaactgttttgagctctacaatcccagccacaaagggcaggtcatcaaggcctgtaagactgaggccgacggccgcgtggtagaggggaaccatgtggtgtaccggatctcagccccgagcccggaggagaaggaggagtggatgaaatccatcaagtgagtggggcctcgggggcggggccaggcccgtcttctcgtgccggttggagggcgggggatggtctggaacatggatgcttccgtgtgcaagagtggaccttctgtctccagaaaccccagagggccgggctgccaaagccgacgttcagatctgagcctgcggtcctgtctgaggggcctctggggctggtgggaaaggggaggtctgtgtgtcacccacgacctaacctgtgtgttttccttttttcaccagagccagtatcagcagagatcccttctatgacatgttggcaacgaggaaacgaaggattgccaataaaaaatagctttcctggctaaaagacccaggtaaaagacccaaccccagcagaaagacaccgcgggcggcccc

SEQ ID NO: 43286 - DNA, 1062 bp, Homo sapiens
aaatacaaaaaattagccgggtgtggtgacgggcgcctgtagtcccagctactcgggaggctgaggcaggagaatggcgtgaacccgggaggtggagcttgcagtaagccgagattccgcccctgcactccagcctgggcgacagagcgagactctatctcaaaaaaaaaaaaaaaaaaaaaaaaaaaaagccacagagggggtgcgtaaacaatggaaatgtattttcttacagttctggaggctggaagtccgagatgagggtgccagcatgattggtgtctggtgagggctctcttcctggcttgctagtagccgccttcttgctgtatcctcacatgctggggagtaaggagaacttactcactctagggtgatgttcttataagggcacaaatcccatgaggccaggacctcatgtaacactgattacctccaaaagaccccgtctccagatagcatcacagtgggggtttgggcttcaacatatgaattgtgggggggacacggacatttcgttcacagctgcaaaggatgatctcacatgcttcagacacaactcaaaattatatctacctccccatgcccctattaaacctgtaacactatgaagcatgaagacattgtcagagcaaataaattccttccagctaggatggtgttttctaagtctcagagtgatgacactttaaacagggagctttggtttgttgaggtgcattatttctagaagtagtacttgagttcattaatgagtaagagggaaggtttgattagatcaaggaagctgaaaacactctgcagcctctcctttattcctgatttcctagaaatgccttaaataaaatatataaatctatatgacaagcaggggtccactcagtggactagaaattgaggaatccctggaagaagataaatgggatcagctggagaaggaaacactccccacagcacatacaagaaagaactgccgggggcggcaagagcagcttcagagttccccgagtgcagaggaggtacattcagggaacaggactgtgggagggacgtcgagactgg

SEQ ID NO: 43287 - DNA, 1044 bp, Homo sapiens
ttatatggacattttttattgcatttagatcccctggataatccaggataatcatctccattgaagatgctttttcttttctttttgagatagggtctggctctgttgcccaggctggagtgtggtgtgatctcggctcactgcaacctcccacctccccggctcaagtctcccacctcagcctcctgaatagctggaactacaggtgcacaccaccatacctggctaatttttgtatttttcatagagatgaggttttgtcatgttgcccaggctggacttgaactccagagctcaagtgatctgcccacctcggccttccaaagtgttgggattacaggcatgagccaccatgcctcgctctccatctattttttttttaatctaaaattcttaattctatttgcagagttccttttgtcatgtaagttaacattcacaagttctagagattaggacctggatatctttgggggtcaatgattcagcctactacaattttctgtggggtcttgaaaaacatgaatattatgctgttggtgggagtgttctataatctttctgagactttgttggttgatggtggtggtgagttcttctctatacttgctgattctttggttcattaattattaacaagagagaaaggcattgaattctctgactataattgttgatatctctcagctctgttgttgctggaatcacatattttgcagctttgtttggtgcatatacatttagaattgctatgtctttttgatggatcattatatagtatctgtctctggtagttttctttgctctgaagtttactgtagctgttttattaatatagccacacctgctttctttttattaatgtttgcatgatatctttttcatccttttacttcagccaatatattcgaatataaaatacgtgtatttgaagtgagttttttgtagacagcatctaggtgggtcatgtataatttttaaattctactctgccaatcttttaatatttaacatttatatttagaccttttacatttaagatga

SEQ ID NO: 43288 - DNA, 1121 bp, Homo sapiens
aactgggagggaagcaaagtcttgagggtgcagagagatcaggaaaagaggcaagtttaaaactcagatgcaaacgggggcaagaaagcagaacaggtaaattgttgcaggttatggccagagaataatttctctggagatcaggctcgttggagagcctgttccgacagtgaagattcaggtggtgttagcagggtgccttgtggcccgggtcccgatgcctttaaaccattatttgagctcctgccctttggtttgatcatgtgctcacatgacaattttccaattataaatgggatccccacttgggggataataatcatgttaatatctaggattctcttacctgtgataagtttttatttgtttctatgaattgatcaatcagcattgagagaatgcagtaaactatatggccaaagactcatatttgtttggtagctgttatttcttattgttaatttatacatgggcacactggtttgatacatacatttctccagtgtgctgaatgtgtgtgtgtacctgagaggtggatctgttcctggcacgtaaagcagtcctggagatgagcactgctgggtgaggctgcctgggagacaccccggcctcaccaccctgcaaagactgagacgctgtcttgacatcatctgagctgtgagcaggctctgccctcctgcagggctctttggagtcttcgtgctcactctgtttcctttgcccaggaggctcttctcccagtccccactcttggtctggccaactcctcttcctcctccaagtcccttttctcttttctctcgtagagtttatcagtgttttgaaataatacatttgagtgttaagtgctgcgttccctactaactaaacagaaagcgtgaggagggcagaagccctctgcccgtccccactcatgcatcatccgactgcagacagttgtctggagagagcaggcaggcagtagtgtttgatgaagtctaaggcgtgggttagtacaggtgagaggggaaaggcctgggtaactcagggagccgagtggctggggtgactgtggggaaagtgaaggcacagtaggaagtctgtgagaacagctctgtgtggagccacaaaatcactgattt

SEQ ID NO: 43289 - DNA, 1076 bp, Homo sapiens
ctcttatgcctggaggtgagaagccctaatttttgcactcaatgtctattaacttttcaggccagacttagggcagagagttgctggcttgacaagttttggggaagaaataccatttttagagcacctgcaattaatcatgagactaggtgtgcatctattgaccacagtcaccttgggaggcacaagttttacctcctagagaactgaaggggcatgtcccaggacacccatggcaagctgtgaaacttgcattgtggaacccaggtctccctcacctggttctttttttgttcccaggcctctgtgcagcctcacgattggtgacccttggtccattctggggtcccagcacagggactgcctagagggtggcagtggggtctgggaggagtatgggaggcactgggtaggatggtgttgaatgtagtatgacagggaattcctgtgactcagagcatctggctccaatcttgagctcatccccctttaggccttcacttgttgaaaatgtaaatgatcctggacctacatagagtcccttaagaaggcccctcttcacgcctgtaatcccagcacttttggaggccgaggcgggcggatcacaagatcaggagtttgagaccagcctggccaatatggtgaaaccccatctctactaaaaacacaaaaattagccgggtgtggtgacgagtgcctgtagtcccagctactcaggaggctgagggaggagaatcgcttgaacctgggaggcggaggttgcagtgagccaagatcgtgccactgcactccagcctgggcaacagagtgagactccgtcttaaaaaaaaaaaaaaaaaaatgccaggcgcggtggctcatgtctgtaatcccagcactttgggaggccgaggcgggtggatcatgacgtcaggagatggagaccatcctggccaacgcggtgaaaccccatctctactaaaaatacaaaaaattaggtgggcgtagtggtgggcgcctgtagtcccagctactcgggaggctgagacaggagaatggtgtgaacctgggaggtggagcttgcagtgagccgagat

SEQ ID NO: 43290 - DNA, 1074 bp, Homo sapiens
ggcaaccatcaatttgctttctgtctctatggatttacttattctagatatttcctataaatggaatcatacaatatgtggtctttgtgtttggcttcttctacttagcctcatgtttttgggccaggcatggtggctcattcccataatcccagcactttcacaggctgaggcaggaagatcagtggaggtcaggagtctgagaccagcctgggcaatatagcaagaccccatctctattgaagataatgttgctggccgggagcggtggcttacgcctgtaatcccagcactttgggaggccgaggtgggtggatcacaaagttaagggattgagaccgtcctgaccaacatggtaaaaccctgtctctactaaaaataaaaattagctgggcctggtggtgcagcacctgtggtcccagctactcgggaggctgaggcaggagaatcacttgaacccaggaggtggaggttgcagtaagccgagatcacgccactgaactccagcctggcaacacagcgagacttcgtctaaaaaaaaaaaaaaaaaaaaaaagataatgtttctgaaattcattcacattgtttcatgcatcagctcttccttccctcttttttgtttgagacagggtctcactctgtcacctagggtagagtgcagtggcatgatcacaactctggccaacctcaacctcctgggctcgagtgattctcccacctcagctccctgagtagctgggaccacaggtgcgtgacactatgcctggctatattttattttattttttataaatgcggtcttgctatgttgtccaggctggtcttgaactcctggggtcatgtgattctcctacctgggcctcccaaagcgctgggattacaggtgtgagccccctcacccagccgcttccttccttttggtggccgagtagtattccactgtgtggatttattaccatttgtttctccatctgtggatggacatacggcctgttcccaccttttggttattgtgaacagtgctgctgtgagtattcacatacaaggatttgtttgggtgcctctgctgggaac

SEQ ID NO: 43291 - DNA, 1027 bp, Homo sapiens
tccagcctaggtgacagagcaagatgccatctcaaaaaaaaaagccagctgtgcatggctgcagtgctgcgtgttcagtgtcgctcgctgtctctccaggtgattctcataggcaccgcagcgggaggcctgctggcgcagatcggcggctctcccactttgctgcccagtagaacctcttgaggagcttttaacactgctgaggtccaggccgcaccctgggccagttcaatccgaatctctggggaggtcagagagaggctaagaaaacaaagatcctttttcatgtagagcagcatggtttatgaaggccagtccctgccagagtgggtcccactgtgtagtgagcgtgagtggagaggcggtgtcccctcctctctgtgccgcaggacttgggctgtcattgcagacactgcagggctccgactttgcgtgctggtgcgtgtgttcactgtttaggccccatgcttgtttcttgctcctgcaggtttacgagctgccgtttttagtggctctggatcacaggaaagagtctgttgtggtcgctgtgagggggaccatgtctctgcaggtaacgttggaacctgactttccagccctgggagtgggtgcgggagcgggagcccacagctgctcggctggggaaatccgtcagtaaccgcatgagacacaggggaaaatggtgaggacagaaaatgaggatgtgagcctggggttgggaaatactccctttgcaaaaagggatgaagctgtttcatcttcactgagaactgtcagcagcagagcggccagcaggttggcccccccgccacaggagctcccagagggcacctgcttgacccctccctgcctaacttccctgagcccagccaggccccacacccgggagccctcccggggaatttctgcaccagagccagatggcggcagtgagtcagtcttgctgcagagagtcacgcccctggccaccagccccgctggaggctcccggtttggatcctcacaggccctcgtggcctgccgttct

SEQ ID NO: 43292 - DNA, 1974 bp, Homo sapiens
ggtctcaaactcctgacctcaagtgatctgcctgcctcagcctcccagagttctgggattacaaggtgtgagccactgtgcccagccccagtaataccctttttagcaatttttttctccaatccaggatgatgcgttacatctagttgctgtgtctctttggtctccttcaagttttaagtttctcagccgttctttcctttcatgatattgacattttgaagaggacagtgcagatattttgtagaagggccttcaatttgcatttgtgtgatggtttccccatgattagatttatgttttgcatttttggcgggaatggtccatgacaaccatccttcctagtgtatcatatcaggggatacatgatgccagtttgtcccatttctggttatattaacattgattgcttggctgaggtggtgactgccagccttgagaccatttaaatatcttgtcccaggccgggcgtggtggctcagacctgtaatcccagcattttgggaggtcgaggccagcggatcacttgagctcaggagtttgagaccagcctgggcaacctggcaaaactccatctcactaaaaatataaaaattagctgggtgtaacagtgtgtacctgtagtcccaggtgcttgggaggctgaggcaggagaaacacttgagcccaggaggctgaggttgcagtgagctggggttgcaccactgtactccagcctgagtgacagagcaagacgctgtcttaaaaaataaattaaataaatatatatgtctatatcccaccaggtgcagtggctcatgcctataatcccagcactttgggaggccaaggcgggctgatcacctgaggtcaggagttcaagaccatcctgaccaacacggtgacaccccgtctctactaaaaatacagaaattagctggacatggttgcacacacctgtaatcacagctactcgggaggttgaggcaggagaatcgcttgaaccagggagttggaggttgcagtgagtggagatcacaccattgccctgcagcctaagcaacagagcaagattctgtctcaaaaagaaaaaaaaaaaagaaaccaaaacaaaacaaaaaacaagtaagtaaatgtcctatccctctctgaattctcatctggcagtacagcatccattgattcttgtctgaatcacttattaccaggatggtggcaaaatcatgatttttctttttctttctttctttcttttttttttttttttttttgagacagagtctcaggatcctggctcactgcaacctccatctcccaggttcaagtgattctcctgcctcagcctcccgagtagctgggattacaggcctgcaccaccatactcggctagttttttgtaattttaatagagacaggttttcgctgtgttggccaggctggtcgaactcctgacctcaggtgatccactcgccttggcctcccaaagtggttggattacaggcatgagccaccgcacctggccaaaattgtgatttttctaaattcatcatttcttctacattaattgtcattctcctataaaaaagagctttttatccctacatcttactgtcaatatggatttatagattcttaaattattcagtgggttgtaattatgactgtttattttgtattaagtacagtgtttatttgatgctcaaaatgttccagattttgtcctgcagactggctccagtgttcttttcatatgaccccatcatgttctgagcacttcctaacctctggattttgctttttctttttttgggactgttgcccaggctagagtatagtggtatcatcacggcttactgtaacaccataccctcaacctcctgggctcaagtgattcacctgcctcggtctcccaaagtcctgggattacaggtgtaagccaccacgcctatgtatttattttaaagatcatgagattttactaatatcttttttttg

SEQ ID NO: 43293 - DNA, 1022 bp, Homo sapiens
ggaggatgcagtgagccgagatcacacccactgcactccagcctgggaacagagcgagactccgtcaccaaaaaaaaaaaaaaaaaaaaaaaaaaaaaaaaaaaaaaaaggaaaaggaaatatcaccagaacggatatcactgcactcttcacgaaaaagaaaaagaaaataccagaacggatttcaccgaccggcagacctgcaatcgactcagccagcgccttccggatcagcgtttctgcgcaggcgcagacagctccggcggaagaggcggtgtagggctcagtgcgcttgcgccgatctcggcctcagcgtgagcatgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtaaggacggcggctacgggggcggtggagcccaccggagagggagcggggggcgagctgtcccttgagacggtgacagaagtggcttcccaagcactgtcgcggtcccagcgctggccacgcatcctcttatcgagttctcaccactgcccgaagaggtgggcagtggtgctgtgtccatttgacggatgacaaaccgaagcccccagagtgtgtgggctgaccccgggggacaaacagggggtttcgaagtccgcgcagcaggacgcgagcacccctttgtgtgcagcgccgagacctggccctggggtgccacgagggtgttaccgccggcaaaagccttggcctcgagttctcctttcttgaggcgggagcagccacttgtgcccttccttccctttgtacggggcacttgaatctgcaacacgaaggataggaaaaaataccgagccggttgtggctgcatttcgtg

SEQ ID NO: 43294 - DNA, 1955 bp, Homo sapiens
gccactatgaatttagtggcactttcaatcaaatttgtatttttaaaatacaattgcttatttcctataccttactatgtagaatcttgtgtgtgggagacttctaggaatgggaagaaggaagctaagtttgtcaatatcagtaaccttttgttttcttttcttctctttgaaattctagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttaattacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggc

SEQ ID NO: 43295 - DNA, 1032 bp, Homo sapiens
aggttgcatgctccttatgaaaatctaatgcctgatgatctgtcactgtctcccatcacccccagataggaccatctagttgcaggaaaacaagctcagggctcctactgattctgcattatgacgagttgtataattatttcattgtatattatagtaataacagaagtaaagtgcacaatgattgcaatgtgcttgaatcatcccgaaaccatccatccaccctgctggtctgtggaaaaattgtcttctatgaaaccgatcactggtgtcaaaaaggctgggaccactgggttatgcagttgccaagctgttgttctattttgggccgacatgccccactccccactcatcttaggctgctttgtggtaaagaaagcaagagtgtttcctctgagctcctggtgggcagtgggtcgtgatggaagcttgccatttctcttccagatcctctggaccttctccatctacctggagtccgtggctatccttccgcagctatttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaaggtatgttgggtgcgacctgcgttgtttctagagtgacgtgttcttttaggagtgcccttgcccagcactcttctaatctggcactctctcataaactggctccagagaaacactttcatgattggccaataacattctggatcaggatgttgtctttttaaatataagaaccctttttcttttgcaatagcttttcctaaagtgacacattttcactgtaaaagattcatctggtgtttcagtgaacattaacaccagatacctctctatgcatacacagacacatgacttaaactgtacattgctgttctatacactgcttttatcccctc

SEQ ID NO: 43296 - DNA, 1050 bp, Homo sapiens
gaaaccccgtctctactaaaaatacaaaaaactagctgggcgtggtggcgggcgcctgtagtcccagttacttgggaggctgaggcaggagaatggcgtgaacctgggaggcggagcttgcagtgagccaagatcgcgctactgcactccagccttggcgacagagcgagacgctgtctcaaaaaaaaagaagaaagaaaatcaaaaattagctgggtgtggtatcgcacgcctgtaatcccagctactcaggaggctgaggcaggagaaccacttaaacctggaggcggaagttgcagtgagccgagatcgagccactgcactccagccttagcgacagagcaagactccatctaaagaaaaaaagttaatttcatggtcatgtctggttatctagaatggacctatttgcatgtttgcagatcgtgtaggttttcatggagttttttgtttttattttctggtttggcaaactctagtgcaatgttcatgactggtgtaaaaaaatcgtagatgagaattaagcacccacatatttaggtgtctgctgacagtttactgtctgattcatttgaaatagaaacttgaaactgtatttcattatcttgacttcagtggtaccaaacacagagccctgcctgtcccagtgtgggaagaacaaggtctccctcctgtagcccacattttgtttgcttttcatgtacagatgtgcactgatgtcgtgtctgtgaccctgcttagcagcactctgcacctcttgcctttaggaaagctggtttgtggtgcccctagtactgtgcagtgagctgatctgctcctgagtgcctcttctttccctgctgaacaggcaaacggtgctgcttcacatcctggggccgatcaagtcactgtgctaccctgggtgtctgatgggtgctgggagtgcctggacttttctttttttttgagacagagtctcgctgtcacccaggctggagtgcagtggcatgatctcggctcactgcaacctccgcctcctgggttcaagcgattctcctgcctcagcctccc

SEQ ID NO: 43297 - DNA, 1037 bp, Homo sapiens
ctctaaaaaaaaaaaaaaaaaaaaaatacaaaaattagccaggcatggtggcatactcctgtagtcccaactactcaggagggtaaggtggtaggatcgcttgagccctggaggttgaagctgcagtgagccgtaattgcaccactgccctccagcctggcagcctgggtgacagagcaggatcctgtctgaaaaaaaaaaaaaaaaaaaagaacaggggctctcaggatatgtaataggagtctgatttctttctttctttccttctttctacaaatactgagcacctgtgcaccaggcactattctaggccatttggttattagcatacccaaggaagtaatatttcaactgaatcctattggtatggcacctaaacaacctccccccaacattttgtgttcaagagcattttcataagcactgttgaaaggagacaaagcagtatgtgagtctggtctttactaaaaagcaaatttgagtcacttataatggattcttcattaccaaatgatgggaacctagtattcaggaaataatgagcttacttaaaaatggttaggtccccacttgtctaggcaagttaaaactgcaggcattagaggtgtgtgagcaagaatcctctctccccctcaggatgcccaggtttcagaggaatccatgcttgcttggttgtagtttctaagcacgatgtcctgaaagtctggcgtgagacccgaggtgctcgtgtctttttactttaacttctgtgtgctggtgagaggagagaagcagctgttcttctccaggtgctgctaaggccttagtggaaataacgcccatcaagtttttattaatgttgagctggccacagtctaggtcctggtgagaggcctctctgctgtgagccttggctagatgcgctgagggggctcagtgcatgtgtagatggatgtgtgtcttgtttatgcatgtagattttgttttgtatttattcacatacatggtgaggagatcgagaccatcctggccaacatggtgaaaccccatctctacta

SEQ ID NO: 43298 - DNA, 1012 bp, Homo sapiens
ggcggatcttgagggcaggagatccagaccatcctggctaacacggtgaaaccccatctctattaaaaatacaaaaaaattagccgggcatggtggcgggcggctgtagtcccagctacttgggaggctgaggcaggagaatggcatgaacccgagaggtggagcttgcagcgagccgagactgtgcactgcactccaacctgggtgacagagggagactccgtctcaaaaaatcaaacaaacaaacaaaaaaaaagtttttgttcttggccggtcttagtggctcatgcctgtaattccagcactttaggaggccaaggtgggtggatcacttgagcacaggagttcaaaaccagcttgggcagcatggtgaaaccctgtctctaccaaaaatacaaaagttagccagccgtggtggtgcgctgtggtcccagctactcagaaggctgagtggggaggattactggagcccaggaagtcgaggttgcagcgagccgtgatcacaccattgcacttcagcttgggtgacagagtgagactgtctcaaaaacaaaagacaaacaaaagagagaaaagtttctattctcaagaaagctgcaatgtagttgaaatgataggaaaatgtacaaaagatggccgagcacggtggcttacacctgtaattccagcactttgggaggccgaggtaggtggatcacctgagtcaggagttcaagaccagcttggccaatatggtgaaacccatctctactaaaattacaaaaaagttacccgggcgtggtggcaggcacctgtagtcccagccactagggaggctgaggcaggagaattgcttgaacccaggaggcagaggttgcagtgagccgagatcgcaccactgcactccagcctgggcgacaagaatgaaactcttgtctcaaaaaaataaaaataaaaaataaatattaaactttgctgatggacatagaagatgacctgcatgtatgttcatactacggtcctggagagcacc

SEQ ID NO: 43299 - DNA, 1050 bp, Homo sapiens
gtaatcccagcacttcgagaagtggaggtgggagtatcacttgagccaaggagtttgagaccagcctgggcaacatagagcctcatctctacaaaaaaaattaaaaagaaaaaaaaatgccgggcacagtggctcacgtctaatcccaggactttgggaggccgaggcgggcagatcacctgaggtcaggagttcaagaccagcctggccaacatggtgaaaccccatctctactaaaaatacaaaaattagccgtcgtggtggcatgcatctgtaatcccagctactcgggaggctgaggcagaagaattgcttgaactggggaggtggaggttccaatgagctgagatctcaccattgtactccagcctgggcgacagagcaagactctgtctgaaaaaaaaaaaaaaaattagcctggtggcatgtgcctgtagtcctagctacaagggaggctgaggcaggaggatcccttgagaccaggagttccaggttacaatgagctatgatcgtgctatgatcgtgccactgtactgtagtctgggagacagagcaagaccctctctcaagagaacgagagagacagagaaagagagagagtttctagccctgcagcggagacccacgggccttccccctgcctctcacttccaaggtaactactttgagagcaggagccacagtccctttagctttgaacgccagttcctggctggcacagatagcaggggctccctgaatacatgtaggattaagttgaaaggaggccagtgttgggtacggagcctcatttagctaaggaagcaaaggagtggacctgggcaagagcctgggcaagagcttagagataggactgaaggtggcagaaacggggttcctgccagatatctgagtgggcagctgcagatgggcctggacagagaagcaagcaggaagactggaggcgtggtgaggggctcgtgggttccagtttcctccagcagagccatctagagacgaggtgggagacagtgggtggtggggatccctggctcagggcttggcctggcg

SEQ ID NO: 43300 - DNA, 1026 bp, Homo sapiens
tacctgggtctccctctttaaccaaatgctcgttttcatcttgtttcttattttctgttctgttcccaatgccttgaatgataccctgtcatggcaggtgcttagtaagtatcatatacgcaaatgaagtctggtttatgcttccaccacctccagaaatgtctttaaagggtctgtttctacctactgtgatttcctcgcattatgagtttctcaaagggtgcctccagtgccaagtctttaggctttgttttttattttatgttgctcgcacccaggatgacatctctaccaccattgagcctgggctctagtctggtattttctgtgataccagttacagagctgctcttgttctcatcaggcctggaaattgatcatgacctattccaaattataattactaatcacctttccacctccctttatttactaaactatactaatctcttcttcttctatagtggtccctgtgaaaccactgaaattctcatcagatattactgatctctctggattactggattttgtccagtgtgaaatgtcttcattgtcctctgtatatcctcagtttcctttgacttaatgtaaacaaagactagatgctgtcatgctatgagtcctagctggatttgcagtatgtcttcatctaaagtttccagttgatatcatcgctagcctcacaagataagcctatagttggttacattttacttcctaaagggaattttaattccttgtcccttaaggatctcaacaatattaggcctgtattacctggaaaaagtaattttctgttgtttccccaaaactctgactaaactccgtttggttcacactcctaatgtcttctcttcatgatactattgtccctacagctttacatttcattagggtgtgctttccttccccacataacacattctttaagtctgacctcaaatcttcaacccctccctgacttttgtcatgacttctgtatctcccttccctcgacttcagtttcacctaggggtgataggataa

SEQ ID NO: 43301 - DNA, 1197 bp, Homo sapiens
aagcgattagagcagcagccagtctaccacacagacacctgctgttctggggcttcaggagtcccagaggaagctccctccttgcttggctctgtgtccttctgctcagctagcattttgtctttttttcttagacactaacatcatttgtcttggggtttgggatatgattttaagaggcacttctttctctcaaggtgcttatgttctccttggaggaggtaattcatggatgtaattatgggagatcatgggagtcgttctggtcaatgcctgggaaactctgaagtgatgatgaagcagaagtctgattttaaatgcatcctcagccgggcatagtggctcacaccagtaatcccaacactttggaaggctgaggcagaagcatcacttgagcccaggaatatgaggctgcagtgagctatgattgcaccactgcaccccagcctgggcaacagatcaagatcctgtctcgaatgaatgaatgaatgaatgaacaaacgaacaaacgaacaaatgaatgcaccatcaaagtattgtgattcagtcattcaaggaagggaaaggtggcatttgccagccctggaataattcgggttagtggcagaggcttgtaaaggcactcaggagaccagcattaggggcctgagtaagtctcctggagggctggtgagatttttgcttccttagaatttggacttcctgttaagagactgagggatgggaatgcagataaatacccagatggacccaggagcccccaatgctggactgagttttggttttgtcctacagagaacttcaagccttctaatttgaaaagtgtgtcatctgttgaaaagctgaaattaatagagactgacattgtgaaaaacaaatgcagtgggggtttgaggggattgagtcagtgacactcaagggtgtctagctgagatgctagacagaggactctcctagctaatgggattctaaaaagaatgaaatattctttctcaggaagatcacttagaatctcttaatggaaagactcaaatatatacgatctataggacagaagtgtgactgaaatggtttggttatttctaagtatgtttctggtcaagatcgtgtccctggcacatatgtatatatatgtgtgtgtgtgtgtgtgtgtgtgtgtgtgtgtatattttttttttttcctctcagacggagtct

SEQ ID NO: 43302 - DNA, 1034 bp, Homo sapiens
cagccacctgcttagcatttctttggagtgtgtccaaaggacccctcaaggtcatagatgcagcaggttcagaataattatttggagcccccccacctatgccttctcttgttcctattgattcattgttccatcgtccagcctgtagccctatcgagaaagatgggattctttctaaagttgtccattttctgacctcgcgattgttttgagtttgtacatgtcatattctagatggtttttatcctgtcccctatcccctccctgctgttgtaaaaatagcttattttttggcctctctactgttgtagagattttctttctatactgctactttcctccacaagcccaggcatattgcatttcccatgtcgagtatttctcctgaagtgttcatcatatcgtgcttcccccatgggaaaagcacttgcgtggctcccagagtggctactacgaaaatgaggttgcctgaagctgggatggggaagactgtgggtaaagcaggcttgagaaaaggccagaattaggtttcagatgtttaaaatttgggctgtgttggtatgcagtgagtggcagcatcaggaaggcaggtaggggtgtgtgtgtgtgtgtgtgtgtgtgtagtttgggagctgtgttagctgtgttagtatgcaatgagtggcagcatcaagaaggcaggtgtgtgtgtgtgtgtgtgtgttttgggacacgaatctggtgtgtgtgtgtgtgtggtttgggacaccactctagggggtgtgtgtgtgtagagtttgagacacaactctgttgtgtgtgtgtgtgtgtggattttgagatatatctctctgggtgtgtgtgtgtgtattttgacacacaaatctgctcggtgtgtgtgtgtgtgtgtgtgtgtgtgtgtgtgtagtttgggagacacatctcgtgtgtgtgtgtgtgtgtagtttgggagacacatctcatatgtgtgtgtgtgtgtgtgtgtgtagtttgggagatatatctctgtgtgtgtgtgtagtttgggagacaca

SEQ ID NO: 43303 - DNA, 1056 bp, Homo sapiens
tttcaaaaagcctcccttatgagcattgttatttgtccttctgtactctgcattcctggctcttaacattgaatcctgcatgtttagaagtggagtagaagctcaggcaatggatagaataaattttgggggttctcaattagggattggaataagaatccatgcctgccatatttgaggaacgtcagtgacaatttggaatgcagtgagcattgtgatataagaagttcttgaagggttttgcacagaggagtgacctgatattaatcatgatttaaaaggatggttctgtggcagtatgtgacaaatgggctataaggggacaaaaacaaataagtaagatagaaatgtattgccaaagtgcaggcaggagatggtgtgggcagggtggtgatggtggaagtgataaggggtggttgcattctggactgaatatggggtataatatagacaaagaagtcgaggataactaaggtttttgacctgaatgactggaaaggtgaaatttccattttctgaaatgggagactctatataataggaagaatggactttatataataggtaggtgttgagaaatcagaaattcagacttgggcatgtacagctaaatctttaaatggacctgccgagtaggtatttggggatagaaatctggagttcaggggagaggtcaggacaagagatataaattttatttaacaatttatagatggtatttaaagtcttgagactggatgaggacgtgtggagagtgagagtatacatagaagagaagaaatccaaggactgggccctgggtcctccagcatttggaagtttgtatgatgaagaggacctggcaaagaaggctgagatggagtggccagtggggtagacagaatgaaaagaaagaggtgtcctggaagccacgtgaggaaatatttcacagagagctaattttggtgctgctgattagatgagaactgaaacatgatcattagatttgacaacctggaagtcattggtgactttcacaagagctgtacacacacacacacacacacacacacacac

SEQ ID NO: 43304 - DNA, 1028 bp, Homo sapiens
gcatttagtgctataaattttcctcttaacactgccttagctgtgtcccagagattctggtacattgtatctttcttctcactagtttcaaagaacttcttgatttctgccttaattttattatttacccaaaagtcattcaggagtaggttattcaatttccatgtaactgtatggttttgagcaaatatcttagtctttatttctaatttgattgcactgtggtccaagagagtggttgttatgatttcagttcttttgcatttgctgaggagagttttgtgtccaattatgtggtcaattttagagtatgcaccatgtggtgatgagaagaatatatattctgttgcttttggatgcagaggtctgtagatgtccatcaggtccatttgatctattggtgagttcaggtcctgaatatctgttaattttctgcctcaatgctctgtctaatacagtcagtgggatgttgaagtctcccattattattgtgtgggagtataaatctctttgaaggtctctatggacttgctttatgaatctgggtgcttgtatattgggtgcatatatatttagcatagttaggtcttcttgttgaattgaaccctttaccattatgtaatccccttctttatcttttttgatccttgttagtttaaagtctgttttgtctgaaattgagattgcaacccctgatttttttctgttttccatttgcttggtagatttttctccatttcttaattttgagcctatgggtatcattgcatgtgagatgggtctcttgaagacagcataccaatagatcatgtttctttacccaacttgccactttgccttttaattggggaactgaggccatttacattcaaggctagtattcgttcctatccatattctgaattctgtttctgtcatttcagccatctcagccttgttcagaacccttgctggagaggtggtgtggtcatttggaggaaagaaggcactgtggttttttgagttgtcagagttcttgggttggttct

SEQ ID NO: 43305 - DNA, 1032 bp, Homo sapiens
agttttctcaccatcatagatacactgatttttacatgtagatacattaatatctacaaaagactttttttacaaaaagagggaggggaatccgaagtataaagtgatcggtacactatcttagcatttcagtgccattttgatgaaaggatcaaaggccctgtttatactgatataatcccattgcctctatcccctcactaaccacttttagcaacttgtcctaccaacacttcctgagactcttttcagccagatggcaagcacattcctagctgctctcagctagaaggatcacccatcagagacgttttcttcatgtttctgacactcccacctgttggagaagaaaaaaacacaggtcatccaagccaatgaacttagattctcatgtggaatgatttatgtattttaaacaaagccttcatcttatttagaaatcacttgcatgaggcactcttttgaaaatgttctcctcatctggaaaataatttggctgtataatcgtggtattcaggaagttagggcaggtgtttaggtggaagagcagaagggagtattccaatgaggctgaagagtgaggggaattgaccccctgggagaagggaaggcatgtcagggccctccttttaacaggaaaggattgaagaaggcagtgaccctgagagaagaggagaagccaggcctgggcgccaaacacttttgggcctgttgctttgaagggtagaaagagtggccataatatttctcctgacccagcagatttgaaaagattcctccagcagacagtggaaagccccttgcttcctcagccattcagtctgatttctgaaataactatgctatttcctggttgtggtgaagtggcagggcccgagggtttgatcagcttttcatgggctatggccattagtggggttggggtgcaggtgggagtttgttaacacaagagcttgttattctcggagcttcaggccctggtttggaaatgttaactggccaaccagccacgggagttggaattccctaact

SEQ ID NO: 43306 - DNA, 1046 bp, Homo sapiens
tgtaagtaacggggggcagtttgctctaataaaattttatttgtttcctgcaaatgggtagcacatctgatatatcaaaggatcctgaaagctagggtagtcattttgttctcacaactcagtgccctggttgctcactcgtcaccacccctctcctgacagaactactctgagatgggccgacatctttctagccacaccttcatgttaaaaatgcctcagccaactcacaccagctagagaacagttgatggcaattatgggaatattagcaacactaagttctctttacatagcattttttcctgacagaagccaagacagttgaaatctggcttggcattcaatccataattaccctcattgcacccttcccctaaataatttccaaagtgatatgaatgaggttggaactgtagctgagcttagtatttgctttttttcccataaatagtcggtgtcatagacatactattttatctcttcatgcgcatgtagtcaaattgttagactgatgcttaataattgttcggagaaaagaatgtgacttggcaaactggctgttgtttctgcctcacactacggggaaagggaataatgataccctgtgtgtgtttgtgaacattctgaggtgtactgttcccgtcatcttagctcccaaagaggggatatcttcaggctttatcatcttcatgtcttctgctgcagagaagcctccaaatccatgggttctaggtgttcattgtatggttcatgagtgttttaggtgaacaatatttaaaaatccatacttacaaaggaattcaagtagaagatatctgttttgtctataaaggaatctgccattatcatcttttaaatcacatgtttgaaaatataatttgtattcctgggtcctcttatttatcttttatctttgagatgcattcttactctgtcactcaggctggagtacagtggcacgatctcggctcactgcaacctccgcctcccgggttcaagcgaatctcctgcctcaacctcctgagtagctaggattacaggtg

SEQ ID NO: 43307 - DNA, 1048 bp, Homo sapiens
tgccttatctgtagcttttgaatgtttttatctcatttaccctctcaactgcccttacagagaggcataattgacctccatagtgctaaacacagggccttgcatgcaactcctaataataatagcattaagcattacagttttaaagaaagcttctcatatacattttctctcttatttatctcatgcttattttccagatctaatggcagaaattcagaaaggttaaataacttgctcagggttacaaaggcaggaagcttctgatccaggcatagcccaagtcttctagccccagattggataccctttctactccaccacattaccaggggttttaataattttttgttgactgaatgcatataattgtccccaaagtattcccctctgcaaaaaccttctatatctccctctaacatatacacatcagtatgtgtgtatctcttattggattatattccaatgtggctgcattgctcaggctttgcgataggaccacatctgtagacgggggttagaatagcctttaacgggacaaatatctggggaaaaagtcctcagaatgatctttaactgttaagatagaaccttcactttcttaagtaaagacttttaggcatgtaggtaagtttcagtgtcaggtaggtttaggtgtcagatggttgctaagctaatcttcccccgcattcccataggagaccaagagctggaaaagcaaactaaatcttgtaaatcggtctatttagttgtaactttcttctcttatgtttatttcttgtctgttattctggagtctttaggaaagttgtggttagagattctagcctgatcaccattgtgttgtggaaaactatggaaatagtcattgcatgtcccctgtacatgctaatgtttttactgggaagctgtgccctgcagacactagtgatggaggcagcaacttcagggatatatcatccaaggatataatctccccatgtggagattctcatttacactgccaaccttacagtgacagtgggttttctttaaaaaagcaaaaaca

SEQ ID NO: 43308 - DNA, 1044 bp, Homo sapiens
gcctgtcactgttgaaaggtttgcggtcataagaggaaagtagcagaagccctacagcaaataggcacagaaaattaacaggccccctgcagacatttccagtgaagaacatctcaactcactctgaattagggcctctctggcctgagttgagtgtaagaatcctctgagaagcaagttggatgtggagaatcctggcttctacctaaggattttgattctggaggcctggggtggggctcagagatctgacttttaatgggctcccagataattccttttctgggatccatagatcacaccttgagaaatactttctcagagcaccatcgtgaaatagctgatgttcatgatgatgactgatccatcaaaaaaggcaattttgctctattttagaagatagacatttaataagaggtatctgacttatatgaagatttcttatgtcttaactttttttttaatagaatatgctttacctacatggaaaagtcacttaaaccactggatttcccaggaactctactatattaaggcttaatgtgctttttagtacttacatgcatgtttacctaaggcttagagcctagaaatttgtatatcacagacactcaaaaattacttattttgtttatctagaatcagtactaacctttctaacgaaatctcttctcctgcttcagctaaagcccccttggtgttctctaggttgatacagaaaactgaaagagctagaatggagccccaggttagttaatatctattattgaatactcagcagcaaacaattctgacagttaatgtacccatgttaatcacaaggaatttgccaggagcactctgacactgtcctgtcctgatatgcatgttaaaattgcccacaggttcacaaaggaatcctcccctctgcattttcccccattcgtgcggtgtgtctattgcctatagctggttcttcctcttaggagtaatcagcctaagacagagcaggctcaccaccaggtcctacagatgcctccatcattttactctgcagtttgttac

SEQ ID NO: 43309 - DNA, 1046 bp, Homo sapiens
gagcccagtgtctatgtgtgtcccttactagctgagtggccttggacaagtctgatcatctgtgattcaggaggattagatgcactaattagtgtaagcacaggactgattctaaatattcgttgcatggttgtggaggtggtggaggtattagtagaaaataggggactaatattaaaaagtcattagaatcagagaacattgcagagttcaattttagaatacatttagcagaaaatacatgaattaagagagggtgactgaatgcaatatagttctgtggagtggaaaatatgaggtatatgtgttcagtgatggaccactgaatatatagatagtagtcattgttaattttaagagtctagattggagactagaaaggtcctctggttctagttagtgaaagtatttgtacaagaagtgactcttaagtattgcaacaatgttccaagagtatacatattgaaatccatctcttaccatcatcatgatcacactcactgccacatctctgttcccagaacagggcatagacatcagtttctgaaacctaatagtacctaggggaaaatccggtcttctctgtgatatttccagggtagagcattctaagccagaaaccaagaagctgatatttataaatagtgcccctctccttagtcataggaaccctgacaactatcaaggaagaaatcaatcagcaattgcaggttttgttgtgcacagtagcactatattggcagtggatttgggcctaacccagcacctaagcctgtgattgggggagattgtttttattgaaacagccccattaatcaagctcctttcatccaagagtagagcagagtagttaaaaacaggagctcagaagtcaaaagtaaacttgtgtttaccagttgttgactttgggtaaattacttcgtccttctaaactttgtttctcacttgcaaaatgggttgatatccccttcataatgtgtggcgatgacataatgatgttaagtgcttcacacatgtaaagtgcttggtaagtggtagaacataat

SEQ ID NO: 43310 - DNA, 1017 bp, Homo sapiens
ccaatgggcgtacagttccaagagtgtggagtgacccttctcagttgtgagattatgaacccaaagtttaatgtcccgaagttttgctgtagtgtagatggcaaggacagtctttctctgctgttctcagaagatccaatcttcaggttctagattatgaaggggttgattgtcttcagccagtgaaccgtaaaaagctttctttacctggtgaaaatacactgtagcataataatctactgttataacatcagcctttttgcatgggaaagcttttatacaaccagaaaacatgcactgaaaatcacaatggaatgaaagccctttataaaaatgtttaaatggtccctcaggtaaccaaatatacctgaagctttgactgttttcccaggaatatgggtttgacaaagcaaatgttggtcataaattattttagcaatttagaagtcacgacaccaatatatatttaatttgaatcattttatcttttccatgatgactcatggaatgcaaaacctttaataataaaagcttaaaggactctggaaggacaaggtggccatcctgattctccgtgagtccatgcttaatccatgcttaattaacattagacttatgtcctcttgaataccagttgtttctccaaattaggtgcatagcactgataactgatgggttatcataggtaatttgacttagaccatggagttcattcaaagtgtatatctaaacaatttcagtattggccgatttagcatacaaatctggcaaaatatttgcttggtattcaattaatttttgttctacttgacttagcagttttataaaccagtcagtcttttcattaaagtttcaggaattcttacccagtacaaatgataggattttaaagttattagaaacctgtattcaagagggcttgtcagggtcctttttatcctttcacgaacctcctaaaagacgccatattctaggattttgtgtgcttgtgaagttgtcagaaactgcatcagcatt

SEQ ID NO: 43311 - DNA, 1270 bp, Homo sapiens
cttatattactagcctctttttgttgcaggatctctccctctaaattacagcagttcattcagcaagtagggaaggtaattcttgttaatcctctattctgttggcgattcttccacgtacttagtagagttaaggcaaaaacttaccgaattggaagtatgtatcagaaggaattcttaattattcactttgaaataaaagaattttccttataggttccaagtagtagactgtactataatactgctcttctgaaataaattgaatatttttaccttgccaaaactatcattgaaggctggaattttaggtacagtatttttctgtgaatgattttatgttgttaaatattcttttaaaaattcatatctgtaattgttactgtagaaaaccaaatacaaagaattctaaaacctttgtaccgtctctgtgtatttgagattacttaaaatatctttttttctgttccaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatggtgctagtagtcaagagatcttgagaattttggctgctgagtcttggtgcagggtgcaggttttcttttcttttttcttttttttttttttgagatagtctctgtcacccaggctggagtgcagtggtacaaacatggatcactgcagcctctacctcc

SEQ ID NO: 43312 - DNA, 1049 bp, Homo sapiens
tgataagtgatggtttattatgctgtttaatattattagaaaagtggaagcaattggtctttactaataaaatttttagttttaaactgtcttgctcactgagaagcctgaaactattagaaaataaacacattacatgttactaatatttagtatacaagttgatactggcagcctctctcagtctacttggtatatataatattttcagggaatattaggatttgatcaatgcaaacctcaaagtacaaaatgcatttatatagtaatagttgatgcaaatcataattcaaataatattctctaatttaattttttatcaatttctcattagctatggctagattgtcattgtcttctaccccataatatggcataaagagagtttttaccaggaaaaaatgaatcagctttgtcagtttcttgttcatttgagtttgcacactttgtgcagccttcaattcatgttttctatatacttttcaagtcatatatttgtttgggaaaaattggcttgtgccactctagattatatactcctgccttctctttatcaatgtataggaaaactccaatacattaaactccagtatatgaaaaggttgagcatggctttgcattggttaatcttgacctgcctacagaatagtatatataccaaatgaactgagtgagatttccactatcaattgttgcactaaaaattaatactgcttaatgtagttcttattttctagataaaaatatatgagcaaaaattgatgtgcacatgaaacagctggaaaacattttgcagattctgatgcaacaggcctaggttaaaacttgagagcttgcattttacaagctaccagatgattctgagactgctggtcccttgaccatacttggagtaacaagttcttacaacacttcagaacttcttacaaacaccttaggaagcttgctttcagtttgaagacagctgtagacatggagtgtcatttaaaagttttctaaaagacaaaataaacatcaagtttattttaaggaccaaagaatgagatacc

SEQ ID NO: 43313 - DNA, 1023 bp, Homo sapiens
acccaagggaggcatgctaagatttaagtatgttaggtcaggctatatccaggaaggggaacacctgtgtccagctgctgagggggaaaagaagctcagcatgtttgggaaacagcaaaaagaccaccacagctggagaatattaagcaaaaaggagatgtagctgaagaatctggtgtcaaggtagagatccgaattgtgttacagatgtaagggagctattggagattgacacaatcttcatttagcttccacaatgatcactgtgcaatgtagatagaggagtgcagggaggtgtatacaatttctctcatgtacctcgtcagatatgctcagctgtccccgtctctgggatcattgaccactcattttgtcccggccatcatggcttccaaattaatgtgggtatagcccagcattgccttcctcttgcctgtgccttatgactgtcctaggactaccttgaagccactgaggagtgagacgtgtgggatcttactagtgtccctgtaagcataatctggagttgtaggagagttatgtgtccaagttgaatctttgatcattagaagggagccagtgaataaaagtttcttcctccctcatgacagactgtcaggagatggtggagttcttgtggtctcttaaaatgtcaccttagaagaataagcaatccattgttttgataccaagctagcacgttaacacaccctcttattagctcttccaccttctctgcctcacctaccttttcccttattcctgcatccttggcattgcacttctgatacaagagaagcacataagctttggtcctacctctgctttctggggaaagcagggtacgacaggtgtaagaagaaaagtagaaacaccagttaggaagttgaccaggcaagagatgatgatgaggctgggtgctgtggttcatgcctatctataatctcatcactttgggggccagggtgagaggattgcttgagaccaggagttcaagacaagcctgggaacatagtgagaccc

SEQ ID NO: 43314 - DNA, 1088 bp, Homo sapiens
tttgcttaattcaagtgccctcaggagggcaattagctcagctagttgagcacttgtgcctgaggacaggcacgctctcagcagtgtcattcaggctattgcataccctcctttatggatcccttgttctacaaaagaacttctgttcgtaaagagagtccagtctgagttctctaagggggtttctttgaggtactccttggccacataggtttgtgctactgtctgtttgcagtcatattcaagctccccagcttcctttgggaggaaggtggctgggtttagggatggacaggttcttaactggacttcagatccctctaatagcagagcttgatatttgaggaggcagttgtccatttgccagagactctccttaggagacagcagtcctgccacattacgtgggtataaatcgttatgttatttcccatggttaacttagtagcctttggtaccagcaagtctactgctgcaactgcccagaggtaggctggccatcctttagctaccaaaccaagctccttgtttaagtagcctatgtgctgctgggctgaacctcaggcccaggttagaactctcagggccatttccttcctttgtgatacataaagattaagtctctcctatgggaagactaaggacaggtgcctcaagcaaggcttctttgaattggtcaaaggcccttttagtctcttgttcccaaattagggagtgagtcttagctgcctgggtctccctaataggtgatataaggaatgagctacttctccatacccaggtatctataatctgcagaatcctgtaatgcccaagaatcccttcagttgcttgagggttttgaggagggtaaaggaggagatgggcttaattctttattcccctactgccctggtcccctctaacaagactagacctaggtacttcactgaagtctgagagagctgagccttaagattttgagaccttatatcctctgttagccagaaaattaagaaaagccttattatcctcctcagagatttcctcagctggggcacaaaggaaaatgtgatctacatattgtaaaactttaacctgagaataaa

SEQ ID NO: 43315 - DNA, 1029 bp, Homo sapiens
ttttctctttctggacctgcatggattgtctcttcttggcctctctgtaaatctttaattctctttgcccattgctgttctttattgattttcctcaggattcaatgtagccagcagatcaatgtgatgatctttctgttccaattactgccacccattgactagaagacatgacatttagttcaaaagtcttggctgagaaaaatctcacagaaattggtaccactggatgggcgtgaaccagtgaccatccctaggcaatcagcccagatcagggccagcagaatcatggcagatggaattggctgtttgctaagttatggtgaagctcattatattagttcattttcacactgctgataaagacgtacctaagactgggcaatttacaaaagaaagaggtttaatggactcacagttccacgtggctgaggaggtgtcacagtcatgaccaaaggtgtctcacatggcgggagacaagagaatgagacccaagtgaaaggggtttccccttataaaactaccagatctcttgagacgtattcactaccatgagaacagtatgggggaaatcatccccatgattcaattatctcccactggatccctcccataacacaagggagttatgggagctacaattcaagatgagatttggatagggacacagccaaaccatatcattcatgttctgagttgggaaggcaacagttctaaattcagaaagttctcagagcttggttgtcaaagattttcaatttttgctttatttattgaaggcaggtaaactaaaactactatggacaaatatttctgtcaaaagactgctaggtatgataacctcttcactcagcatccactttattttcataattattcaatagcacaccataaaaatcagaagtgctttcctgagtggaagtagatcaattatgtgattatcaattaaataaattaagtggggataattagaagaaagaaaaccaaaatgtattgagcgtgatgctagggattttaattaacaatctt

SEQ ID NO: 43316 - DNA, 1035 bp, Homo sapiens
gaataaatatcttcaaatattttacacagtttgactcttttcatcaacaataagatgcttcactatgttttatgttaccagaaattcagaaatataaatgcaaaataaatgttaacacttagtgtatacttaaattcttcagcttttgtgaaaataagagtattgtacaaatattcttcagcttttgtgaaaatagcattgtagatacaaatgaatactttttaaacttagtaattggaattaaaatactatgaaaatagatacatttttatatcagtttgacaactttgcttaatatacaattgtatgagaagaaaacaaattcagtttcttcccagtatattctcacaacacaacaatcaacacagaaggtttctgtgacatctggtcaccaagaagtttgtgggggagttctccccaataactaatcaattctgcagcaaacatcagctggatgtcctcttaattcaatgcagttctgacactatctacctgtagtagcatcagatgccacaggttgaggtcactgtcccccaattcctcagacttaccccttcagatgccaatcacatgcccgaggttgttttacctgtgcttctgactggccagctataaattagagttcccactatctcctcctctcaggcttgattaatttgctagaacggctcacagaacacagtgaaacacgtttactgctttattataaaggatgtaacaaaggacacaggtgaagagatgtgtagggcaaagcatgtgggaaggggtgcagaggttctatgccctctccaggaacctctgtgtattcagctatctgaaagctcatctgaacattgtccttgggcttttatggtgacttcattacgtaggcatgattgagtgaatcattatccattggtgattgacttaaccttcagcctctcgccttccctggaggttggaggggctgggctgaaatgcttaaagctatcttggtctttcctatgaccggcctcctatgacctggctatccaggagtccccagccattggtcaa

SEQ ID NO: 43317 - DNA, 1057 bp, Homo sapiens
ccgtagaacattacattgtctttagtaaatataccaaacacaaggtatctatagaccttcatgtccatattataaataattaaatcagagaaacaagaagataaaaaagccaggagagagagagagagaaagagaatcatttggaatgatgcactcaagaaaagagatggctaaagagatagaggaattaagagaggtcatcttaggattgttaacagtaagcaggctcagtaatacctacctactcgctcagatttcaggagcaccacgagcaacattgtatttttaattacagcctagacatattacattataccctctctcggactatttgacacaattctacttcaagttagctctgaaaagtgtattatgcaaatattactatagtttatggagagaacagaaagaggatgatgttattgatgttttccaaaatcatgttagtcaaagattttcttcagttacaggtatactttaaaatatattttcatgctttcaattctttcaacaaggcaagcattgctaaaataatataataatagcctaaatatatttctacattttagaagtttgcatgcatgttcttattctctgagaattaaaaatggcttttgtttgttgaagaaaaaattctggatttcattctggatacccctcatcttgtcctctttaagtacagtagcattaaatctttactttcatagggaaccagttggtgtctgagtgtatttctaaacagactatgctgctattcacaggcttaaagagaacaacccctcatgtattggcttgaggaatggatgttatgggctatatctaagctagaaatattctgtattcaccttagagagttggttaagagtttgaatgtttctgttattttttatgtgcatgggaaaagtatatatttctaaaaaaatagttcagtatgcctatatctgattaatataacttcatacctaaaaaatctgtatggaagaaaagaagatagaacattttttaacaacttttttccttttagattcttaggaggactttggaatcattaattgga

SEQ ID NO: 43318 - DNA, 1031 bp, Homo sapiens
gcgtgggcggtagagggactaggctagactttttggacgacttggggagcgtccctgtgcgttttaaggcagcaagcgatgtttgttcctcacccgcctcctctctgtccctctgctgtctttgaaaaggtcaatttccagcttgaaaactctacacttttcttttgcgcacatgcggttgttgcctcctcttactctacgacccttggttctgtttttggttgtttcctgctgttatcctgctctttgaggtcattgtaatttactgtaagaaactttcgccggatctgcaaggtatgctagccgcaagtggacctgaattctcagaacagagttgaattccatactgcacgaattccacctccaaccggaccctcagaaataattcattggtgaacattttatccctacaataaatcaccaagttaagttttgtatatccgtattatactgtattatggtttttgtatatatatgttagaatcagttttggcactgtaaaagagatctctgtggagcgaatactcccctcctacttctttaatccatgacaaagaacatttagtttaaaatacagtgaagttaaaccaaaactactttcattagccctttttgcttgttttttgtgttcatacagataggaatattaatgaaaggtgacttgttcttatattgcaagtttccttacgtttttcagaaaaagtctgatctgtgttcaaccatctgcagcttgaaaaaacattatgtacaacatttatagcagtccagggtatagttttgtcttatcattttttgatcttaactcattttactgatgtaagtttgctttgtataaggggaatacaaacactatcctatacaaaacttaaaaataaaatactaaaatcaaatttattattttctgcaatgatattttttctggtccttctttggtttgcttacagcgttactaaatctttatgaataactttaaaaaatacatgtaataacatatatctgttcattacagttagataaatatttccaggaaa

SEQ ID NO: 43319 - DNA, 1050 bp, Homo sapiens
aatgtccatttatacagagctgaagggtgtagtgttccatcagctgctgcttatgccagttgactggaagtaatgattaatgctcattggtcctgcttgcaagtaacctgacactatttatggccttgcagtgttcctaatgtatagtgaatgagaagacaacattctcaaatcagaaacataaacaggaactggtgggtctgaattccattcaaatatgtcatttcagccccacagtgtttgtctaacttggattttacaggcaggaaagggggaagggatggataatctgcttgtgagttgtactagcttggaaaaaggcaattagaagggggtggagtgtgcttttatagggtgggacttttagtttcttttttaataaaacaaccaggatatttaggcccagaactgcttatttcaagtgggtaaagtgaacatacaactgtttttataagtggaactgagatttgaaattaaatgagacagtttaaagatacatgtttggatctctcttctctctctctctctctctctgtgtgtgtgtctttgtgtgtttttgtctgtttcatgaatatgaacaaaagaagggaacatataacattttttaaagtgtttacataactaagtatctgtttttaggtttcgaatatagttttagaatttttacacttaaatgatttctatacttaaatgagttaactaataggtttgaggaaaagagacattttatttcataaaacattttcaactaggatatgaacaacttgaaaaaattttcaaggaatttttatcagattaaatagatggttattgttcttattttgtgtgtgtgtgtgtgtgtgtgtgtgtgtgtgtgtgtatggtttctatttagttgtttctaacaatctggaaaattttacaggagagtaattcaaagataaatatgaaaagtatcaaaaaaaaaaaaccaaaagaacaacaagcatgtgttattgtgattcatttaactattctctttaaaagtatttttcaactctctgttctggtaatttttttttttagtatgtg

SEQ ID NO: 43320 - DNA, 1030 bp, Homo sapiens
taccacataaaaataaattaaaaataatattattaaaaatgatatcaagcatttaatttcagccctccaccatgaccaaatttacatttcctgactttttatacaaatgttgctattgtgacctcttacagtatctaatataaaatgagttctgtcgaaaggcatttaaaataatcatttcagagggaaagcagagaaaaaaaatcaaaggttagtatactaaattttgtggctatataatatgtttaacacagtagaattaaagtggctgaaataaaacacaaatatccaaaatagtgaatgttgaatgaagttgtaaagttgcattatatgttaaaaaacagtgaacaatttgtacagagaagttataagcgttcttgattcttttcttttggcttttttcgctttgaattctgtacttttaagtacaagcaaaaaacatttagtccgtatataagggaggcaacagagtatagtgtaattacaattggctaagagttgaggctcctttattgaactccaagagtttgaattctggcttcattgcttattaacggtgtgacttttggcaaataatgtaaactcttcatgtcagttttcttatctgtaagatgaaaataatattattataatacctcacccagaaagttgttataaccactaaataaacataaattctaaaaaatgtacttaggttatagagaacacttaaaaatcattagcagctattgtagtgtacagcatggtaattatagttaagaacactggattatttacttgaaatttgataagagggtaacatttagtgtccctatcatgtacatacacatacatacacacagtggtaactatgtctggtgatgaatgtgttaattaatttgattgtggtcatcatttcactatgtgtatgcatatcaaatcatctccttgtatgccttgagtatacacaatttttatttgtcaattttacctcggtgaagctgggggggaaagaaaataagattctcaagttcattaatagttaaggaag

SEQ ID NO: 43321 - DNA, 1027 bp, Homo sapiens
ttaaagccttacaatttcatgcttaagctgcctacattcttgtccaagagcattctcctatgaatacttaatatgttgtaaaacgataaaacaggacaatcacttcaccagtttgagaaatattccattttggtattcacctttctggcacacagttttagattatgattagcaatgtttaattgtgagcctttattagacagaatgtaaaggtaaacaaatgtatagctggagctttttctgtttttatttcttcaagtggaacaattttttgacttcatcatttcttgttcttaatttccatttattagtgtagtacatgtactttttaaacttcccctgtcatattttcttcccttttaattatatcttaccttttataggttaaggaagatgtaagctgggtattggaagatataagctaggtattggagtggaaataatatgtaatttccatgatattttttatttatgtaagacaggtgtgatgtttcaattctgccagctaaggagaatgaagttcttgtttcttacagttggatttcagtttcctaaaaatcttacattcataaactttcctaacaaaatttcccatagagtttgacattgactacaattccttaagagtgtagggttgtgattttgagaagccccttcagggaccattggtttttcaggtacactcagccaaatctaattgtaattgcttgagtagttatcatcacctcatttgttgagagactttactttcattaatgcttgtgtaaataaagccatatagtatacatttctttttcttttagcatgtgtatttgttaacgtaaccgtcagtctggctaacattgaacaagacaatttatttgtacagccattgagtttcccttttttagaattctagatagataccctaatatttctggttgaatggagttggaattcttgttttggccataaatgtattgttaccatgagaatatcaatgtccattctctcttcaatggtatgttaatggtgtgtgtgtgtgtgt

SEQ ID NO: 43322 - DNA, 1034 bp, Homo sapiens
gaggtcccctactattatagtattgcaatctctctcttcattcagatttgtacataattgctgtatgtatttaggtgctccaaggttgaatgcctatatatgaattttatgtggtcttgctattttaacctctttattaatatagaatgaccttctttgtctctttgtgggccttgactttatctattttataggtatagctaccctgctacccctcttttcttttgttttttattcatgtggaatgtcttttttccatcctttcattttcggtctgtgttcttaacagtaaagtgaatctcatttaggcagcatatggttggatcctgtttagtttttactccaaccacttttgccttttagttggagaactttctgtatttatattcaagctaattattatcagatagggatttgccactgccagtttgtaactttgttttctgattgttttgtaggttccttctttccttttttttttttttgctcttttcctttgtggttttatgaagttttttgtggtggtatgctttgatactttctttttatattttgtacagctataatataggtttggctttgtagttataaggcttacataaaatatttttatactaggcctactttaaggtgacaacttgcctttaattacatacaaaaaatctgtgcgttcactctccctttctcttattttgatgtcaaaatttacacttaagaataatttgtatctcttaacaacttactgcagctacagttgtgtttaatagttttgtcttttaactcttttaaaagggattaatttggtttatacattacccttacaatattagagaattctaagtgcaactacgtactatctacaccattgagatttttaatttcatggtttttgttattaattcatagcctttttccaacttaaacttcctttagcaatttctgtgaagcaggcctattagcaacaaactctctgagcttttatttttgtgggaaaatttttaattatctttcagttcagaaggacaactttgcca

SEQ ID NO: 43323 - DNA, 1035 bp, Homo sapiens
tgttttcattcttagatttatttatatatttgtagctagtcagggtaatgagagcctcctttgttttcacagtccttgagactatgctgtgttgtaagatgttatactgcccccagtagatgagactgactagtcattttttcaacaaataatgtactgagcacccactaagagttaggtgtaaggcaatggacaaaacagacattgtctctatatggagcctacattctagaagaggaaataaaatgaaatgttgtattatcttgaaaaatggtaaaaatttcttattgcttcatttttagaataagatggtagtatagaaaaaagtaatgtaatgtctttgtatattcggatctttttgtctcttgtatgagagatcgtgtagaagtattgtaaagattgcaagagctaaaatataaaaaatgcttaagacatagtgcttaatttatattggctattattatgtgatacttgtattattttgccactttttcttcctgactcatgtagatgattacttctagaatagactatctctaaaacgccatatacaagctccacctggtacccaggcgaccatcattgcattgcccagattacagcagccacctcctacctggtctctctgcatcctttctctctttgctgaatcctttctcctccctgcagccagagtaaaatttatgctcttgtgattcctattgctgctataaaaattaccacaaactgaatggcttaaaaccacattctcttacaattttggaggtcagaagtctcaatttagtttcactgagctgtgtcaaggtgttggcaaaactgcattccttctggaagatttgggggagtatccatttcctcgcctttctctaaattctagaggctggccatgcatggggttcacttctataattccagcactttgggaggttgaggtgggtggatcacctgaggtcaggagttagagaccagcctggccagtatggcgaaacctcatctctactaaaaatacaaaaattagctatgtgtggtggcagg

SEQ ID NO: 43324 - DNA, 1044 bp, Homo sapiens
ccaacacgcccagttaatttttgtacttttttttgtttgttttgagacagagtctcactctgttgtccagactggagtgcggtggtgcaatctcggctcactgcaagctctgcctccccagttcacgccagctaattttttgcatttttagtagagacggggtttcatcatgtgagccaggatggtctcaatctcctgacgtcgtgatccacccacttcggcctcccaaagtgctgggattacaggcataagccactgcgcccggccattttcgtgtttttagtagagatggggtttcaccatattggccaggctagtctcacactcctgaccttaggtgatccacctgcctcggcttcccaaaacactgggattacaggcgtgagccactgtgcccggcctatcttgtggatttttatcttcctgacactccattatttttttcctagcccaaacatataccctataccacacacaccctataccatgctggctctaggatgactttgagtaaattcaatgttgagggttaactggttaggaattcagcaagcgaatttagactgaatttgttaatcatgacaagcctccctccgaaaaaaataaaatcattcatccaagtacttcatctatacacacactgatgaacatttatctttaggtagtaaaggagccctcccagccctcgctctcccactgacatgctttttacctgagttcccggattttagtgattttttataatgtttgtgttaccatcaattctccttttcttcaccccactctgtcacatgctgtggaggactctggcaagagggcacggcccctgtctttgcataccatggagggttgtggaaaagcagaagaaattgtcagccagtaaactgagttatttccctgctctgcattagctgcaaaaaagaacatacatttgggggaaaaaaggcaggcaggttttattcctggccaggaatggaaaaggagagagctcttgctctaaagacaccttcctcccaagctgtgggaagctggggaactttaagg

SEQ ID NO: 43325 - DNA, 1119 bp, Homo sapiens
atttatccttaagagaatagtcaggctttctgactgccatgccttctcttgttttcttgaccaaacttttttattctatgtgctaaggacagaaagtaacaaatgttcattactaacacactattgagggagaataagattgtcagtagaatgggcactcccagttgttaagcatcattcatgcaccaaacactgctctaaatgttacagacaactttattcttcaccaatgtaggatagcctttattacctgcatattatagacaagggaaacaacttcatgcaggcaattacctctccaaggacatcaaataaattcacagaaaagctgtattcaaatacaggctttgtcaaatcccaagcaacaatcttgatttagagatggctttggagccagcggcctgagttcaaatgctggttctgctgtttcactagccaggaaacttgcagcaagctaccaaacctctctcttctcagttttctcatttgtaaaataacgttagcgatgacagtagagatactaatatacctcatgtagttgataggaagattaaataatacatgtaaagcattgagaagagtgtctgacacatggtaggaacaaaataacttcttctttttttaatcagacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatgatcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatcccctta

SEQ ID NO: 43326 - DNA, 1069 bp, Homo sapiens
tgtgtgtgtgtgtgtgtacacatgtatttccctaaagtgattggctggtcaaaactgtacagtaccacataccccatccccaaggccccatatttacccatttagcaactttataagatgaaatccttatacttcatttatttctccacattctctgtttttgccttgtcaggccacaggtctttcctttctgccttctctgatacttcctcaaaacctgtgccaatcatacctgtagctgtggactttgctgagagagtctagtatttttagcacaagctgtaatgagagtgtcattgacagggtgttgcttctctttcagtaatccataccaccagctgtgtgatttgcctgtcatctatcttcacccactcatatgaactcactctcttactgtcctctctctcctcccctttgtctccatttttgcatttttgtctttagatctctgttctcatttagattttggttataggaccttttcaaatgggttacgtaggttgtatattctttgacacccatcatgacaaaactattaatacctttctttctgaaatgtgagtcatattttgcctagctttctgactcatatcagagttcttttctctccgacatatagaagttattctacagttttctaagttctggttttgcaaatgagaattcaacttactttccattgtaaactttacatttctcattctggaagagcatttgattttcagtttatccttgaaagtaaaaaatttgaaaaggatacgtcttgttgtatgtgtgtgttcctattaatcacactcagtgagccctgtaagtctagaggactcaaatctagtgattgtaatatgggagcaaaatgatgtactggcttctccacctgcagcatttattttctatattagtagtattattttatttatgtatattcagaatttataaatttaaaactagtaaaatatttaagaatttcaattacaaacatttaaacctaaatgattaagtatttacaaagataaactttaaacatattattcaaatatgttattagcagattaattaaaataaaatatca

SEQ ID NO: 43327 - DNA, 1032 bp, Homo sapiens
atctatgttcatcagggccaatggagtatgattttcttttctcataatgtttttatctggctttggtatgaggataatgttggccttgaaaaatgaatttggaaatgttctcttcaattttttggaagagtttgagaagaattgacattaattctttaaatgtttggtaaaattcaccagtagagccatctggtcctgagcttgtcttgtcttttctgggagatttttgattattgtttctacttctttactcattattgttctgtacagattttctatttcttcttgattaagtcctggtaggttgcatgtgtttaagaatttattcatttcttctaggttatctaatttgttggcatataactgtttattgtattctcttatgattctttgtgttgctgtgctatcagttgtaatgttttctctttcatttataattttatctatttgattcttcctttttcatagttagtctaattaaagctttgtaaatttcatttatctttttaaaaacccaggtcttggttttgttgatattttctattgcctttctcatctctattttacttacttatgctatggtcttcattatttccttccttctgctaactttgggttaagtttgtccttctttttctagttccttaaagtttaaagttaggttgtttatttgtgattattcttttttcttaatataagcatttatattatatgcttacatatagtatttaaatagcagctccctcttagaactgccttcattgcctctcataagttttgatatgttacgtttctccatttttggttgtatcagagtttttaaaatttaccttttgatttctttgaccaattgattgtttaggagtgtttaatttccacgtatttgtgaaatttccaattttcctcctattattgatttctagtttcatgtcaaacaatgctactctttttattatctttttaagaagatttaaaaaatgaaatatattatgactaatatcaataagatggtggaatagaattttccaacgc

SEQ ID NO: 43328 - DNA, 1026 bp, Homo sapiens
tttataatgtttaggactcatggtaagagaggcagaacttaaagggcagatgctgtctcttaatggcaaaaagggaagtccaatggtgaggcaataactgtttcttgctgtttaatgaacagctgcttaaaaatgcagcatgtcagtcaccagcgtagacatcagtaaatgaaaggagtggctttgaaacgtgaattttattaagtatagcaggagattctgctgcagatagacccagaagacattttgagaaaataatactatcccctgggtgaacgatactcaaactgtaactatagtgccttagagaaattgatcaggttcaagcttcatggacgttaagccatagtttagatatttaaaaacatcatagaccagcccagggaagaaaatttcaatgaagtatcagaatgtatgatgttaactttatcaagtcattattacttcataactaccttctgggtatgttgcttgttagtgttttgcattctaatttatactgtaggtcctgaggtctggaagcttgatttctagtttgtcccctaagtccaggacatattctcttaacacattttgttaaacacattttaatgctctctaaacacatttttacgtcatttagagctactaaagatagagggaagttctaatgcttgcttcaagattttttgtagccctgtgagatcgagattggtggtataaaagaaatagtacaagctttatagtcagtcaaatcccagcccatcaattactaaactgggaaatgttgggaaagttattaaacttagaaaatcagtttcctcttttatatcatggtggtaatactgtactctattcccacagttattctagagaatagagataatgcccataaagaggaagccacgcagcaggttttcaatgaatggcagtattatttgattaaagctgtcttttctagggacttctcttcttgttgtctgatgccccctcctggacagtccagaacctgagctgagcaactgtcaacatcacttgcttgaaact

SEQ ID NO: 43329 - DNA, 1027 bp, Homo sapiens
tgtatactcccataatactgacttttatttgctaaaagctaaaagaaaattctagtaatttagtaaactatgccttttgtaatgtgaatttagttgtgtgatggattgaacttcagcatctttttcctgaaagtacataaatacatacaatttactaactaagcaaaatacattattctgtatcattcatgttttgttctattaaatatatggagatgttgagaatatcttattcttgtgaaaaagatgcatcagaaaatagacaaagggtctagcatttgccttatcaaactcatacagtctcttccaatagtaagaaccaaatcatcttttcctaggaccatcatgaatctactttgccttgaaaatgttaaactatagccttaaaatttattcattattgtggggctatgaagttctgtattctgtcagaatgactactagaaatattttttctacattagaatttaatgtcaagttacaaaggctaaaatgtaacttgttctctgacttgtgaaatatcaatcatttcgtaaaagcaacaaaagtaacaattcatagtagatagctaactcaaacttattcttatttcttatattttgtcaggtggatgacaatattccacttagggtaatgctgcttctcatggatgaagtattcgacttaaaagaaagaaatcagtggttgcgaaggaatatcaaaaacctacttcaacagcttattagagctacatatggcgatactattaataggtagcactctttcctcctcgcttttaatctgatcttacttagctattaaactcttacttctggaagtagattgctcaacctttgtaggagaatttttttctctgggccttttaaggacatcattaaagcagtctgttgctctcagggataatttacatccagattaagttgcttgctctatgaaagtcacgtttatttttttcaccttctaaaattttaaccttcctcatttacattaatttactttcagaaaaatagttgaccatgttgactgg

SEQ ID NO: 43330 - DNA, 1033 bp, Homo sapiens
attggtctatatatctgttttggtaccagtaccatgctgttttgactactgtagctttgtagtatagtttgaagtcaggtagcatgatgcctccagctttgatctttttgcttaggattctcttgtctatatgggctctttttacttccatatgaaatttaaagtagttttttctaattctgtgaagaaagtcaatggtagcttgatggggatatcgttgaatctgtaaattactttgggcagtatggccattttcacgacattgattcttcctatccatgagcatggaatgtttttccatttatttgtgtcctctcttacttccttgagcagtagtttgtagttctccttaaagatgtccttcgcatcccttgtaagttgtattcctaggtattttattctctttgtagcaattgtgaatgggagttcactcatgatttggctgtttgtctattattggtgtataggaatgcttgtgatttttgcacattgattttgtatcctgggactttgctgaagttgcttatctgcttaaggagattttgggctgagattatgggttttctaaatatacaatcatgtcatctgcaaacagagataatttgactttctctcttcctatttgaatatcttttctttctttctcttgcccgattgtccaggccagacatccttccaatactgtgttgaacaggagtggtgagagagggtatccttgtgccggtttttaaagggaatgcttccagcttttgcccattcagtatgatattggctgtgtttttgtcataaatagctcttattattttgagatacgttccattgatacctagtttattgagagtttttagcatgaaggggtgttgaattttgttgaaggccttttctgcatctattgagataatcatgtggtttttgtcattggttctgtttatgtgatggatgacatttattgatttgtgtatgttgaaccagccttgcatcccagggatgaagccaacttgattgtggtggataggctttttgatgtgctgct

SEQ ID NO: 43331 - DNA, 1077 bp, Homo sapiens
tttttattggaggcagattatatagcacataccaaaattctggactcctagaaggaaagtaggtgttcagcataaacatttcttatacagatagtttaggtatggtaaaccactcttattgattagagaatgctgagaatcttccctaaatttaagttcccatattccatccgagggacaaacttggaagcagtcttttctagacagagcagtttcaggctgccatgttaactctgcagcctgctttaattacatggttatgttcctttttatatatgtgtggatatatgtgtatgtggcaaaaacatttttaaagtttagacccaaaggccgtagttataaaagattcattttgagtcagtcaataggaatttatgtttgtggaattgtttttgaaaactaatcatttaaaatctatcatagtctatggattcacctcatttaataaataatcagaataatagctaacagttgttatattaggcagttttctaaatgtcttacatgtcttatttaatctccacataattctctgacttaggtagtattctcattttatagataaggaatctgaattaaatttaaaaattatttctatattaacaaaagtattaagctaaaaactacagagctggttctagtatatttcaatgtaaatgttaacataatatgtctacttatttttatctagattttcttgccatataaggatcataattgaaaagtagcaagttacagtagatggacaagcaattaagggagaaataatctaatatattaagtttattactaaattttttgttattgtttcttaatctttgctttttttctgttagcctaaatggaaaatattattgtgtatggaggggatggagggtatacaaataatatatagtttacatgcagggaaatgagtaattgtaatgcatatatgatgtagaattctttactcttttttttccctataaaattttaaaaatttgtttcctgatttttttttctcagtctttagatgacctttcaaatgtttcttctgatgactcagtacaacttcatgcctacatttcagacacaggt

SEQ ID NO: 43332 - DNA, 1050 bp, Homo sapiens
aagaatatttgtagctttaaaaatgtctaggataaaagatctacaatcaacaatctttttttacttaaaaatctagaaatgaaaaataaatccaaggcaaacagaagaaaggaaacaaagattattgtgagaatcagtgaatagaaaacagaaaaaccatagtgaaaatctaaaaccaaaagttggttctctgaaaatatcaacaatattgtcaaacctttagctagactggccatgaaaaaatggaagaagacacagataaccaaattcataaatgaaagaggagacatgaaccctgaccctacagaaattaaaaggagtaagcaaatattatgatcaactttatgacaacaaattaaacaacttaaagtggacaaatttttagacacagattgccacactaactcaagaagaaatagaaaataaaataatttgcttaataaggtctgattcttgctagctatagaaaaaatgctaaaatcttggtctgtggtaaaatcatatttttttaagtataggacaagaaaaatgtttttctctaatttgaaatactttttgaatgaaaatggagaaaaggattacagtaaacagaaatttatatactgtttcgctaaaattggtaggtgatctttgacgaggccaaaagcagcctagaaaagagttgacacactgacctgagttgtttgatgatacatgtaggttgtgataaaaactcatatagtgagcaaaatgactcctatttttaaaataagactacttgaatattaaaaaaaaaaaatgtgtcaccagaaaaggacagccaactttaacaggattttctaaatttctttactaaaagtaatttatttggaattgaacttcagtttgacaagtttatctgtctatttaaaaaccatttttcctcaaaaagggatttaacttatgatgacatcattatgcttcaaagtatttaaaaatgagcattgtaggcctggatagcctatatgatgaatttatagatgaaaaagacctgattgacaaacagttgatctacctaccaaacaagccata

SEQ ID NO: 43333 - DNA, 1050 bp, Homo sapiens
tttgtaactcttaaaagtagtttccagattctgttttcttctttaaaggtcatctttaataattaactggtcctggctgggtgcagtggctcatgcctgtaatcccatcattttgggaggccgaagggcctggattgcttgagtccaggagttcaagaccagcctaggcaacatggcgaaaccctgtctctactaaaagtacgaaacatcagctggctgaggtgggagaatcaccggagcctgggaagtcaaggctgcagtgacctgtgatcatgctattgcactccagcctgagtgacgagagtgagaccctgtctaaaaaaaagaaaagaaattatcaatctacttttaaaatatagcaaacgcaaacattttatgactgaatttttttatctgtagtaatttctcttcctcttgaatttattatttttgcttcagaagtatacctgttaccataaaatatttcctaagggaatgatacagtgatttcaaataaaatttatagatttcaacgggcttgtcttttattggtaggagtttacactagacaagttttagctgaggacgttatcttcccagttttgcaagtattaagtctttgttaattggcacagttttaaattaagaggatcacttatgcaattatattcccagaaagtgtcagcataggaacaactatagaaaagcccttctagttgttgaaattgttttcttagattttgaaaatgttttaaatatttttatttatttctttgttcttcctttcttcttttgccttttctttttatgtttattgtataattcaggttttaatggccagtttattagcactgttaagaagtatagttgacacttgaacagtgagagggtttcgggtactgactccctgtgcagacagaattctgtgcataacttttgacccccaaaaacttaaatactaacagcccactgttaaccataacccttatcaataatgtaaacaattgattaacacatagactagtatctgcatatattttatgcattcatggcatacctttttgtgaattt

SEQ ID NO: 43334 - DNA, 1025 bp, Homo sapiens
aattcttgtagcaaacttagagttgtaaggggaaaatgagatgatgtgggtgaaacatttagtaaagtatttgccaaccagtaaatgacatttttagcaaatcacttgactctgtgcctctataagctggcacatagtaagtgttcagtaaagttaacttctctgttattattgttgctattatgttcctaggttgtgtacacagattctttgaccctgtcttagctcttttttttttttttttgtagagcaagggaggtggagagggcaaaattaaggcacatgaaacatagagaaataaaacaatcatttctgtggtattgagagcggtttgtcatgtagcgatagagtgaaccacagtagctgatgaagacctgaacggagttgagaccaaaactggttttcaagaatgggttatttggatagatagagaggaaggacatgttaggaaataagaatagtatgagcaaatttctaaaaaagaagataaggatagtgtagtagaaactataacaagcaaccttgttgttgatcttgaaagtgaagtgtgggtggtaaatccctccatcattgttccccttaacccaagattagcagaaagtacataatatattctttttttttttgagacggagtctcactctgtcacccaggctggagtgcagtggcatgatcggtggagagcagtggcacgatctcggctcactgcaacctctgcatcccaggttcaagcaattcttctgccccagcctccttagtagctgatattataagcgcacgccactacacccgactaatttttgtatttttagtagagacggggtttcaccatgttggtcaggctggcctcgaactcctgaccttgtgatccgcccccctcagcctcccaaagtgctgggattacaggcgtgagtcactgtgccccccagcgaaagtaggtatatgctaatgccactgtgttcctaactgaaggatcttcctgtagagggaggagggatagatacataggtttcaggattcgctgg

SEQ ID NO: 43335 - DNA, 1053 bp, Homo sapiens
cgtgatctcagttcactgcaatctctgcctcccaggttccagcgattctcctgcctcagcctcccaagtagctgggactacaggtgcaagccaccaccctggctaatttttgtatttttagtagagacggggtttcaccatgttggtcaagctggtctcgaactcctgaccttgtgatcctcctgtcttggcctcccaaagtgctgggattacaggcatgagccaccacacctggccttgtcacaagattctttaggaaatatattggattaaaactttaaaaagtattattgtataattcacaaaatgttcatagttgttttaaacttcagaacctaatacaatctgtcaatttcttgctttgccaaagtcacaaattgactttttagtaaatgataagccatctgtgaactctggaaaatatacttggtagtagattcattaaattataaggaaattttgtttttatatttgtgattaaatttttctttctaggggtttagtggttactctcctgtttggaaaaacaaactcagagaagtacctagaacagtgtgaacactcatttcttcctccaacatcacctggggttcctaaggtaaatcgtttgagggaatataaaacctcaaagtccagttctttgcaatgataatagagtaatcatctgtatatatagcgtgacaaattttcgtatagtttactaatgctcactgggaatttatgtgagattgtctaattatacttagaaaatatattttaaaaggccatcttaaaaactttcttagtgttagatttaaaaagtgggaatacaaacttgagaaaacgatagaaattggttagtttattttgggtatttttcctgctgtcttatcatagtatttcaaagcatcatgcatatgatttttaacaatgtcaatgagtattctggtttgaatgaaataaattgcagaggaatcagaggaaaaaatggatacttttcattactttgaaaaatacagcttgtaattagattatgcagtatctataattttaataattcaggcctaattttta

SEQ ID NO: 43336 - DNA, 1032 bp, Homo sapiens
tttgtacatactttgttgtatttctcatgctaggatttcatttaacagtttgtataactatttctgtcctgtacctttgcattgccactaggattttttaaaaaagtaattgcagatgctctgtaaatctctctatacatataaattttgtatattgttttgtggagataaattttcaagtatacacttcacattttcaaaagttactgaaataataccatgaatgtttacaagaagaaatttaaaactatgtaaaagttttgttggttcttttctaattcatgtggagaattatttactaatttacttatattttttctgtatttcaggccagtctatccatatggggatggggaagccttggcattgtcctttttctgataacctttggaccctttgtaatattttatttgacattttatatcctctgctttgtgggtgggtaagtatactcaattataattttataattcatgtgtcatatcttgttaaaatggaaacaaatgactgagaaacgggagtatgatttatttgtgaatgccatttttaataaattgcttttactaaagttaaaaaaataaggatacccataaaaataaaaacagtgattgtcattatttgtatcagaaatatgggtagtccttcaataataagatgtccatttccaaaggtatgaactttttttggtgataatgtgtaaagtttaaaaaatttttcaaattccttttggtggtgtttctcctttaaagttgaaattttcttttgcattatgttaataagtaagttaaattgagactgcacatgaagttttacattatagaaattgtgattagacttcaaacaaatgttaattttttcctttaatgaatgttgtcatttcggtctagaaaattcaaatacctgattttgcagttttctcttcatagttatttggtgtacgtttatgttttcccttaagttgataaacctttacaagagaggtttcagtcataatttattgtagctttgtatgcagagcatttggtatcagac

SEQ ID NO: 43337 - DNA, 1050 bp, Homo sapiens
gtcctccatcatgctgagatcatgctgacttgaaaaagaaagccaaaaattagtcgttttgtttgaggtacgaactctcggtacatcttttgcaacagatttttcaaccagttttatctgttatttttccagtggtttattgaattgtattttgttttattcctttcattcaaactgaggtgaatttcttttcccttattatatttatgttcctaaaacctatgggaatgattttggaggtctaattaaatatcagtctatttattgcacaaaataaaaggaaaataatcaaaaagaaatagcaacactgaaatagtcttgggtactttgaaggagttatgttaggttttaattgacttaagtacaggtcagatctctttgtcttctacctttgctctaggagtcagtttgtagggctcggttttgagtgtccttaaatttgaggccatcgtattgctgtgacatatttactaaaacaatttcttgtattatatttgatcaatggatttgtagaaaacgtaaatggcttaagataggttaaatactattcaaatatgtctttttcaacttttaagttcaggggtacatgtgcaggatgtgcagatttgttacataggtaagtgtgtgccatggtggtttgctgcacagatcatcccatcacctgggtattaagcccagcaaccattagctgttcttcctgatgctctcgctcctcccatccacacctgccagacaggtgccagtgtgtatttttcccatctgtgtgtccatatgttctcatcattcagcttctacttgcaaatgagaacatgcagtgttcggtttttttgttcctgcattagtttgctgagaataatggcttctagctcgacccatgtccctacaaaggatgtgatcttgttagtctcttgttcctttttatggctgcatagtattccatggtgtatatgtaccacattttctttatccagtctatcgttgatgggcttttgggttgaatccatatttttgctactgtgaatagtgctgtagtgaacatacatgtgcatg

SEQ ID NO: 43338 - DNA, 1080 bp, Homo sapiens
ttactatttctttacttttatacttcatacttttcaggaacactttaaattgtccagttctagatttgtgagcaactatttataggtttcactttttcaacatacaagaaatgatatagacttagagtgaaaaagggccttatatattatctaggcaaactcttcttatttatgcattagaatttttatgcatagagaatcaaagtgaaattcacaaagaaccctcttacttagattaaagtataaacggtatatggggctggaaatttataattgctgcactgattcaaagtttttgtaagaataaatgggttaactgcaactcattttattaatttgacacgtaacttgatttctgtattttttcactgttaaactttgaaatataagagcatcagacatcaccgcccacagagtgcttcaaatttatttttcttttacaattaaagaaagcttttaaaagtacagtgtatgtgtaggctttaagagctactctagttatgcaagagaactatgaaattgcttttgaatgaagagttcattcaaaccttctcaaaaatattcaaatatatttttggtcagaataaggtaagtagtaaaatggtaaatttggtaacagtttgttttagaaataagaaaattgctaagtgaaaacaagactttcacataattatagtatatcatgttaactagtaattaaaacccatgtgcttttactaagcgaaatagatatcatgattaaagcttttatacttttaaacattagtctattttgcgtatagcgatcttatttcacctgtgtttgaattgtgaaacgcaaggtaactttttgaggctatgacaccagatagatgaagcctgttttaagtcatggggatttaggccacatcaaaaggatacttttttttctttttaaaattttattctttactcattcattaatttaattaatttatttagagatgggggtcttacactgttgcctaggctggttttgaactcctggcctcaaatgatcctactgccttggcctcccaaagtcctgggattacaggtgtgagctaccctgtccagcccaaa

SEQ ID NO: 43339 - DNA, 1090 bp, Homo sapiens
cctatggtttgccctaggtctcctttctctggtccctgggctccagggccctccgcctccgagctcggtcagcaccctggggttgttgctcggcccgaccggtttgtttcccaccctctactttgactgcttcatgaagtggacttttttatctcaagctgcacatgtatggctcagttgggtcatccccctcccccacatccatcaccttttcggttaaatcgtggtcatcacaaagttcagtttagcatctgccaccttgatttgcgtgtggcccccttgttactccctatggaatagtttttttctttggacctgaaatggaagtagggcaactatgacgaaccaatcaatttcccttttctagtgcctaatgggcattgcaaaaagccgactttttgaagaagtagagtttgcctttactagcaacactttaaggggaagaactaaatcggtgcaactaggtacttgacccaggttagcccagttatgtgttgtagtatctgcaggtgtaggtgtcactgaacataaaatactgaaccttgtgatttgatgaaatacctttttcgaagcctttcactttaagtactgtgaggatcctgacgtgaggaactgaccggattgggcatttttatgggctgaactgaataggaaacagttttagtgggcaatgggaagtattcctacatgggccaaaaaggaaatacaaacatttgtaggtgagtggcttttattttgtgaaaagtgatggtaaagcacgtacttgcctgaaatttcaggtccttggaacgtgactaactttgaggaactttatactttgctgtttgtacttaatctaagcacagagcctggcatatgataaatacttactggttgattgtaacttctacagtacgtatttttagttgtttgaagttcattttatatttctaaattctacagatttttcattcttggagttaattgagattatggttatagcataagtttgtgttgtgattagcagtaatagattagaaaaaagagttataagtagcagaagtttcatttttaccttaagtgtgatattttagtgggaacagttagcctt

SEQ ID NO: 43340 - DNA, 1042 bp, Homo sapiens
tattttaaaatttggaaatggaacatatgtctaatcaattcaggtgctaaagaggaaattaaaaagtctggaaaatattgagaaaatagacaaagttggaggcatcacactaccctgcttcaaactataaggctaccataaatgaagcagcatgatgttggtacgaaaacagacacatagaccaatggaacacaacagataacctagaaataaagccacacacatacaaccatctaatcttcaacaaagctgatagaaacaagtgatgaggaaaggactccttttattcagtaaatggagctgggatagctggctagctatgtatagaggaatgaaatggacctctgtttcaccacatacaaaaattaactcaagaaggattaaatatttaagtgtgaaacctaaaagtataaaaatcctgtaagaaagcctcagaaacaccattctggatgtaggccttgggaaataatttatctataagccctcaaaagcaattgcatcacaactaaaaattggtaagtgggacctaattagactaaagagcttctgcacagcaaaagaaactatcaactgagtaaactgacaacctacagaatgggaaagaaatttgcaaactacgcatccaacaaatgtctaatatccagaatctataagaaacctaaacaatttagcaagtgaaaaccaaataaccccattaaaaaatgggcaaaagacatgaacagacacttctcaaaagaagacatacatgcagccaacaaacataaaaaaatgctcagcatcactaatcatcagagaaatgcaaatcaaaatcacaatgagatatcatctcacactagtccgaatggctattattaaaaagtcaaaatggctattatttttaaaagtcaaaaaataacatgttggtgaggttgtgggaaagggtacacttatacactgttggtgggaatgtaaattagttcagctactgtggaaagcattttggagatttctcaaaggacttaaaacagacctaccatccaacccaacaatcctattattggat

SEQ ID NO: 43341 - DNA, 1048 bp, Homo sapiens
aatgccaactttcacctgatggtgatttccataccttctttgtttggttattaataggcctccaacattggaataaaatttctatttctcctagtgtttagattcatttaatttaactatttaatttacatgaaggactcgaagcccaatatgtttgagacatttgcccaagaataatttggcctagtctagcattcttttctctacttggaaccatgatttttgtactttaagtacgatagtaaaatctaaaattggcctgggtaccagaactactcattttcttcagctgaacaaggattccccaaggctcagtatcattttcttttactgcaaagttttagataaacaaagcagataacaagaacacgactgtctcttaaataatgagactggacactactctatgtatagacttaacacctggtaagttgtaaaggccaagttataggaataagaattactatttggctattatatcattttgcttcctgactgaaaataagtgtctttatttaaattaaaaattctaatagtagtattttgaatacatgtaactttctaaatacttctgatttcattttgatttttaccatttctgatacaaagccttgcttgtggaaaaatgccctgagaccgttatttttgccttttataaggataattaccactaacaatactcatatgaattcaagactgatggaaaaggaaagataattttttttttttttttttttttttttttttttttgagacggagtctcgctctgtcgtccaggctggagtgcagtggcgcgatctcggctcactgcaagctctgcctcccgggttcacgccattctcctgcctcagcgtccctaatagctgggactacaggcgcccgccaccacacctggctaattttttgtatttttagtagagatggggtttcaccgtgttagccaggatggtcttgatctcctgacctcgtgatctgcccacctcggcctcccaaagtgctgggattacaggcgtgagccaccgtgcccggccggaaagataatttaac

SEQ ID NO: 43342 - DNA, 1064 bp, Homo sapiens
gacaagctggttgaagctggtaatcaatgcatggccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgttgccatttatttagtaccagacatagtgctggtctcacagcttaatatttggtaatgaataaattctgctagtggtatatgttgatctgaacttacaatgatgggatatagaattggcagagtggcagatgttcacaattgtctacaagtagatgtgctagacaatggaaggatgcaggccaacctctttgattacaattgagattcatgtgactattgagccctggaaatgtagcttgtccaaattgagatgtgctgtcagtataaaatacataccagattttaaagatgtaccaaaaaatgtaaactatctcaatttttatattggtgaaatcaatatgtcttggtatagtggcttaaataaaacaattttagcctttctcagtttatttttctgcaaaaagattaaaaattgtacatgaagctcatgttaactttcttttggtcagtgctattttaaaggaagtatgagttgaaaaaaaattgaaataaactatatcatattactaggacttaatatagtggcatacccaggaaatgcttagtaagtgttcccttcacattttaaaatttgagtatacaatcatgtttgacaatatagaaatttaatttttagtgaaacaattctaaaccccttttccatagacacaagaaagatggcaaatttatgctattcctggaaaaatacattgtggcttagcaaataagcaagttcccacgttacttttgttttgcttcaagtaatacttctgccagt

SEQ ID NO: 43343 - DNA, 1039 bp, Homo sapiens
aaatattatttttaaggaaaaattaatttgtatcattcaaacgtaggtaagtttttgaatatcctcctaaaacacatacatgcacacgatatatgtcccatccactttattcttttcatagtagcagaatgattttaagggcaaaaaaatcaattatcattattatttcaaaagttctcaattctacacaaatactatttctttataaaggattcaaagaatatagcagtatatgaaacaggaattcaaatgggccaggcagtaatgaaaatttatcaatgacagaggacagggcagccagtctgtgccttggaaatggaagctctgtgggaaaggtcttccagtttttcataagctggaaatgcagatattgatacaaaatctgctgaaatagatccttttttactctttactttctcctctcttcctccagcagttctctgtgtgtatacacatgttcgtatgtatacttgtatgtgtgtgtatatgttcttttccttagctgataaatattttaatagatcagaactgttaacccttgatattgttcataaaaatatagatcaatttaaccatgacaaaacccacaagacacttccaatttttttcatttttcaatatcaaattaatacaagtagtatcctttgcctgttaaactgggatcttataactggactactaaagttggcagtagatttgtatttggaaattaacaaacttaactttcatctactttgtgtaaattattattttaaatataaacatgtaggccagccacagtggctcacacctacaatcacagcattttgggaagctgaggcaggaggatcacttgaggccaggagtttaagaccaacgtgggcaacatagtgagacctcatctctacacaaaataaaaaattagccagtcatggtggcatgcatctgtagtcccagttactcaggaggctggggtaggaggatcacctgagcccaggggttcaaggctgcagtgagctatgattgcgccaatgcattccagcctaggcaacagtgagac

SEQ ID NO: 43344 - DNA, 1049 bp, Homo sapiens
catatgaactcaaaaggaaataagggaagcaaggctagctgaaagcaagcaatcattcattgttaagatgttttgtttattcctaacagatgattttccttaaatcctaggtctgttgaaaatcacacacaaaaaattaaatgccaccaccgttgtcattcttttcttttccattttatgattcacaaatttgctcttccaataccaaacacctacaggttatagcttggtagttggtgctgggagggagatataaaggctgcaccttacatgttctctggctttggagaagtccttgatacagtaattgaaatgtcacacccagatatatataattatttccaacaaagaaaaacatttaagattataacagctacaaaaatacagagaatgagggcaaacatggaacaaaataataatgcaagtatccttctttaaaatttctattgcaaaaagatctaagcccactcagtcattcacattattggcttttattcccttggcaaataatgaacactggtagatgtggtgggcagaattatgcacccccaaattcatatggtgaagtcttaacccccagcatctcataatgtgactgtatttggaaatagggtctttaaggagataattgaagctaaatgtggtcattatgaaggttttttttttttttttttttttttttgagacagagtctcgctctgtcacccaggctggagtgcagtggtgcgatcttggctcactgcaaactccgtctcctgggttcacactattctcctgcctcagcctcccgagtagctgggactacaggcacccaccaccacgcccagctaattttttttgtatttttagtagagacggggtttcactgtgttagccaggatggtctcgatctcctgacctcatgatctgccctcctcggcctcccaaagtgctgggattacaggcttgagccaccccatcctgccaatgaagggtcttaaaccaatatgactgatgtctttatgagaagaagggattaggacccagaaacacagaagacaaatcacatg

SEQ ID NO: 43345 - DNA, 1076 bp, Homo sapiens
actcttgctgctataggaggtcctttccctcctgctgctactcgcctgcccaggactctgtttcctctatagctgctggtcctttctataatggctgctgcttgaggattggtgagcagggcaaggagacgccatcataggtaaacaaagcagggcttctggttaggctgtggtcctgtgtgcatcaggggctgcactgcgtcagcccttaccagttaagaaggactgagggttgaagaagccggagagccacacgacagccggaagggtaaggtcttgtgtccaagtatcgagttctcggcatcgcaggaggaggtcattgaacctggtttatgggagggaggaagaaaaacttgctgttcagtaaaatagccattttccagtatgttctgttgtgggcggttagggcagggtggtggtggaggagaagtataccactgctagctggtaaaatccttccctgacaatttgcagggcactgtccctttaaagggctagtttgtttcccattggagacttgatgactgtagcgtttacattagagcaagatacactgaggaatgtggaaaactcatttccatttatgcaacagcttttattagagcctcttcatgctatgtggtgactatacaaaggtcatcaccctatgacttggactgacaagcgccaacttggaggtatggacagggtgtctgaggaccagggatggcaaggctgtgatggtggttacaagaccagagttgccgggaaatctgattgataagcagagggaacagcatgtgcggaggcagtggagcacgtgacggcagtctaagcacgtgcagtagctgcctgaaagtggggaggaaaaaggttaattaggaaaacaagtcagccaggaatggcacgccggtgggttgagaaacgctgctgttacgtacatgttctcttctcggctcctcacaattgggcaaggtaggaagtatttgcagttgacctataaggaagctggctcacagaggctagggacagatgaacctcttcgataaaattaagagagaagtgaaaccttgaattgtaagtttcagaggctgctt

SEQ ID NO: 43346 - DNA, 1042 bp, Homo sapiens
tcttggaaagctgaatctgtatccattaaacagtaactccacgtttctccctcccctcagcatctggcaagtgccattctgctgtctccgaggattcaaccactctaggtacctgttataagtagaatcataccgttcttggttttatcgagactgggttattatcatttagcataacgtcttcaaagttcatccatgttgtggcatgtgtcataatttccttcctttttagtgttgaataatattcaattatatgtatgtctcacattttgtttatccatttatccatcgatggatacttggattgcttccaccttttggctcttgtgaatcatgatgccatgaataagggaaaggatataaagtttttcttaatcttcttaacactttgatgccctctactattactactaggcactagtagatatattaatactgttggtaatatttggaattctggcatttgcagtttccttggtgtcccacagagccctatgagttccaccgtgcatgttccctgaacaagtttgagatccagtctgtagatgggaagtttcttaccaacactcagattctcaggttctctgggaatgttggaggtcagacacaccagacccctgttcctgcagggcagtgatcagctggagtggaggagtggcctgccttccctgatatatgtgttcagcctaccagtcagcaccatcccatattgtcctacagctgacctactgccctgttacccacctgcttggccccaaagcctgttgagttggcataatgtatttcagagaaaagctctcaggtaatctgtatggcttataagggaaacctgcagtcctttctgaaaggggagctgtgaatatgactgctttgtagaaagatgtcttaggattctgggtgaaaatttttaattcccctcatgtaggaatgtcacagagtgtacctttttgacttagtattttcctagtaaaatacacctttcttaagaaaatggctacaaagtcagatgcatgtaaatgctttcagcaagggtttgttgatc

SEQ ID NO: 43347 - DNA, 1052 bp, Homo sapiens
taagagctgtcaacagtgcagctcatgggagctccagcttgctgcagctccgtaggagagaaactggtaggcactgaatgtcagtgttctcctcgtactctgttctagctccagagtacaggatggcccatttgagaaggaaatgatgctaaatgttcttgtaaataggcaggagcacgctgttgaaggggtaaaggggtatttttctggtattggtctcttagctgcaaagtgctcccatctgatcctgttgtttaacatgtaattccagagccccagaagctggtcacagaaaggacaatgatttgccactctaatagtcttgtatttaaaacgctccttggttgttctgtgttctgctggctaccccatccatagcagagcaggattctcaaaaatcaggcgaaaacctcagagatcataatgattctgatcaggtacacaggccaggaaacaatgagataattgtggcctaaaacaattacaaacattagagtaaattaatgaaaaagattagaacatcattggaatagaataagccaggcattacatttaaactgctcttgagagttttcctttactcaaagttatgttttagaatatttacctccagtatacagttttgttttagaaaagactcggctttattcaccaaaatggaatagattacaggctacttaaagtaggtagggatagagataagaaaatactactggggccattttgttctttttgtttatgaaaagcagtgctttctgtagtttttttgaaataggaccattcagaggcatatttggtaaataccactgaagttaacactcagaaaaatgtatcttccatagtagtaaatgctagcaccctgcatgcagcacagaaataaagtgtggagtctcacagtgcaaggggcctgagctttagttcaaataaatcgttgatgtttcctgcctgttttccttcatgatcatcagctgaggatagagggcttgctgactgggttagtacactgatcagatagtcagttgagcaccggttatgtgctaggcattggtagg

SEQ ID NO: 43348 - DNA, 1051 bp, Homo sapiens
aaaaatttaaatttaaacatctaaatctatatcttaactagttgttttaagtaaagcaagtcccatacactttgccagggatttgtaaaaagcaaacacatacttactaaaatcctgttgtttctgggtattcagtccttttctgctcagtcttctgacttaaacacataatggaataattaagttatagactagctttagtttatattaagcagattgaagtcaaacatttcattatgagtgcaaaatatatactttcagtaaggtcacactgtttttacacacacacatatacacacacacataaattatgcacttttacatcaaataacacataaatccaatttcaaattgcctctccaagtgcatggaatgatccataatgtttaggaaaaatgaataagttgcattgtacctagacctcttcagccctgactcatgatccattcctaatgatacatacatctttttgtttttaattttcagatgtaacatttattcatgaaggaaataaaacttttttggataatcttgtcaattttgaaaagctggtacgtaaatttcattacttctcccttttttacagtaacagaaatgtatgcctttctttcctgctctaggaaataaatagttttagtacttttctccattggatgcatggcgaattcaaggagcttatttgcttcattcaaggagcttatttgctgcatgttgtacgctgccaacaaaatgtattccaattaacaacaagtatgttagcaaggtttttgtgaaccaaatatgaaaatctgcgttttgtttttaaaaatggaatatgataagatgaagaactgagggtatattattgaaccagagctaaaactgtaaggctgctgtcaggaggaatccacactcaggagattatgttttactgctttataggcatctctcagtgtctcagcctgcatgctttcaaggcacagagggaaaaagttcctctcctggggatatatgtttgtctctcaggactccaagcttaaatgtgaggctggaatttgcagggtcttgtgtg

SEQ ID NO: 43349 - DNA, 1071 bp, Homo sapiens
agtccccatctcttcatggagccatcgctggggcgggtctttctcactggctcctgttgtatgtataattgagaaacctgcataccacgtaggttaacccaaactactgataatagttttatgtccagatatatgtctactggaaagacattttatgtaacgttgtctgcaggatattaagctatcataataatgttaatcacttattaccagatctgtatgtgctgagtaatttacatacggtatctcgtttaacacttccagtaaccccacgagagaggctgagtaaccactgtagcttcatacagccaagtcagggagagtgcttcgatttttaaatgcaattatatgtttgactctgaagcccctgcacatttctttcatttgtacatgccttacttggacctttcctgtgctgtccttcagcaggccacagtcctgtgtaattctgtcagtgaaacataaccaactgggtgctgcacagcatttttgagtaaataatgagattgattttaccgctccccatgaaggaggacgatctgacatgtagctactgtggggcttgttgcggtagaggaaacccccactctgaatatcctctatgcctcctctgccacccatacgtggccttctcaggtagctccctcctgtgcatccccacggctcaatctaccactgtccaaggccaccttcagaaaagaaggcaggcctgggcaatgccttgatggaataaataggtgctgtgaaatatgttccaagagaagccagactccatcctaccctcaaaagcctcccctgccaactcttgacaccacctaaaattgtcctactggaatcatagatttagatatttcatcaccaaaagatgtcagttaaaatctaacattgtaagggaagaataatacctgaaaacaccagtacctactatcactttcacatagattaatcttcttagaaaacaggaattagagcactgaaggaatgagatagaaaaatttaatgttccttggcaagggcaatggacaaccttgaataaatagagttatttaaccttgaataaatagagttaat

SEQ ID NO: 43350 - DNA, 1005 bp, Homo sapiens
cagagtgatcttttcatcctaattttggttctaattctcagagttggatatataaaatgtgacctttgatgtcttggttcagtttgatctgtatttgaaggcattgccagccattttcatttactgatggcttctgtagaacaattttagttaacccaagttctgccaatgctgattggcatagtgtgcatatctcagaattattatgacaatttgcactgtttgatagtctcccagggaaggtgtttgttcttccaaacaaaccaacaaacaaacatccaaggcactgtgtcttcgtcagcacattctagaaatccacagtagtgagatcaggatgaattaatattgttaagtattcttaacactccttgaatgtacctttcctacttttgataattgagaaaattgagaaccatatcatattgcagatcgtgtacttgagcttctggaaattttcagtgtacatgtgttatttgtgagtaggcacagctgcatataacagaaaagctctaatgatgatttaaacatggtataaatgtatttctctctcatgtgaaaataagtatggagaaatacagtccgcagccgataaagccactctgatatcagtcagttctgagattccttatttgaacttgatttcctgggccctgatggacactagcataactgtccaggcagcaggatgaagaaagtcatgaagagcacacttgcccgtcacacacggcttctgcttttacctcatggaccaaaacttagtcttgtggccacatctagctgcaagtgaagctggcaaatatattgtatattgttttgttgtgactttaaaatatcaggggagcaacatgcccagggagaaaaaatcaaagtttgattcccaaaaaaggggcaaatggcatgtaattttgtaaatagaagcttatgttaagtttgttttgatattgtagacccaataccataattatgtatttgtttcttcaaagaaatatggacatactatgtttt

SEQ ID NO: 43351 - DNA, 1028 bp, Homo sapiens
ttcaatttttgaaaggcaaaatattttaccaagaccatgatttaatccaggcagtggaaaagatgagcttattataaggtgaactttgcggtggtgtcatgtcctgggactgtggttttaagtatatcttcgctttttctccaactcttaaggcaggggtgatgtgcaagctccaggaaagagatgaaatcggacgaattgaactagtccagaagctggcaaaagaaaactatcagtttttgcagacggacaaaaaagaacaggagaagtctgaacacgtaagccttttgcctcttggggatgcaggtttgaaggggtggaaaatgtttttgcctgattgcatgtttgaacgaaagactattttattttaaattctttaggttttgggggtttttttccccccaagagcatcctccttagtaaaaatgacagctgctcatagctctaagcaagtggcttatgacacaggatttataagagactcttctcaaaagtaaattatgtagaaatatgagaatacatttaagcaaatatgaatccttatctatttatgatcctgcttgggtggctttcaagtttgattttggaagttttgccttatcatatagtttgtagaacatgaattttgaaaaaacatttcaacatatttttatgtttagtacagaggtggatctagttgccaaatgaatgtgtcctaagtcactagaaatagatgaaaacacaaaaagagattatagatgctctcaccaagtgggagggtcagaagggagttttcccagtatcttatgaaggcttgtgttccaacaagagttatattgtttgaatatagttaaagctggaggaaagggacgttccgcttggtcctcctgaaagcagttattcagattgagccttagaactgagagtgctgccgtcatgctgggaagacaatgggaccactttcttgtgccacacattgttatctgttgacttggttgttgttggttatgagacttcactctcagtgctgcactatccaggattgctca

SEQ ID NO: 43352 - DNA, 1035 bp, Homo sapiens
aggaaaaaggacatggctgtaatggaccctttccattacataaagtctacaaaaacactctaggaattatctggaagcagtgtgactttccgcattctaacttatcagcttagcctcctttctaatatcctctggtgctacacattttgttaacttggaaacctcttttcatcgactgcaagtctctgttgctgtgataaagctggcaggccaagaagggcctttgaatgacacagctcatcagtttccacccttgaagttctgagcattgttttatttttaaacatgaattcttccagtgtttgtgacaaatagagtattcagaattgatcagacaaatttaaaatattcatattacaacccaggggtctgcttgctcaaacctaaagtaaatacggggaagtgtttatggtgaattatgtattactttcaaagccacaattcttaaggatgtaaatttaggaaatcagctaaactttgaagcatttaaaagatctgagaagtacttgggaagcatccaaagacaggaaatagaaacatgaacattcttaaataggagataaaaacgtattctagacttccatctcatatttacttaaaatcaacaaccagaacaaaacctattaggttgtttctgttttttaaggctaagtttttatgttggaaattgtagaaatagaaaagacaaacatctcatctgggtttgaatgaaatttgtgacttttgttcatagtctaattgtcaaacacctgaggtgatgtgagttaggctaagttgtgcattatttatattagatgcctatttggtaagatgggtatgtgggaggtccttataaagggacagggagcatgtcatgtgtcctctatgctgctagattggatgaagtcagccatcacatgggtggtgaaagagaagagagtctgagtgtctggaataaaacattaacccggtggtggtgggggggaatttatgtctctctcttctgatccgtagtcagacgcgttatccattgcgctactgatgtctctctcttaa

SEQ ID NO: 43353 - DNA, 1034 bp, Homo sapiens
ttcatgatatcaaagatctcaagaaaaatctaattctcattcttccaccatcccacttcttttttcataggaatttgctttgttaagcaaaacttacttgtctagaatatagacatcatgggtaggggaaatggggagatgttgatcaaagcatacaaactttcatttattaaattgagcaagttctggaggtctaatgtacagcatgagtggtgatgggtgttaataaatttgattgtgctaatcacagtgtattcacaaataatcatgtggcacaccttgaatagatatctttgttaattacatatttttaagtataaaaagattttggctttatgctaagtgagacgggaagtcattcaaggattttgagtagagggacatgaactaacttacattttagcaagactatgctggcttctgagtccaggtgagagatgttgtggctgggaccacagtggcagtgatggaggtggtgagacgtggtcaggtgagagatatgtcttgaagagccagtaggatttcagggtggatacaaggcagagtatgagagaaaggggttcaagaatgacttccagttggaaggatggagtttccatcaattaaggtgaggaagactataggaagggcagggctttttgttattttccttttgggtaggagtggacataatgataatgcatccagtttgatggttagagggatgagggtggaggaccataggtttttgtcatctctgcatcctcacagtgacacccttagatattgcagacctcttgaacttacagagacatctgcctagagcaccaggactcagcactctcccctggagagttaccaggtctggcttggggcattggtaagcagagaccttgaaaggtaacccagggaattcctaaaggagagcatctgttggcataaaccctcagggagggatcttccttccaggggtcactctatttctcttctctttctgtcttatgtcacttgtcactgtcattacctgctgattccagtaagagtttctttatttt

SEQ ID NO: 43354 - DNA, 1026 bp, Homo sapiens
agtctctctgaagagctgaaagagatcttactggttatattggtagaaattaagtaagaaaactgaggctccacaattggtatcctgctgaaggtcatcatgaggaagttaagagtcaggagccccttaggctgggcttctcagtccagggtctctgagaagttagcctcaggctgcggtgaagggtggggctaaagcggaacttctcaaactgaagcctgcatcagaatccctggagggcttgttaaaacacatattccagggcctcagccttagagactttggttcaacagctcatggacagggcccaatcatctgcctttttatcaagttttagggtatgctgttgctgcatccacagaccacactttgtaacactggactagaaggcctcaaaagtttggtgactgtcatcatcagaacattgcttaggtcaggagtatgcctggctgtttaccacctccgtgatgaaggccagacccaaatagaggactctgactataagaactttattgaatgaataattttggaaactcccccttggtggtttctgcagagtaactggcagtttaaaaaaagaaaaaagtggggaggatttggagcatcatcgcccatggcagctatgctggctattctgtttgtccatcctgagtcctctctgcccttccctgttctggtctgcaccgtggaggctgcctttgtggatgttcatcaccaggactctgttgccctctggcttaggttgggttcagtcagtggtaggtcaggaggagcaagaggccagcagtatctattcttcctgcttgctctctttttctctgtggtgcttgcagtgtctgtgaccgcctataatggcagctgaccctgggcagtccctcctcaatcgcgtcacctctctccagcctccagtacagctgtgtctccccttggctgtcaggcctcgaactgttcaaggcttgtcatgactggtccctttgtgctgtagcatctccttgggcctctgaaccttgcccacacatctttgat

SEQ ID NO: 43355 - DNA, 1028 bp, Homo sapiens
tgtttctattatccttgacggttactttttcatggcacagaatactgaagacatgagggctgccaggcagtctgcgacaagaattgctgagggtttctgtataaatagatctatagtatttatttgcgttcatactcatgtttcttgctgcctgggagggtgtcgtataccttgtcaatatacctatttagttttattttttaattactctgaatgtggttacctcagataatgtatgctttattaaccctctttgattctaatactgtattatttctttttgggactttccaaacacatttcgtaactgcatagccagtttttattgaaggaagtttgattgtcagtttttccagtgttggaaacccatactttttgactatttatttgactgtttatttcccctttcttctgccttggaactacctttgtgattttggaatcttccccatcaaaggagtaggaagggggttgaaagaaggagaaaaacaagtgaaatatgaacttgtcttaggcagctcaggctgtcataacaaaataccgtagactgggtggtttaaacaacaggaatttattttctcacagctcaggatgctgggaagcctgagatcaatgtgtaggctgattaggtttctggtgagggctctcttcctggcctgcagatgaccactttctcgtatatcctctcatggccttcccttggtaaacgcagaggaagagagggctccctcttctcataaggccactaatcccatcatgagggccccaccatcatgacctagtctaaccctaaataattatcaaaggcctcatctccaaataatgtcatgtttggggttagggcttcaacataagaattttgtagggggcatacacttaacagtccaaaacacagggggtttgaaagaaagagagatacaagtagaatatgtatcagactggttggttggtgacttgttagcatctgggattgtctggttaaccaccttggattgggcagtgatgctaatgcaaacaaatcatggctt

SEQ ID NO: 43356 - DNA, 1032 bp, Homo sapiens
ttgagaggttgaggcaggagaattgcttgaaccctggagatggaagttgcagtgagccaagatcccaccactgcactgcattccagcctgggacagagcgagactccatcaaaaaaaaaaaaaaatttacaaaaaacaaaaaaaagaccattgcatgctcatatttcacatacacaagttgtagttgaaaacaacaatttttaaggaaaagtttttggagaaaaactcaaaattctgcaaaggggggaaagaccatagttaactgaatttaagaatagttcagacatgcagattaaaacctcactgcttttgcttctacagcctttcctttgccagcctgcattactgtgagtcagttacacttaaaagggaaatctcttttgaaaagcaaaccctcccaagagattaatatctattaggtgtcaacggcatgtcttttaacagttgattctaactgcctctttattcccacttcccaaacacaaatgtctaatgcacacagctgaaccttgtcttctaactttattcaatcaacaaatatttattgagcatttaacacatgcatgcactaccctggtctcttgggatatgtcagtgaacaaacagataagaatccctgtcctctagaaacttacattctagcaacttaaaggaaacttactattcagatattaatgtcattaagcatgttgatttctaaggaaagtcgagtccactacagtattgtgatatagtgccggtttctttttttctttttttttcttttgagagggagtcttgctctgtctcccaggctggagtgcagcggcacaatctcagttcgctgtaacctccgcctcctgggttcaagaaattctcccacctcagcctcctgagtagctgggactactctggcatgcaccatcacgcctggctaatttttgtatttttagcagagatggagtttcgctatgttgaccaggctggtctcaacctcctgacctcaagtgatccacctgcctcagcctcccaaagtgctgggattataggcga

SEQ ID NO: 43357 - DNA, 1042 bp, Homo sapiens
ttctcattatacacttatcacagggcttttaattcccacatactttacacaggcaccaaatgtatcatttcttttcattttctaggctatactgactggaagcctggtagctttgtgcaactttcaggccactaaactggccaagacacaactggtaggcacaccaaatttctggcaggagcagcagtgtggaatccatttcccaccaccttccaagactaggagttatatatacttcattttatcagcagccagcccttcaaagggaaatgttagctctcacatgtttcagcttcatctagaaaatctcaataaaaaagacaagttattgctgatcatctttcagatttaagcatgcatgaaagtgagaaccttgttccctgctcatacatcttacatacttgcagaccagaccatggtagaagctggaagtacaaagtggacatctaccaaacttactccaattattttaatgcaatcttcactaacagtattatgtagaaaaataaaacatgtgggacaagtgcgaaaaactgcataggacaccaagcatatactggaagtatttcaggagaagcagtgcgtatgactttgttggccatgggagagctcaggatgctgttccttgggaagggaacccaacaacaacaagggaagaaaacgtgggggagtttctcgggacaggaaatacctgagcagaaccttaaaagatgggttgaaaattgtcaggtaaagtaaaaaccttctgcacagcaaaagaaacgatcgacaaaatgaaaaagaaacctatggaatggaagaaagtatttgcaaatcatatacactgataaagggttcatgtccaatgtatgttagagtgtgcctacaactcaataatgaaataacaaaatctgattaaaaaatgagcaaagaaaatgaatagacgttttcccaaaaagatgtacacttgaccaatagatatatgaaaatatgctcaataatcacgtcactaattatcagagttacgcaaattaaaaccacagtgagatattacctcatgcta

SEQ ID NO: 43358 - DNA, 1053 bp, Homo sapiens
tcatattccaatggaagtgtccatcagagtggttctaaatcttggctacgcattggaattgccagtattccagggtttgcacaacttgcttgtaagaaatcttagggcagtgtttatcaacctatagcaggcttcagaaccacctggaggtttgttaaaacagatttttgggccctgtccccaaagttcccgattctgtctttctggggttggcctaagaatctgtatttctaacaaatttcctgtggctccaggttggggacctcactttgtgaaccactggcatagggcattgtcttgcaaagcgcagtcctgtcccagagtatccaggttggaattagggactcaaatgcaggttcttggccctggcccaaatctataggatcagatctcagagggtagggaccggggatctgcctcataaacaagtgttccagatgattctttcacttgcagaagcatgagaactgtcatccaatgggtctttgaactccttcatctcatatacagcccagcttttaaatactgtcacattttgaacgacaactgcacagcagaactgcatttacagttgaccattagctgctgctgtgacttgcttctggttatttaaaatgcccacaagggatctcttagcccatgcttcataaataaagcccaaagaagaaatatttattcattcatttttttaaaaactctccagttgtcaagtttccgactcatcagggggaaagactgattagtggttgtttcatgcttccccacacaagtgaaatcaggaggagaaaagcattctataaaagagcttatttcccttcctcttcgcctctcctgcctcctcatttacccttagctattcagtttcatcagcccttgtgagaatatagctctgactttgagtttaaaggggttgggctgcttggagagcagtgccctccctgctgctcttgcatctgggaagctggatcaccacggggacttcccccaagccggaaaaggtcgaccaaatccccattcagaggtggagggcgggaagccaggcccaggctcgga

SEQ ID NO: 43359 - DNA, 1028 bp, Homo sapiens
cttcaaaacagagcagaaatatgagaaatcaaaatagtttatcccctgttccctgccttcctactcttcttgggcaggattcaaaggagaaaaagctcagcaaaaaagcaatctccagggactggtattgggattagcaactgccaggaagacaaataattctcaccttagaaatcctggttgttcttcctgaacacgtgagaaaacgggctccctgtgcttgcatagaaaagtgaagatttctcgagcttggggtaagattctcagccctgggcatcactgcaagggaaccatgtagttcctgcttactctgcagtttttaccccgagactgaaggagttcgctcaggacccagcctatcaatctattgatttggggagaggagagagtaaaagtcatttatcctttctctgtaatcctttaactgtacttttctcttgacgtttgttccagttgttaatttattgccttgcagctccaaaccgtcctttttgtcttgctttgtgatcctgaagctagaatctgcacattaccgcattaccggctcttctttgaccggcgggtttgggtttggtgtatggcgcggggaggggggggattgtctgccaatagagggcgctgcagggagcctgcaaagctgaaaggaagggaggggtcactttctttccgtttctcacacaaatatgagcaaattggagtgtggagggtctcaggagcgttcatttcagtggtgacagttctcagggtgctgtgacgagcaccctctggcagcctgtttcttctttcctgcagtagccacgccctcgcttccagagtctttccttacttacctttccctcagtcaagggtggtagcagccttctgtaatttctacctcaattatatcttaaacttttcctttatgctttttaggagttaatcatcctttgtctggttatcagttctttatactggatttcccctgtttaaattactaatgaatcccagtgaagaaaagcctgggacccaatggcttcactgctgaattc

SEQ ID NO: 43360 - DNA, 1043 bp, Homo sapiens
aatataggtacatgtaataatttatgtctatgcacacctcttttatttctgtatttatctgaatgtgagtgtgcatatcttttttttaaacatgagtcagcatgataactaactacagtccagcactggagtttattctagcttttctcctttccatatttgtaacttctttatccaatagtgagaaactggctctgcagtatgcactcatgcatcacttaaatgataggaatatattctgagaaatgtgtcgttagatgtttttcattgtgtaaacattgtagagtgtacttacgctaacctagatggtagagcctattatacatgtaggctatctgcaagcctagtgctcctagctacaaatctgttgagcatgctactctattgaatactgtaggcagctgtatcacggtggtaagtgtttgtctttctaaacagaaatgaaacagtaaaaatacagtaaaagaataaaaatggtacacctgtataaactttccataaatagagctggcaggactggaagctgctctgggtgagttagtgagcaagtggtgagtgaaagtgaaaggttaggacattctgtacactaatatagactgcataaaacactgaagacttaggttacactaaacttataaaaaacattcttcaataattagccttagcttcctgtaacttaccatataaacttttttgactcttttgtagtaacacttagcttaaaacatgctgtacagctgtataacatcattatatccctattttacaagcttttttatatattaaattatttattcttttttacttcttaaaatttttgttaaaaatgaagatacaaacatacacataggcctaggcctacacagggtccagatcatcaatatcactgctttccacctctatatcttgtcccactgaaaggtcttcaggaatcataacacacacagagctgtgatgtcccatgataaaaattccttcttctggaatacctcctgaagtacctacctgaggctgttttacaattaacctttaaaaaaaactgt

SEQ ID NO: 43361 - DNA, 1029 bp, Homo sapiens
attttaaaatgctatggttttaacaaggtgctgcttcctatttaatttaggtgtcatgcattgtataagataaagtacactctgactaagcagctgtggtttctatttctccatgagttgcaagccaactgataacctgggattatagaacttaaaaagacgtttttctcccttattctgggtgcaattttttaaaaaaacattacttttctagattttagtgactttgtatgggtaccaaggattagagtaaatatgacagttggtgttgtccccactattcttgcagcacctccccccacacccacttctttcacttactgatagaagggcctactctggctggtcaaacactgggactagctccccttttagctaagagaggtgtggaagcttgattcttccccttctttgtgccaccttttttcactgcgtgtacgaggtcctattttagcgtgctcttgctttttgtgtccctttggttttttgcttctctgtaagtcttttcatctactgttccctcctcctccctgttttgagattccgtttctattgctagaaagctgtagctggttgctgcaatctgcatgccaggggcttcgtgtaagagtggataatgcattccttttccatactagagtttatctttcattttatgcacactggctatattcccttcctaggactaccgttacggtgattttcaccccaacattcaattcaagttatatgagattggtgttaaggttgtctttccagtacttgtctatcattgtcttttcctttatactgtatatttaattttatgtctaaaccagttcccatgttgaaatagagacagggtcttgctgtgttacccaggctggtggtcttgaacttctggtttcaagtgatcttcgatcttggcctcccaaagtgctgggattataggaatgggccaccacacctggctccaggttgttcttttacttcctccacctcaactctcactaaaaccagcaactgcggatttaactttgtgtgtaattt

SEQ ID NO: 43362 - DNA, 1030 bp, Homo sapiens
gaataatgtaactgaaaaatattttttaaaaaccacttaaaaagaaaaataatttgatgggtactttaagcattgtagatagaaattaatgtataatagtgtcctcccagtctttgtatgaaaaattaaaactctctagtcctttaatgagcatgaatttatacttctacatttgttgcttagtaaaattatactcagtactttgagttattcagatttatgtttaatattgttaaattcttcatcagagagcataaatatattgtcttctatactttgtaacttgtgcatatctaaagaaactaacaacgaacattttgggagatgtttttgtgtttttttatagtagagttttagagtacatttgtcttaataggaagtttttaccataaacccaagattttatttcacgtattgttgctttctcttatatggaacttattgtgtacctcttacctttatttctaatcatttagtgatactaatcttttcatagtaaatatatttgtttctaattgtattcctagagtttacattcctaaagaataaacgacgactttggctatttttgtgtgttccctaccttcttaaggctatggaaataaactggagtttagttttttgaatttttgtatatttgtgtaaatgttctccatatgtagtactttatacaacaagtgttgcctcttgttttattgaaataaaaactgaaaaaaatattttttccagatcagtttactcatttaaaaaattattataaaaatttgcagaagttttgatatgaaggaagagaataaaggaggaagacttaggtaagttgagccattgagagcttttgggggtaagtgataagacaatgacctcattcctggctttgtgctttacatgtcatagggctgaggagtatgacaggtccactcgtattcatccaaagatgaagatgagctctatgggccatgcaccagtggcggattatttgtcatatcagaagcacaggcaaatttaggtaacatcactttgtccttctaac

SEQ ID NO: 43363 - DNA, 1009 bp, Homo sapiens
aaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaaatgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagt

SEQ ID NO: 43364 - DNA, 1028 bp, Homo sapiens
tactgctttgacctcactttaagaccactctcaccctggttcattagactccttcattctaacacttcaacgtactaagccattctgccttaggggcattgtctagttatttggagtatttgagctgaaatttgaatagtgaaaggtatgttgacttcccttactccagattgttgtgtggctagcagtttttcatcattcaaacctcagcttaaacatctcttcttcaaagaggttttcccagaccacccatctaagtacttttatcccctattaccctacttcctctttcccatcttatttttttattgcattttctgctatttaaattatcttgtttacttggttccgatattacagtgtgagctctgttcccttattatatagtgagggaagaatctatctttttggctgttgtatccccagcatctaaatcaatgtctgacatattataggtgctcaacaaatttcagttgaatgcatgaataagtgagtgaatgataaagaaatgtataacatagggtgagcaagttgttctttcttttcttgttttgttgaagaacagtataacaacatgatagtaaactagattaggggatatttacttataattccagtatttaaagaattttcatttagttttttctatgcatgtatgttttcatggttgtactctatttaaacttttttggtattttgtttttgtttagttaatattgtcagacattttccctagttctcctagtaaatacagttattttaatggctacatgatatcacattgagttaatattccatcatttgcttaatcattcttctaatatgttaagaaatttgtttctgagttttgctattataaataacactgtaaggaatagcttaatgaatacagataacatttttctccattgaacagaatatattataaacataaaatgactatattaaaggatatttgttctggtatggcatttaaaatatctacatctcataaattgtaaaagaatgtgtatgactttgttttgggg

SEQ ID NO: 43365 - DNA, 1035 bp, Homo sapiens
tctttttttcctctttctccttgcctctttgttttcctagtttttggaaagaagaaagcaattggcccttttttctttttttctgttggagctcttctctttttcttttacttatttgtctttatttattattgcatttcctctaatttctcctctttctatcttttctgggtagaagagggaaacgagtgaatgaggttttctcatggaagacgccaagtaaaactttcctttttgcttttttttttttttccatctccctttaccataaaagaatatacgtaattaagccatgtgaatgtactggtgtgtttgcatatctgagtcaccaaaaattattacacagccgacaaatacattaaattagagcaattaatggatatttattctcttttattatcagtaacagaagaatctttcaattttctttacagcccaatctcacattgtagtgtttttaaaatgaattttgaaaagttttaattgtttacattttaaaatattttaaagctatcctagaatgtattttaggattctgtaacgcttcatagatctgccatttttttcttaaggttaagaattattcacaacatattttaatggaaagtattataatggaagtttaaaaattactttattcttaacatttctacacatttcagaatacgcatctctggccatggttttgctgttgttatcaattcaagtttctagaattgtattttgaccagtcctgttatttgcttggctctgttttttatttttatttttttagtaaactttattttttagagcagttttaggttaacagccaaattgagtggaaaataagagagttcttaaatacctcatgaccccacattcatagcctcccccagtatatcaacatcccgcaccagagtggtacgtttgtaaggacctataatttaaattttgaccagacagtgcatcctcatgtcaattaaataggatgatttttaaagaaaggttggttttaactgaggtattattttggagagatctgtttgacaacta

SEQ ID NO: 43366 - DNA, 1646 bp, Homo sapiens
tttagtatgaggcatctgtcttcaaattttgttgttgttgttgttgttttttgagacagagtctcgttctgttgcccaggccggagtgcagtggcactttctcagctcactgcaacctctgcctcccgggttcaagcgattctcctgcctcagcctcccgagtagctgggactacaggtgcgtggcaccacacacctggctaatttttgtatttttactaaagacggggtttcaccatgttggccaggctgatctttaactcctgacctcgtgatccacctgcctcaggctcccaaaatgctgggattacaggcgtgagccatcgcgcccagcgtcaaattttgccaagaataatataccaacataattttccattaggtgcttttcaactccagttatgccttctgaaatgtgagaaagctaagctagtatttaagaaggtcactacctttgaactagtacagtgtgagaaaatttaaatgtttttgctataatagtatttaaattcatttggctcctttagatcttgttttttaaaacaccattcatgaacacaacattttctccctctctacagacaaaattaacttttcccacattcattaaataaaatgatgacagaattgtgaataaaaggtattattactgcactaatatttaagatacccttcctttcatttatcagtggtagcctgggtccatggtattttccagagcttgtcttttcagacaaacagctgtctttttgcctttgggtgtttcacagaaaatattttacctcgtgacggtcagctagtatataagctgaacattgtaattcatgtttttaatgaatgatctagttttagcctagatgatatatatatatataaagtagtaatctttctattcactaatttttttaaacatttatattttggttcatttattcttcaattttatagttagatatatatgttagacatgtatacacagtatacatagacatgtatacatgtaactatgtatacatagttacatatgttagacatcaatgtgttttaaatatatataatgcattttatatatataaattatatatataatttagatttatttttattcagaggattaggaatctgctgtttatttgactgttattcccttttatataaattcccccagtattaggttactcttgatcaaatgacggaaatggaatgttgcctcgagatcttttgtgtcatacttttgaaatattgaagaatgccttaatctcgtctttatgtaagcagttgcagtaaaacctttttttcccccgtcgggagaattgtgaaaggtttccaaatagtccacatttgcttgcccttctggtaaataaaactctcttattaaacttaaaaaaaattctattcacttatatatcccaaggtgaaatatgacccacttttaaagaatctaccaaagtataagcaatggcaattttcatttcttattttgtttatctataatatgttccctcagcaaagatttgcgtatgagggcctgtggtgagtgctgtggttgcagagatgataagacagttcttgccctcaaggagctcacagtaaagtgaaaatgaatcaaatgtctttattgtaaaaatttatgctgtttaatttatgcac

SEQ ID NO: 43367 - DNA, 1052 bp, Homo sapiens
acaatacaacttcatatgtagaaaaccccaaagattccacaaaaaaaacccagttagggctactaaacaaattcagcacacaaaaatccatcgtatttctatacactaacaatgagcaacctggaaacaaagtttttagaattccatttacaatagcagaataatacttttttttttttaattgagacgttcttgttttgagtttcgctcttgttgcccaggctggactataatggcgcaatcgcggctcacagcaacctccacctcccaagttcaagcgattctcctgcctcagcctcccaagtagccgggattacaggcatgcgccaccacgcccggctaattttgtattttcagtagagacggggtttctccatgttggtgcggctggtcttgaactcccgatctcaggtgatctgcctgcctcggcctcccaaagtgctaggattacagacatcagccaccgtgagcagcctagcagaataatcttaaccacaggagcaaaagacttgtacaatgaagactacaaaacactgctgaaagaacttacagatgccagtaaatggaaagatacttcatattcatggatgggaagacaatattgtaaagatgccaatactacccaatgcagtctacagattcagtgcaatctatatcaagatcacaatattttttgaagaaacagaaaaatccaacctaaactttatgtggggccagacacggtggctcacacctgtaatcccagccctttgggaggccaaggcgggtgcatcacctgaggttaggagtttaagaccagcctagccaaaatggtgaaacctcatctctactaaaaatacaaaaaattagctgggcatggtggcgggcacctgtaacctcagctacttgggaggctgaggcaggagaattgcttgaatctgtgagccgagattgtgccactgtactacagcctgggcaacaaaagcgaaactccatctcaaaaaaaaaaaaaaaattatatggactctcaaggaaccccaaatagccaaaacaatcttgtaaaagaacaaagt

SEQ ID NO: 43368 - DNA, 1033 bp, Homo sapiens
tgttttcaggatgactgtatgagatcttcttgacctattaggtaaggtctggtcaacttcttatggtagcttttccttaaactttcctggtattcctactgcatgagaaggtgtccttcctaaagctaatgttaacaaaagcctgatttgtagcaaataaacatgggtgtcctggctttcttttctaacagcaatcagaaacggagactgttcatctgtttatcccagctctatcagtcggtgccatcatcggcaagcagggccagcacatcaagcagctttctcgctttgctggagcttcaattaaggtactgttctaccagctgtggttctctggttctttaagtaagttacagaaatatgaatcttcttgccactttataatttgaatagaatgtaaaagacactgttagggttacataaggatatgaagaaacccccaaacaacagtggcttacaccaaggaggctaacttctctgtgcagaaaacacagttaggaggtgaacatccgggctgggtgttggctctgcccccaccaagtccttggacctaagttccttccaagccaccttccccaggtacggccttggtccctcttggttccagattgacaccattcagtgctccaggaatcaggtctgttgcccagccagtaggagaggagaacataataaagagcttttcttctagggaggtttcttgttagctactgtgggatatttctacctatatttccattgcccagaacttggccagacgaagttgaaggggcaaaatacaggctatgcacagtcagctaaacattttgtaactacagaaggtaacataccagaggacaaataatggtgtctgccgtaatagataactgtgtgttctgaagattctgtattttgatgccttatttaaggaaaataaaggttggccaggtgcggtggctcacacctgtaatcccagcactttgggaggccaaagcaggcaaattgcttgaccccaggagctgaagaccagactgtgcaacatggtgagacccca

SEQ ID NO: 43369 - DNA, 1682 bp, Homo sapiens
atacaacaacatggacagtcttaacaatctgtgttctttgcagaattccagtggatattttattctacatgtgttccaggcagtgatacaatggagttctcaactttataactgaatattttcctaaatcatttatccaaatcatatatttccctaaatcatatattactgtttttatttcttattttacattgattgacaatctgtaaagttcagcattaattattccctgccttaaggggaaaaaaatgtttttcccatacttaaattataattatcccagacaatttgaatgaaaatccctgggggtaggggtgaggcaaaggtatcaattttgaaagctcccgagatgactccaatgtgtagccaaggctaacaacaactgtttgattagttaagaacttgtgtcccacttaaataaataaaaatctcagtgggagcaggtggaagctcaaaaatgtgtagtttcataaaggtcatcaggagttttatgctacccgtttattgtcaggaactgttcttttcaagagatggggactcactatgttgcccaggctggaattgaactcctgggtgcaagtgatcctcccacctctgactcccaagtagctgggactacaggcacacaccatcacgcccagctaagaacttctgttctacaaagaatgtttactagtctttggaggggcgcttcaatgttgaaaagaacagtttctatcagtaccaattgcaagggagaaaaagttcaggataagcacaaatacatactagttgtgtatatccctttttctaccttgttctatgctttgaagagtgaaaaaaaactcacctctttctctctggaccacctgccatcccaactcgtaggaaatatcatgccaaaaacctctgtgggatgttgccgttatgtctgtttttacccttctaactctattttggcatactacatgtatcaggattaggtttgggtatgtattgttactagaaaaaaaaatggcttaaattcgttttcctttttcatgagaagagttcaagggtagacaatccaaggctggaagtggttccaccatatccttcaggactggtgcttctatctgccttgtgtgccattccctggcccaggataactgctcaagctccaactattgggtctgtttccagccaacaagaaggataaaggattgctggatgtggtgacagacacctgtagtcccagctactggggaggcggaggtgggaggattgcttgagcccaggaatttcagtccagcctgggcaatgtggtgagacctcatttcaaactgaaaaaaggataaaggatcaaaattggcagcatccttatttaaggacactgcctgaggatagcttttcatacttctgtttgcctcatgttggccagaacataccactggctgtgtctagctgcaagagaagctgggagacaatccctgtgtgagggcagcaatgtgcccattaaacacaggatctgttactaaaggaaaatacatgttggggacagctatttgtctgcttcactggatttggcactattgcctgttaaaggagcctcccagagcctggaagagaggaagcaagcttttaagttctctcaaaaagcagaatctaaattctggaggagaaaattccatattccagattcccattcctgtggttattttcat

SEQ ID NO: 43370 - DNA, 1050 bp, Homo sapiens
gcaattcacctgccgtttctagtatgttttggcctggaaatcatgtaacagaatgatagccatcaaaatttcagctacaagtgaagtgtgcatagattcattacgtgccccctgaagtggctggcatgtttttactttgatgctaaaggggactggtagaaagaaccctggagtcagagcccaggtctggcccactgcctctgacacaattttgtgtcactgaaggtcagactccttggctctggatttgttttctcacctgtataataaaaaaaacctgaactataagaattgtgtctaaagcctttaaggtcacacatttctagtttctacagaattaaataatatgaaaggtttaaggaggaataggggagaatgagcctaaaataggaatctgagagtacatctagggacttaactttgaacatgtccactagtttatgtgtgtgtcataggattggtttagggcaggtgtgtccccaacacttctgtataaaatgacacttactaaaaggtacaatgagctgatcatgtgacgtaactctgtgctaggaaagctcgcatctaacccacatttctgctggttcccctaaattagctttctctctgggtgggttgcttaacctctctgtttcattcccagtttgtaaactgaggtgtccctttaactctttttttctctctatactggtgacatgttccaatcaacaaagcttttcacattacaagtgatcacagaatagaacattcttggacatcagtcttttacacttacatggatgcttcagtagccaaaattcctagagtgaacttgtaggtaactatttttaaaatatgtagataagactgcatattctctggatttagtcatttttctgacttatggtatagttctgtgtatcaggttcctatgttagaaaaattaagaatgctttgagagaagtgagatcatattaagaacttatatttctccagcacttctacagtcttaaatgtctgaatgacttaaatcagtggcagttttgttttaagaatgggaggaggaggtcg

SEQ ID NO: 43371 - DNA, 1029 bp, Homo sapiens
attctggagattatgcataaggaagctcaagatataaaattgtgagtaaagaagattgtcctgtgaaagaggttgatatttgtgctcttgtatttttgacatctctgacacaattcttgggaattgccaacaaacagagggaaatgatatcctgatgagctacagtggttggcactgttgatctggttgtgaagtgtatgtcttttaatatttaaatattttcattcacatttgaacataggcgagtggtgataacggggaagagaaatgcagctatagaagaaggcaacttggggaacctaggaccaggaggtatcctggattaacccaaaacaggagccccaaatcttgactcatcctttactcggagctcattggagctctgttcttgtccactgcctggccccaccttggagcagcagggagtgtggaggtggggaagtgcctaagtctcttctaaggcaaactggagatttatctgggtaatgcaggcgggaactctatttcttccacaggaactttgagtgaaggttgggttctgtgccacgtttagcgtacagaacagcgctgcactgaaagtagaatcgagagtaaggcactggagttagtgtggggacctcattaccaaccttaatttgtagagaactttaaatatgttttagtaatattatatgtgggtgccatatcataagaatgtaattattaaagtaaaaattttaaagaagaattattttagtatagagaaaaataggcctggtgtggcgactcatgcctgtaatcccagcactttgggaggccgaggcgggtggatcatgaggtcaagagatcaagaccatcctggccaacatggtgaaaccccgtctctactgaaaatacaagaattagatgagcgtggtggcatgtgcctgtagtcccagccacttgggaggctgaggcaggagaatggcttgaacccgggaggcggaggttgcagtgagccgagatcgcgccactgcacgcctgcctggcgccagagggagactctgtctc

SEQ ID NO: 43372 - DNA, 1048 bp, Homo sapiens
agcaggcctaagaggacatgcatgttcatcataggcaccatgcctgcattggactagctgacccatttctcatgtagaaccaaaaagaactgtactgagtggtggtccatacccacctgctccctgcagtggcatctgatcctgccttcccctgctttgaagcaggagatgttgggtgctggttacctgaatgcaaaattaatcgccctgacctcatcatgtaggagtgggaaagacaactggaccataacctagtcagtcggcctggctttaatcttaaaatttaagggcttcttgcttcccttgatccaccgttacctgcagaaattcattatatggcttcccttccttctcatgtagcagattagaattgttccttttcgagctactcatttccctgtcagatgaaagagctgtgacttaaattgaactgtttgttttacttaaggcaggaagatggggataggggaagggaagcaatttttgttatatccgatgattcatttgcagagctctgccagtggatttaattaactcttgacattgaaattagtcattatcagaacctcgtttctggaatggtctcagagggccattctaatctccaaagccacattcctttctctcaggggatcggagcttagtaatccttagcacagtgaaagggtgaaaataaactgcaaagagggatgctaatgtgttgctggaagacaggcatccctgaaagtgactggggattgaaacagcagccgggaagatgactcctaagattgggactgttatctaagacactatttttttattagttatttttaggtagcccttaatttgtttcatgcccttatttttagttttatcttttactcttgaggtaaatcttcagatttcaaccaaacatttaggaaaatgaaagccaaatcttgattttattggcatgatcaagtggtcactctcatggccatgagttatttagccctttaagtgtttgaatggccaaaggaactcaacaaatacttaattttcccaaaaacacatatttttgagtagc

SEQ ID NO: 43373 - DNA, 1070 bp, Homo sapiens
ggattacaggcatgagccactgcacctggccccagtaaacttcttatcaatacatttaaattctaccaactggcaaaattactcatcatcttctcagcgacccttaaaatagcaccaagagcaaagagttaagtaatgatgacaggatcctggtctggcgctgtggctcacacttgtaatccaagcactttgggaggctgaggcaggtagatcacttgaggtcaggagttcgagaccagcctgaccaacatggtgaaaccccgtctctagttaaaagaaaaaaaaatacaaaattagctgggtgtggtggtacacgcctgtaatcccagctacttgggaggaggaaggagaattgctcaaaccaaggaggtggaggttgcagcagtgagccgagatcgcgtcattgcgctccagcctgggcaaaaaagtgagactctgtctcaaaaaaaaaaaaaataaaaataaaaagacaaaaccaggctcctgagtaatatacatgttggataaacatctttaagttctgtttaactgaatacatatgtgtcaaataattatgacagtcgttcatctcatgtcttgcatctacggtgggtttggtgaaaatactaaaattttttttcctcgtgaactcagcagatcaccatatgacatagatgaataacaaactttgtgcctagaaagattctagtagttgacttaaattcagtaatttaggagctgcaatcatgagaaagccgccattctgcatgttaggttcctcctgtaccttttcagctgtgtctgactgtggatggagcactgtggtttgaggggttaggaactctgcttagatggcaattagacagtcaggtacacacagtagtggctgtctgcattctgcctggaacagcctgagtttggagccattggggcccagaaggtacactggggactagagccccgggccacctgacctcttcagtgagagaatcttttcttttccccacaaagaaaaatctttttaaagcagcacaataaaagttagaagttagtttttgccaagttataaagttgtttcttgtgatacatgt

SEQ ID NO: 43374 - DNA, 1100 bp, Homo sapiens
aatgcctccaaaacatgtttcataatacctgtaaggtagagctcaaaagttagcagctattatgtatttttccaacatgtttgattgctgcttctgctcccctgttattgtttggtatacttcatttccagtgatggctggtcactgatgctgaggagccaggcagctagttttaacgtggttgtagctgcctctgttagttaaagctctatgaatgtcacttaagaagagtcctcaaatacggctgtatctttaagacagaacttaacgtggaaattcctgccaccttgtggctaaaataaatcaaaggttaatagtacacatattttagaaaatattaatacatgtgttcattttaggcttaagtcttgaattattaaaataaaaatttgacaagtttaaatttcatttcattagtttcattaaaaatggaagtatgtgtttagtgaatgcaccttttcttgttcctcagagcgagagaggctcacctatttccttccctcttccagagatgttgagataagccagtcaaggacagacattactcatgagaggatttgtcatgtgtgacaaagaaataaccccctagaaaatgtgtagacattgagttcttatactttcttttgtttggggttatcctgatgtttatttttgttagggaataggaatgtttattcatactttgaaacttcaatcattctgaggcaggagaattgcttgaacctgggaggtggaggttgcagtgagccaagattgcgccattgcactccagcctgggcaacaagagcaaaactccgtctcaaaaaaaaaaaaaagaaagaaactatcattgcagttcctttgtatcattgtgaagatctgtataaggtaaatatggttatgtttagaagtgtttgaagcaacttggccagtggctaaaggtaagaaaattcccatttaaactttaacaattatgtaaataaaagatttattttggaaaaagaaataaagcagtgagacaaagggattttttgccattcagggataaccactgttaaatttgccatagagttttgtagactttgtcccatgcattataactttcagaattacaaagatca

SEQ ID NO: 43375 - DNA, 1168 bp, Homo sapiens
gaaaagtaaaacgagctgcaagagtaggagctcagctaggttactataggcagtactcactcaggagggactatgaaagaaaagactgagaagaagatggaaatgtgtataaggtaaatggaactttatttgtaaaatcaataacactcacatggttcaaaatataaaagatttgaagatgcacatagtacaaatcttcctcccagtattattccctaactaccttatctcttgggagataaccatgtggaaaacaaatgctacatgtatgtattcctccttttacacaaatgataccataacatttgaatgttttgtgtatataaatatattttttatagttacatagtatttgattgtacagatatggcatgactttgattaatcgcagtttggatatttaggttgtttccagtctcttgcagttatgaacaatattgtagtgaatctgtttttgcatgtcgtgtgtatgtaagcatgtatccacatgataaattcccagaagtagaactgcactttaaattgtgttgtagagctggagctagtttaaatttccatcagcattgtgggggagtctttctccaattctccctaacacaggactttatcaaactttgccaatctagtatgtgaaagtgatatcttgtgtttttcacttctcccataagtgagactggaggcttttaatatgtttaaacacattctgtatttcttctgttggtatcctttgttcatgtaaaattttttggcaatttatataaggtctcggacattatagaaattgtggtatgagtcataaaacaaatttatttttctttctcttctttttttgactaattttgttctttagttgtatcatgtaagaagaccaggaaaattttaccttttataccctcagtagaactggggataaaagtgagggcagggagaaagcagaggctccatattgttttaatttttatttattttgaggctgggttatgagactggcagtctttttttttgtattttttttgtagacatggggtttcaccatgttgcccaggctggtcttgaactcgtgggctcaagcgatctgcccatctcagcctcccaaaatgctgggattacaggcatgagccgctgcacccggccatgttttactttacaaagatttatactgaatact

SEQ ID NO: 43376 - DNA, 1044 bp, Homo sapiens
agctgggactacaggtgcgtgccaccatgtccagctaatttttgtatatttagtagagatggggtttcaccatgttggcccggctggtctcaaactcctgacctcaagtgatccacccacctcggccacccaaagtgctgggattacaggcgtgagccaccgcgcccagccgtggatgaactttttttttttaaaaaggctgaacatttgagggtttcacgtcctaaatacataacgggggaattctagaaagacattttctatgaggctttactttgcatttataccccttcctccctcccctgtcgttggaatttaaacttacctaagcatagagaaatgtttcctttctggtttaagattttatttaggtatgggaacttgtgaaagtgttggaaatatagagtggaaagctttttgttttttttcgtggttttttttttggcctttaagactgtttaaaagaagtatttgtggctgacatagaatgattagcagtactgagaggggacaagaatctaggagacaaaaacaggtgcataagtagcttatgtgacaggtaacaggaacactgtcttatcttcctgtttaatgcagaattaagcaaaatgcggccggacactgtggctcacacttataatcccagcatttgggaaggctgaggcaggcagatcacttgagctcaggaattcgggactagcctggccaacatggcaaaactttgtctctactataatacaaaaagtagccaggcgtggtggcacatgcatgtaatcccagctactcaggaagctgaggcacaagaatggcttgagcctgggaggcggaggttgcagtgagccaagatcatgtcactgcactccagtaagactctgtctttaaaaaaaaaaaaaaaaaaaaagcaaaatgtgagaacttaccaagtgtaagttgtatttattctttgagagttcagtgggctggagtggcatgataccatttgataggccttgatataaaagagcatattcaaataatggcctgccttaagattgatgggattac

SEQ ID NO: 43377 - DNA, 1050 bp, Homo sapiens
gtggatatttctttattttgttttagaattatatatcaatatttaactggaaatgattatttggaacctgcaatacagattgttcttcattttgtaatatagccatttctcacaaatagatgtaaaagaacagttcctgagatgatcttgcccatgacagataagtagttcctgtttgtataaactgtgctgagctgtttgaaggatgttcccttcatctccatatccctagcgctaagggtgattctgtggagactttttgcctctcttgttgcaatgagtagtagtcaaggtgactcctttctagaaacccctccccaatgactgacattggctttggtgcttggaagggtgtgtgtgtgtgtgtgtgtgtgttggcaaggtgtttgttggggcaagtaagcattaaatatcccgctttgcattttattaatactttaatctcactgtgatttttgtaatgcttgttccacttctatatcttttgtataaattcctgacaaatacctgtttgcttatattattatggacttttaaagacacctagaactggctgggcgcagtgactcacgcctgtaatcccagcattttgggaggccgaggtgggcacatcacttgaggtcaggagttcgagaccagcctggccaacatggcaaaactctgtctctactaaaaatacaaaaaattagctgggcgtggtggcacacgcctgtaatcccagcttctcgggaggctgaggtggtagaatggcttgagcccaggaagtggaggttgcagtgagctgagatcacactgctgcacaccagcctgggtgacagagcaagactctgtcttaaaaaaaaaaaacaaaaaaaccaaaaaacctagaactagcttcctttgccctgtagaacaaaaaaatagtgtgactcctttttaaccttttattgttcatcacagatcctgagcagtgagttcaaaggtaagacatggccccttcccttatgaggtttatgggatagtgcagctctgtgttagagccacattgaaggagtaacccatttccagaga

SEQ ID NO: 43378 - DNA, 1047 bp, Homo sapiens
gctgtcctagttctttgcttgactcccccagactgtgtggcatgttgggggaccctatgcctgaagggggtggaatgaaagaaagatagcagatcaatagctgggactcccacctattgaattccatgtggcagttccaaaggtttgcatttaccaacacggatggatcaccaagatgacagattggggtggtgggggagggtagcaagataaggaatgtcatacttaagcaagttacttaaaatcgacctcagtttattcatatatgaaatggggataattgctacattctgaggcataaataagatggattatataaaatgtttaaaacagtatttgacactctagtgtgaaaatttaaaactcaacaaatattgctctttgggtatatatgtgaatatatgagcatatacacatacctttttaaaaattgagaaattcacataatataaaattgttgcgggaagtcagggaccctgaacggggggaccggctgaagccttggcagaagaacataaactgtgaagatttcatggacatttatcacggaacctgccgacatgtgatgtctcccccagacacctagctttaaaatttctctcttttgtactctgtccctttatttctcagaccggccgacacttagggaatatagaaaagaacctatgtgaaatatcgggggtgaatttcccccgatatcaaatcattttctttttatacttttacttatttatcatcatcatcatcgtcactattggagacagagtctcactctgtcacccagggtggagtgcagtggcgtcatcatagctcactgcatcctcctaactctgggttcaagcagtcctaccaccccagcctcccgagtagctgggagtacaggcactcaccaccacatctggctaattatttttatttttgtagagatggggtctttcctatgttgcccaggctggtctcaaactcttggcctcaattgatcccttgcttcaagtgataacttggcctcccaaagagctgggattatggatttgagccaccatgccc

SEQ ID NO: 43379 - DNA, 1652 bp, Homo sapiens
ttttttttttttggtagagctaggtttttctgtattgcccaggatggtctcaaactcctaggctccagcaaatctctaccctcccttacccctccacccctgcgttggcctctcaaagcactgggatttacagacatgagctaccacacccagccttgcttaagtattgagtttgttatgggcttctagaattttgatctttatacttacttgtctgaggtgtcactaatgggcaaggccatttttgttttaccataaggtgtatagcaattggataaaaattaatggtaggaggatagttattgagatggcagatgaggcactgattgtgatataagtgaatttgtatttagctgaacttttggtcatgattaaaatcctgacagatgtagtgcttgaatttgtttttagcaattttactgcttctgtctataaaatatgttaaacaatgagagaatatttctcttacgatacagttgaaatcctaggaaactttatcttggaaaaaaaaaaacctggtaagatcaaatttcattttactcaaactacagtgttttctgaaagatgcaggagttgctatcctgccaacctgttttgttgtattcagagataataacctgtgtagtgcccattacatagtgaagttttttgttttttgtttttttaaaacagcatctctgttgcccaggcaggagtacagtgctgcaaccacggctcactgcagcctcaacctcctgggctcaagtgatcctcccacctcggcctcctgaatagctgggaccacaggggtgtgtcaccacacctggctaatttattttttgtaaagatggggtcttcctatgttgcccaggctagtctcctgagcttgagtgattctcccgcctcagcctcccaaggtgctgggattacaggtgtgagccactgcaccaggtcacatagtggcattttaatgaacagtgcaaatgttacatctttgcccagtgattactgttaattttaaactttggactttgacgttaaaaattaagttttaaggccgggtgcattggctcaagcctgtaatcccagcactttgggaggccgaccgaggtgggtggatcatttgaagtctggagttcgagaccagccctgccaacatggcaaaaccccatctctactaaaaatacaaaaattagctgggcgtggtggtacgtgcctgtaattccagctactcaggagaccgaggcaggagaattgcttgaacctgggaggtggaggttgcagtgagatgaggtcatgccactgcactgcagcctgggtgacacagtgagactccatctaaaaaaaaaattaaaatttaacttaaaattttaaaatcagccatcactttaatgaacatataagcatatacaagtagagagtatataataaatcctcatgtacctgtcaaccagcttcaaaatttatcaactttctgtgcttgctggtatgaagagcttttgaagaatcattttccttacaaggtggtgactttttgagaaacgggtgtagcctattgagcactgactttagagtcacgtagtgtgggttcacatcctgactcttctcgtatttcctgtcccgctgggcatgtggcctttcctctttgaaactcaatttttgcatcttgaaaa

SEQ ID NO: 43380 - DNA, 1030 bp, Homo sapiens
attaaagatttatcatccaatttctttttcccatctgtgtagtcttgtaatttaaaaaaaaaaacagtactgaatatattgcatgtaatttcctgcttttttctcacttaaaccttaagccttttcacacattaaacattgggagttagtcgggtatggtggctcacccctgtaaatcccagcactttgggaggctgaggtgggcagatcaccaggtcacgagtttgagaccagcttggccaatatggtgaaaccccttctctactaaaaaatacaaaaattaggcgggtgtagtggcgtgtgcctgtaatcccacctactcaggaggctgaggcaggagaatcacttgaacctgggagatggaggttgcagtgagccgagatagtgccgctgcactccagcctgggcgacagagtgagactctgtctcaattaaaaaaaaaaaaaaaagggaataattctcacttttgttctgatttataacaacttaaatcgttgaattagtaggtctttttaaaaaacagctttattgaagtatgatggacataaacacatctttaaagtgcacgttttgataagttttaacatacatatacacatgtgaaaccattaagatttacctatgatgtgtgagtcaagagcctattccctttcatagctgagtagtggtttgttgtgtagatatactactatttacttgtttacctgttgaacatttgggctgtttccagtttttaactactacaggtaaaggtgctatgaacatttatgtgtaggtctctatgtggatgtttgcttttgtgaggacccacttgtaacccccagagatagtatgaagattattttaaactaaagacatttgagattcaacagatgcagaaagaagcctaatcagaaattccttactttaactaaaggcagaaacttctgggaatgaggctgctaaaaatctcctcccttggggaatgttcttggactggaaaaaaaaaaaaaaaaaaaaagatggagaagaccactcatctgcataaaca

SEQ ID NO: 43381 - DNA, 1047 bp, Homo sapiens
ttgcagtgagccaagatcgtgccactgcactctagcctgggtgacagagtaagaatctgtcttaaaaaaaaaaaaaaaaaaaagccaggcgcgatggttcacgcctgtaatcccagcactttgggaggccgagacgggcagatcacttgaggccaagggttcaagactaccctggctaacatggctaaaccctgtctctactaaaaatacaaaaaattagctggcgtagtggtgggtgcttgtgatcccagccactcaggaggctgaggcaggagaattgcttgaacccaggaggcggacgttgcactgagccgagatcatgccactgcactccagcctgggcaacagagcgagactctgtctcaaaaaaaaaaaaaaaaggcaacaataaatccaaggtgacaaaaacagctgtaaagtttttagctgtcttttcaaaaacgaaagttgtatgctgtacagttgtggtcttggcattcctgtgctgcctatacacaagctatgaagagggagaaaagggggtaaaggtggttgtgctgttacaggttttgtatttaattctagctggcatgtgagggatttcattcatgtgccagagtgggaggtcctggagtggggttgccctgctgtctgaatcttcccaccagctactcctaacgagctctggtggtttaccctaatctagcggcactctttgctttcctgtagctcagtggcttcatctgttttcttgtcttggtcagtcaagggacagatctacgcttgtttagttggtattttggcttcaaactgatttttttttttcttttcagaagcctcagttaaagaatgacttaaatatacttcttccccattataggtgatacaggctcgttgaataaaatttggaaagtaaagttcaaaaatatcttggcatattacctttcatacttctatgcaggtatacacacaaattgaattagatcagagtgaatttttaggctatttgatattaacaaaacttttatagaaattctatgttgctttatactttcccccactaatgga

SEQ ID NO: 43382 - DNA, 2082 bp, Homo sapiens
tcaatttaccaccagtgtaatcagcactcaagtgtcaaataaatgctaataggaccacagccttgagagtggggactctaaatactcagtggtgaaatacattaagataaagttcttcagtacctagagggatttctatgcagaatacattttgtcatttcatgtaggggatgcagcattcctattatgagatgacaagatagaaggaggcatgtgttggtgtaaggccagttaggtgttgaaggaggcatggcgtatggctagttagatgatagaaggaggcatgtgttggtataaggccagtttgagaccttagaggagacggctgcagttcaacatcagagctgagatggtgctagttcatggctcctgtctcaggcttgacactgacagttgacaacacggtgctctcctgggccttaggccattctgtcaccctccctgagctgtggagctgagctccttccctgtccttgcttctgcctcttcttagaagcctttttgaatttatcagagtgcctactatgtgccggaggagaatttgctgcacaagacaactttgatgtcttatccaagtcagcttctctgaactcgcaaaaaaacagattccttctagctctgattttcactaaatgtttctgaggtcttggttattctccacataaacctggagacatacttttcattaaaatataaggcagaggtatggggtttctgggtctgaacctcagaatagtcgaatggaagacagggtagggactttgagggcagcttcttactggctatgagactttggataaaagtgacaaccatacagagtccctttcccatctgtgaaaatgggattaacaaaaaaaagtcctttcagggtcaatgtgagaaccagcgaataagacaagtgcctcgccctgctgcactgtgaattaactttttttggaggcatttgtcctttggctgaaattcacatgctgtgtgctccagtactgtgaagtactttacttcctcaaccccatccttctcttagcttcaggactttttgcatacattttctttgccaagaatccatttgctcttttttttcccccccaacagtcttattttgttctggatcctttccatctttctttattctcaccaattatttagccctcaatttagacatcattcctaccacgcttggattagacatctctcctgtatttctcccatacttaacactatggtagcacttaacatgtaggcttgcattatctcatgtattttttttttcttcagaaaactaggtttattgctacacaatctgccagtaattccagctattttgggtgatttcattatttgacttagcattgtgtgtgtgtgtgtgtgtgtaagtacatatttcagaagtcagagtcttctctgttgcccagtgcagtggtgagatcatagctgactgctgcatcaaactcctaggctaaagtgatcctccctcctttgcctcccaaagtgctggggctataggtgtgcacccctccctgccccctacccccaagccagcactttatatttaattgtcttatgacttgtgtctgtttctcccaccagagctaaggtgggtagggctctgtcctcccatgttatcaaagacccagaacaatggctggtgtggacttgctggtcagtattcactcactgaaagtgtattggttgggaattttttcaactctgtaatgggttattgggttaaaaaaaaaaaaaaaaactcactggatttttttgtgtaggggtggggtagggggatgggtataagaaaataggatataaatttgttgtctcgggtcattgaggtttgtatttttgttattttcttctttttttgagatggagtctcgctctgttgcccaggctggagtgcagtgatgtgatctcagctcactgcaacctctgcctcccaggttcaagcagttctcctgcctcagcctcccgagtagctgggattacaggcacctgtcaccacgcccagctaattgttgtatttttagtaaagacagggttttaccatgttggccaggctggtcacgaactcctgacctcaagtga

SEQ ID NO: 43383 - DNA, 1062 bp, Homo sapiens
ttacaccttatacaaaaattaattcaagatggattaaagacttagatgttagacctaaaaccataaaaaccctagaagaaaacgtaggcaataccattcaggacataggcatgggcaaggacttcatgtctaaaacaccaaaagcaatggcaaccaaagccaaaattgacaaatgggatctaattaaactaaagagcttctgcacaacaaaagaaactaccatcagagtgaacaggcaacctacaaaatgggagaaaatttttgcaacctactcatctgacaaagggctaatatccagaatctacaatgaactcaaacaaatttacaagaaaaatacaaccccatcaaaaagtgggcaaaggatatgaacagacacttctcaaaagaagacatttatgcagccaaaaagcacatgaaaaaatgctcatcatcactggccatcagagaaatgcaaatcaaaaccacaatgagataccatctcataccagttaaaatggcaatcattaaaaagtcaggaagcaacaggtcctggagaggatgtggagaaataggaacactgttacactgttggtgggactgtaaactagttcaaccattgtggatgtcagtgtggcgattcctcagggatctagaactagaaataccatttgacccagccatcccattactgggtatatacccaaaggattataaatcatgctgctataaagacacatgcacacatatgtttattgtggcactattaacagtagcaaagacttggaaccaacccaaatgtccaacaatgacagactggattaagaaaatgtggcacatatacaccatggaatactatgcagccataaaaaatgatgagttcatgtcctttgtaggaacatggatgaaactggaaaccatcattctcagcaaactatcgcaaggacaaaaaaccaaccactgcatgttctcactcataggtgggaactgaacaatgagaacacatggacacaggaaggggaacatcacactctggggactgttgtggggtggggcggggggagggatagcatttggagatatacc

SEQ ID NO: 43384 - DNA, 1059 bp, Homo sapiens
attagattcaacagacataaaattcttgtcagtctgctataaaaatttgtaaatgcttaatctccacttataagtttgtcttgtcatgatatggtctctatcttcatctcactctttttcttcccacagtcacccaaaatgacggtatgttcctaaaatactttcccgtggaaggtgtaagttcccctcttcctggccaaatgctcaaatgttttactcccatcacctcctttgttttgcataagtatcactttctataaaaattatcatttaatgatggaaatgaacttaactgcctttaccatcagcagtctctttttatccatgataaaatttgcagagtagtttaacaggcataactcaagctgtttatttcttcttagctttatatacttacggataggaagtcatgcagtacaagtgtgcaaaagttctgcaaagtatatgttacttttgctgatcacatacaggtaaatccatcttagatgatctgatttctaatacaactcaactctaaaagtctaaaaatatctctgagctatgtattaagcaggtggttttggacttagactgcatttctttgtttgtttttgtttttgagacagagtcttgttctttcacccaggctggagcgcagtggtgcaatctcggctcactgcagcctctgcctcctgggttcaagtgattctcatgcctcagcctcccgagtagctgggacttcagggacacgccaccatgcctggctaattttcgtaattttagtagagatggggttttgccatgttggccaggctggtcttgaattcctgacctcaagacctcaggtgattcacctgtctcagccaaccaaattcctgggattacaggctttacaggtttcagccaccgtgcccggcctagactgcattttgcttcatgccaatccctagggcagcagtgactttttttttggagacgagtctcgttctgtaacccaggctggagtgcagtggtgcaatcttggctcactgcaacctttacctcctgggttcaagccattctcctgcctcagcctgtcaa

SEQ ID NO: 43385 - DNA, 1018 bp, Homo sapiens
ttgtatatattcacaaatacctttcctcagttttttattccaatctggtagacaaaggtggtgctcagtaagttaagtgttggttgaattgagggtgtatgatgcttttcaaagcttgactatcaacccagatagagatttctgtgttcatcttgctggattttttttcttgttttgtgtccactactcctagactctcacatgtgtccaggtatatatacaaagattgaaattgtttaattagcttactctggctaatggtaatgactgatatttcagatttctttttaaaagaaggcctatatttgatgtgtctatctttcactcatttttatgcctactctcatattcttagctcatttccttctctttagtactctgcctttgggttttagagtaacttaatatcacacatgtgggttgtgtcgattatgagcagagcaatatgcgaacctcttttttttttttccatttgattttttcaagactctgtcacccaggctggagtcaggtggcacgatcacgactcactgcagccttaaactcttcctgggctcaagcaatcctcctgccttggcctcctgagtagctaggactacaggcacataccgctgtgccccattaatttaaaaaaaaaaaaatttttttttttgttttacaaacagggtcttgctacattgcccaggctggtctcaaactcctgagcttaagcgatcctcctcccttgacctcccaaagtgttgggattacagtcgtgagtcaccgtgcctggccaagtacctctctagatggattctcttcttgttatattcttagagccaaccctagatatagaagggaattgtgctattcttatttttaaaaacaacaaagtaattgggaaatggaaaaacttgccaaggtcttgcagctaccattggctgaattaggatttaaactaggcagaacctccttttttagctgctactgtatctaaactgtatattcttctgtcatctcaaacgtggaaataaggatg

SEQ ID NO: 43386 - DNA, 1513 bp, Homo sapiens
gggccaaataagggaataaaagttggccacctgagccagcagtggcaacccgccagggtccccttccacactgtggaagctttgttcttttgctcttcacagtaaatcttgctgctgctcactctttgggtccacactacctttaagagctgtaacactcactgcaaaggtctgcggcttcactcctgaagtcagcaagaccacgaacccactggaaggaagaaactctggacacatctgaacatctgaaggaacaaactccagacacaccatctttaagaactgtaacactcaccgtgggagtccacggcttcattcttgaagtcagcgagaccgagaacccactggaagaaaccaattccggacacaatttgattagtattttgtttccctgaggcttccctttttgattctccaatcagaaaagcaaggaccttagataccttgcgtggttgtgcacttcctgtaactgtatacatgtccagggctaacgagaggcaaacagacggaaaagaagcaaacaggttcaatccatccccttggaactatagcttcttccctccatcagtgttttagatcagtgatccccaacctttttggcaccagggactggtttcgtagaagacaatttttctttctttttttttttttttaatcagaaaattttgatcatggcttttatttctttgcaacagtcgtccagaggttctgaagagaactcaccggttgtagagtctgtgttaatcacccagcattaatatttccattgctccatcatcatgtgtaagcctgtccacagcattcttctccagaagcaaacttgctcaacctttagtttcacatcagtgaaggcgaattctttcaccaagatggacttgtttgttctcaggaaatccatacagccctggttgaagagttcagaaactctttttatgcattaaaacaattttttcatggttggggaaggggagtggtttcgggatagaaactgttctacctcagatcatcaggcattggttagaatctcataaggagtatgcaacctagatccctcgcgtgcgcagttcacaatagggtacgcacttccatgagaatctaacgctgccattgctgatctgacaggaggcggggctcaggcatttaagcctgctcacctcctctcaccttctgctgtgcggcccggttcccctttcttgcttctccagcctaaactacaaggcttctcctaagatctgtctgtatccactaacaacttgaaagttttttgctgctgagtctaggctggggcatagcagagggaaaaaaagaagcaaatcacttcagtttctgtagtactatagagttcctagtctgtctgttatctttactttgagtcttcaaattattgtttgatactttctgtctagattttttaactgctttcagtgggagaaacaaggtgggtgtgcttattgaaatttgtctggatctagaacctggaactaaagtttaagttgtttctttgaatattgtt

SEQ ID NO: 43387 - DNA, 1101 bp, Homo sapiens
aaccctgcattcctatgataaactccactttattgtggtattttattctttttgcttggtttaatttgctaacatttttgttgaggacttactgtgtctctgctcatgaaggatattggtctgtagtttgatgttttttgtattgccattgattttgttatcagggtaacacagccttaaaatgtgttgggaaaacatgtttaccttttctggaagtgatttgctgaattggtgttatttctttaagtatttgatagaattcacctgtgaaaccacttgaataatttctctcagaagtttttttttttttttttttggagacagagttttgcttttgttgcccaggccggagtgcgatggcccaatcttggctcaccacaacctctgcctcctggttcaagtgattctcctgcctcggcctcccaggtagctgggattacagacatgcgccaccatgcccagctaatttttgcatttttagtagagatggggtttctccatgttagtcaggctggtctcgaactcccaacctgaggtgatccatttgcctcggcctcccaaagtgctgggattacaggcatgaaccaccacacccagccctttttttttttttcttatgctcaaattcaatatcttcagtaattatagtgttcttcaggttatttcatcttgggtcgtttgtagtgttcaaagaattggtcaatttcatccaagttgtttctttttttctttttttttttttttaataactacatcatcatggacaagttgcataaagctttgtagtattcgcttatcctttaatgtctgtggggtctctagtgatatctccactttttaattctgatactagtaatttttgtgttctctctcttaaaatcttcatcagccttgcagagctttatctgttttattgatttctaataacttcatgatgttgaagctgaatgagcttctctgtctccatgattttgagaggtgaaggtggctgggcttctgggtcaggtggggacttgaagaacttttctgtctagctaaaggattgtaaacacaccagtcagcactcagtttctagctaaaggtttgtaaacacaccaatca

SEQ ID NO: 43388 - DNA, 1102 bp, Homo sapiens
ttcacaggctgtggttttattttttgcatgtaaatgtctcattctaacaccaaaaattgaaaatattgttccttttccattgaattgccctcacacttttgttacaaatcaattgaccatatttgtgtgggtctgtttctggactcttttatcccattgatttatgtgtctgtccctttgctactacactttcttggttacggtatctttataagtcttaaaattgaatagtattattccttcaactttattgtttttcagaattgtggctattgtctttactttgcttttccacgtgtattttggaaccagcaagtctatacacaaaaattctgctgggatgtttattgggattgcaataagttaacaacaaaaaaacccttttggaataattatcaactttactaagttgtctttttatgactggcttatttcacttagtatgctgttcaaccatgttgtagcacaggggtccctaacccccaggcctcagactggtaccatctgtggcctgttaggaactgggctgtaccacaggaggtgagtggcaagtgagcgagcattactgcctaagcttcacctcctgacagatcagtgacagcattagattctcataggaatgcataccctattgtgaactgcacacgttgagggatctaggttgctcactccttaggagaatctaatgcctgatgatctgaggtggaacagtttcatcctgaagccatcccccccatccccactctctgtccgtggaaaaattgtcttccatgaaaccagtccctggtgcgaaaatagttggggaccgctgtcgtagtatgtgtcagaattttcttttgaaagttaagtgtagtattcctctgtctgtgtattctaccttttgtttattcttctgtccatgggcatatggattgcttctaccttttggctattgtgatcaatgccaccgtgaatgtaggtgaataaatatctctttgagactctgctttcaattcttttgggtatgtacctagaagtgggattgctggatgttatagcagttcttcttttcctctccttgaataaaccagtgaaaaagatgttatagcaattatgtttttaa

SEQ ID NO: 43389 - DNA, 1072 bp, Homo sapiens
tcgagaccagcctggccaacatggagaaaccccatcttaactaaaaatacagaaattagccgggtgtggtggcacaggcttgtaatcccagctactcaggaggttgagtcaggggaacctcttgaacccgggaggcggaggttgcagtgagccaagatcgcaccactgcactccagcctgggtgacaaagcaagactctgtctcaaaaaaaaaaaaaaaaaaaaaaaaaaaaaaaaaaaggccagagtcttaaggaaaggatttctcagtttctcctaatgttatttccttgaaactactctccagtcaaaagaatcaaaactcctaataagtactcaaaaaatgcccaaagctgggggtaccttccctgaagtgaagcataagaccttatgtaaaggaagacattaggtaaatgaagtggtcctagaggaaagggcaaggaaggttgtcattttgggggctgatgaggaaggtgaaacaatatttccctgtgtttactgtgtggggaaacagcctatgcaccaggttctccatgctggtggggcccccacatcactcatgactggaatgactgttttccgagcaaagatttgaatacgtgatctgacaggtacttatggggaatacatacttaaaaatcacagtcttgctagaaaattcagaacgtttcttggttttacttcaacacttgcatatttgatttttttcctggacttaattgatctgggaagatgagtattaagtgaggctctggtcaaagaagggaaaccaagtattccttatttagaagaaacaagtaggcctggtatggtggctcaggcctgtaatcccagcactttgggaggctgaggcaggcaaatcacttgaggccaggagtttgagaccagcctggccaacatggcaaaacccaatctctactataaatacaaaaattagccaggcatggtagcgcatgcctgtaatcttagctactcaggaggctgaggcacaaaaattgcttgagcctaggatgcagaggttgcagtgagctgaaattgtgccactgtactcctgggcggcaggcgagactcta

SEQ ID NO: 43390 - DNA, 1054 bp, Homo sapiens
cggtgggttataagattaaactttttacatgttcctgttttagattaacatttatttagggaattcagtagcttgtgggataggtcctcaagtgttgtaatagcaagattactagttcaatccccttattttaagatgagccatattaaatatgatttaaaatgtaatttaatatgattttttttgttcaggagctacatctggtatgatgtagctttctatgaaacagccaaatggtagaaaccaagtttaagtaaattattagagtactagcatatctgctatgggcagagtttccttttaattcattcataatctcttcaaatttagagaatttagcttttagtttattgcattttcccttattctgggtatttgccgtatctaacttttcttaatttttgtatttcactttactctcctcattgtcctttgaggtagtgtcaagttagtggattatctctgttttcaaatgggcaaatatgggcacgcaagataaagttaattaagcaagagcacatactgaatcgtaagatgcttggaactagactttggaattcttcacctttgactccctttaaaaatttaatgattatttacatattgatcaacaaaaacaattttattgagagttcgttaggaataagatgggctgctgctgttaggtgtttctttccttaaaggcttgagggaacactatttcctttttgagaagggtcactttgtatgtttttgtttgtttgtttgtttgttttttgagatggagtttcgctctcattgcccaggctggagtggaatggtgcaatcttggctgactgcaacctccgcctcccaggttcaaatgattctcctgcctcagcctcactagtagttgggattacaggcatccgccaaccacgcctggctaattttttgtatttttagtagagatgggattttaccacgttggttaggctagtctcaaactcctgacctcaggcgatccaccagccttggtctcccaaagtgctgggattacaggcgtgagccactgcacccagcctgtatatatttt

SEQ ID NO: 43391 - DNA, 1044 bp, Homo sapiens
gtctacatgagctgctctattggctcttaaaaattaattttaattttgatttttttgtagataggcagggccggtgtggggggtctcattttgttgcccagggttgtctggaactcctggtttcaggcagttctcccaaagtgctgggtttacaggcatgagctaccctgccgggcctatcattgactctttcttttgtgattaaacatgcttttaataaataatgattgaattttcatagtaactaatatttctagcagagtgggcagtttttaaattgtttatttttattttttgagatggagtcttgctttgtcgcccaggctagagtgcagtggtgcgatctcggctcactgcaatgtccgcctcctggttcaggcgattctcctgcctcagcctcccgagtagctgagattacaggtgcctgccactacgcccagctaatttttgtatttttagtagagacggggtttcaccatcttggccaagctggtcttgaactcctgacctaatgattcccccgacctcagcctcccaaagtgctgggattacaggcttgagccactgcgcctggcctttaaatttttaatctattagcctgagaactaaaatttaccgtatttcccctctggtggggaacccttaaactgtgttgaaaaaaaaatttttttgtttgagatggagtctcactctgtcgcctaggctggagtgcagtggtgcagtcttggctaactgcaacctccgtctcccgggttcaagcaattctgctgcctcagcctcctgagtagctgggattgcaggcgcataccaccatgcccagctaatttttatgtttttagtagagacgaggtttcaccatgttgatcaggctggtctcgaacttctgacctcgtgatctgcctgcctcggcctcccaaagtgctgggattacaggcttaagccactgtgcctggcctgaatttttaaaattaatgcaaatgcttaaataattcaatattttggggtttttgttttttttttccattctcaaaaatgtgtggcagt

SEQ ID NO: 43392 - DNA, 1370 bp, Homo sapiens
aaacagggatttgccaaagttggtttattttggagatgatttcaagaagaagtgagggaaggggaagaatgaattggggagtgaggaaaagccaatgatagatactttattgagtttcctatagggaaacgggacctccaagaaattcacggaatgcctcccaggtttatctatctgaaaaattggagcttcctgcccgcaccctcatacacctatatttatgcaagttcttcttaaggattttgtctgtccagtgtttctgggctgctcctgtactctagagactttggagaaagccctgagataaagaagcagccttgtgtaaggtgtgtgcttttgggtggaaagaagcgagacaactgaaatgtgtgtgggattgattgtccaccacagcgatgagtcaggtgatgtgataaggagcacaaaaccatctgctgcagaagggaaagaataaagtatttatcctgtctttactatacttagtatgcttcagagcatccaaatatttgatgagggacacttgttctttatggaataactctggctaaaaaacacagaaggcatgatagaatgagaaaatcatggttttcaaccttgaatgaaatagtgggtttaggcagtgatcactagtagctgccaacatcatagaaagatatcagaggtaacaactcccatggaagtacagaacactccctatggaatattgcctctctcaaatatgaaacaagagaaaccaagttgagcctttggatctaactacaactttatagggaacagaggaatgtattaaacactattacaggagtgtcactagcaaactccaggtagtgagaaactcaaagacaaatgacagcattttaggtttttggttttttatccaaataagttgcaagaaaaagggtaacatttaggttataagactagagtcataagcaaatgccacatatggatcttatctgaatactgatttgaacataccagttgttaagaaagatattttttaatcaggaaaatttgagtactgactagatagtattaagttttgctcattaaattttttccccccaaccatttctggcaattttggccccaccccccttttttttttttttttttttgagacagaattttgctcttactgcccaggctggagtgcaatggcacggtctcagcttgctgcagcctctgagttcaagcgattctcctgcctcagcctcccaattagctgggattacaggcctgtgccaccatgcctggctaatttttgtattttcagtacagatgggttttcacgatgttggccaggctggtctcaaactcctgacctcaggtgatctgcctgccttggcctctgaaaatgctgggattac

SEQ ID NO: 43393 - DNA, 1029 bp, Homo sapiens
gcagtgaggcttttatttaaatagtaactgttcaactgcgtgtgtttctgtggttgtaatactggtggtgactttttagtttaaaggcacatatacaggctgggcgcagtggctcatgcctgtaatcctagcagtttggtaggccgaggcaagtggattgcttgagcccaggaccagtctgggcaacgtggtgaaaccacagcttatgaaaaatacaaaaattagctgggtgcggtagcgcatgcctgtagtcccagctacttgaggggctgaggcaggaggatctcatgaacctcggaggttgaggctgcaatgggcagagatcatgccgtttgcactccagtctgagcaacagagcaagaccctctctccaccaaaaaaaaaaaaaaattaaaaaatgaagcacatttacttagttaaaatctcagtatgaagactataaaaatctttggttatttagggatcaaggattagtttgtgccctgttttttttgtttgtttgtttttttcctgtttgacattctacattaagatgtgcgtgcccttctagtagtcacattaagaagtaaaacaaaggcccagtgtgatgatgtgtgcctgtatcaattgtctttcgaacagtgttaggttttcctaacttgcacatgtcctaaggaagtataaaaactttgactatgtttcttcaaggaacatttaatcttctaaaagaaagacatagcagtgtgtaaatgcaagcaaacaatagtagtaagagagtacgtagaaaaacattcagtcttttttggactcttctagtgcatactcatggcgtcagtcaagttttcatccatgcacgtctggctgtcagactctgttctacatagatggagataacgtgtgcaaatgtaaaagataaaatatacctctgttttagttaacgggactaaaacatagctgttaccatggagatctgggagctggggataatggaaaaaaccatgtttagattctcacttagaactgtgatgtaaagagactttgttcccttgc

SEQ ID NO: 43394 - DNA, 1050 bp, Homo sapiens
ttttttgtatttttagtaggtggggtttcaccgtgttagccaggatggtcttgagatctcctgacttcatgatctgcccacctcggcgtcccaaagtgctgggattacaggcgtgagccaccgtgcccggccaaacatgtcactttttattttattttttattttgaggcaaggtctctgtccccagcccggagtgcaatggtggtatcatagctcattgcagcctcaaactcctgggcttaagggattcttttgcctcagccttcgagtagctagggcttacaggtacatgtcactgtgcccagctagttttaaaaatttttgttgagatgaggtctcacttcgttgcccaggctggtctttagctcctggactgaagtgattctacttcagcctcccaaaatgttaggattacaggtgtcagccaccatgcctggcctataaacatgtaactttttaaattgaaattgaaaaatatgtaacatttttaacaactataatggtggaaagtagaatcgttaaattttttttagcatctcagtcttatgagtttattaagtagattttacattattgctactggaaatctgtcatcttttctgagaaagtaatttaactggaagtgtgacatagttactgaagttttaaaggaccacaactagggttattataactaaatttatttaactaaatttttaaagattattttatcagcctaacaaccattataagcgtgtggggtccttgaaatgacttcccagtagaaaggaattaaaaaattttttaaaaatagagtcggtctcactgtgttgcccaggctggtcaaagggaacttcttgaaacatcatatgcattggatcttttgtcagttagtgtacttatttgtctcatttaccttagatggtgactgaggttggatatttgccttgaaatgatctatgttgatgtgaccttgagtcttctttataaaatttgtatgtggcccagtgtagtggcttggtggttcatgcctgtaattccagcactttgggaatgccaaggggggcagat

SEQ ID NO: 43395 - DNA, 1059 bp, Homo sapiens
agcctccgcttctgggttcaagcgattctcctgcctcagcctcccgagtagctgggactacaggcatgcaccaccacacctgactagtttttgtatttttagtagagaccaggtttcaccatgttggccaggctgttctcaaacccctgacctcaagtgatccgcccacctcagcctcccaaagtactgggattagaggtatgagccactgcgtctggccctaaaacactcttataaaagagaactgtttttcatttttgtaagtttctttggcctaagaggcaactggaaactggtaactactactgcattcagtttgtcgtcatgtattgttttgattgaagtatatgaggaaaatccagccacatatggatatgtgtttagaaaaggaaggagtataaataattacagatattctttggtgctacatcaaaatatgacaagtggtagttaaaaaaaaattcctttttaaatttaaattgagacaggatctcactatgttgtgcagactggtcttgatctcctgggcttcaagtgatccttgtgccttggcctccccaaagtgttgggattacaggcgtgagccactgcacccagctacaagtggtagcttttttgcggaggtgcgggggtgggggcttactggtaaagaccggaaaaccacctgctggacaaattctaaaagagctgtaacaccaagtggtagtttttttaaagtctagtttcaatgtggaatctgaaatcatatcagtgaattttttttgtacttgttacaaaaagaatccattgattgtcttatactcggaaaggatctttatccacgaggattgggaggctgtcaaagctcattggtaatagatagaagtttttcaaaatactagtttttacttaaaagctcaaatttagtcatttggcaacagatacttcaggaaaatcgttttacctgaagtgacagactcattttattcctttttgagaaaatatctgccagatactcaagtttttaagtaactacattttgcttctagttcttcaggtagaaacggtgcttgactggtt

SEQ ID NO: 43396 - DNA, 1020 bp, Homo sapiens
aggcctcagtaggaacctttgcttagccctgtgatcttgtgcaaactgattaaactctgagatttctgtttttaaaatctgtaaatgagggtaataagacctatggcagagggttgttgggaattaaatgataatgtctgtaaaggacttcttggattatctggtactaaagtgatattgtctcactaataagtttgtgtgtttaccatgtggtagtggaaaatgggggatgggtgtgcctattcccgtatgaccccgtggtttatggtttatgtttcatatatacggagacataggagtgtttcacatttctttgtaaaatatgggttatgcactgtgaataagttaagaattggtgctttatatctaggtgcatggatcttagaatccctaaaatgtgtttagttatggaattatcttaggagagatcatacgtaaaggaaataatagaccaggagatgaattcctaattccaaagaggtagaaacagtataaaaatgaacgaaggatgagaagtggcagttcagaagggcacagctgaaaagtcagtctgtgtacaaaaagatatccaatctaggctgggcacggtggttcatgcctgtaatcccagcacttggatgaatcgcttgagctcaggagtttgagaccaggctgggcaacatggcgaaaccccgtccctgcaaaaaataacaaaaattagccaggcatggtggtgcgtgcctgtagtcccagctaactggggggctgaggcagggggatggcttgagcccaggtttgcaccactgcattccaagctgggcgatagagtgagatcctatttcaaagaacaacaacagcaaaacaaacaaaaaaaacacccttgtctaactagttattagggaagtgccaacgataatgacattttctgcctatgaggttggagaaaaatgaataagattggccgtatctggtgttggcaaggttgtggaggcatggccactcatatagctaaagagtaaattggcaaagacttcttggcac

SEQ ID NO: 43397 - DNA, 1377 bp, Homo sapiens
taaatgcatgctgtagcttgaggatgaggaatttgaggtcttgggaagttagaatggacatgatgcttcataggatcctgttggacaatgtgtgtaaaggatgaatacaacgtcacccagtagtcattccaatggaagccgttgtatttttctccttgagattcagatggggaagctggatggatgtaaatagatttgatggtgataacagaaacatggaagatctttgttctcttttgggatgtggactcaagtaataatctgcaggtggtgtgtttttaatttacaatgagcatgtattaccttttttgttcagatacaacatagatacaacagattgtataaatattaaacaggttgataatttttacatatgtgcacattcagattaattcaaaatacataaaatgtggaaaatgtttttcaatcctcactctctctagtagttcccagggcttgcttacactcgttgctgaatatattttctagaagctctatgcatgtgtccacagacatctttgaatatagtaatgaaatcatactgtttataatttgtgcttttactaaataatgtatcctgaagaatcttcaatgtaggtacaaatagttctcttttgtaaccaacagatgcattgttcagcataggtgtgcaataatttagccatccttttcatagtaactttattcaagtgtacctacgtgtatgccatcagacttcttgttgagaagtttaaaaaaaatttttttttttttgaaacagggtcttggtctcgcccaggctggagtgcagtggcgcgatctctgctcactgaaacctccacctgccgggttcaagggattctcatgcttcagcctcctgagcagctgggattacaggtgtgtgccaccacacccggctaatttttgtattttttggtagagacggagttttgccatgttggccaggctggtctctgaactcctgacctcaagtgatcctcctgccttagcctcccaaagtgctgggagtactgagtgagtcatcgcactcagcccctggttgagaatttttataacgtaaattcttaaactgggaattgttatgtcaaaagatgtggacatttaaatttgaaagctctctgaaaaacctaaaactaaatttcttctttgtttttgtttttgttttttgagacagagtcttgctctgtcgactgggctggagtgcagtggcgcgattttggctcactgcaacctccgcctcccggtttcaagggattctcctgcctcagcctcccgagtagctgcgactatgggcgcgtgccactacgcccagctaatttttgtatttttagtagagacggggttcaccatattggttggccaggatggtctcgatct

SEQ ID NO: 43398 - DNA, 2483 bp, Homo sapiens
gggctaaaaggaccagggaatctttgctgatgtaactggccgtccttgtaacctttctccaaatgataccttattgttcagaagaagctggagtttttttttcctggcagagttgactgatcttaccctaagtgaaaatggaagctgctagtcttcttaaaggctgggctcagaattggcacattacttctgtcacattctattgattaaggcaagtcatcaggctagctcagattcaggggagatatggaaatagactccatctttagttggtagagtggcatgcatgtaccgagagaggaattgatggtggctatctttgtatgtcatcttccacaaattgaaggaagggtggagtagtggtttcaaaatgcttgcaacagaaaatacctgaaaattgcatttagcacagttgtaatattccggcaggagatgatatgttactagctttggaggtaatgagtagtggctattctctgtatagctgtaaggaacagccaacaggatttgctgatggattagctgaggagtatcagaaaagtgaagaattgcaagattttttggccagagcaactgggtggaagatggtgccatttaccaaaatggagaatattgggagaggagcagattcttgggtagaaaataggaactttggttttgatatggtgtttctaatacttactagaaatttaagtgaagaaggttagtaggcagatatatcaatttggagctcagggggagatgggacatagaagtgacatttggagacttcattagcttgtggcatttgaaaccatggaattggacatgatcatcaagggactgagcctatggctgtaggatgaaggaaagaccagcaaaggagggtgaggaaggacagtaaagtagaagaaagcaagcagggcaaactgtttctgggagataaatgaagaaagcctgtggagaaggagggtgtaatcagctgtgtagaataccaccgagagtgatgtagatggatgaataagtgagtgagggtggtgttaaatctcggcctggctctgctgtaaatagaaggagaacgatttacaaattttggagcaacctgggatgtaacctttctttcagaattcatttattcaatttttgttcactttcttagttttttatttatttatttatttgagatagaatcttgctctgttgacaggctggagtacagtggtgcgatcttggctcactgcagcctccgcctcccgggttcaagaggtcctcctgccacagcctcccaagtagctgggactacaggtgcgcaccaccatgcccagttgatttttgtagtttttagtagaggcagggtttcaccatgttggccagaatggtcttgaacccctgacctcaggtgatccacctgtctcggcctcccaaagtgttgggattacaggcgtgagccactgtgcctggcattttcttagtttctagaaatatctgagtacttatgtatatgttagagatggaagaatctcctcagtagatcctctgactcaatggacaaggcttgtctgtgacaaatgacgattgatctactctttttttttttttgagatggagtttcactcttgtcacccaggctggagtgcagtggcgatcttggctcacttgcaacctctgcctcctgagttcaagtgattctcctgcttcagcctcttgaatagctgggattacaggcacccgccaccatgcctggctgatttttttttgtatatttagtagagacagggtttcaccatgttagccaggttggtcttgaactcataacttcaggtaatctgcccacctcagcctcccaaagtgctgggactaccgctcctggccagttgatctactcttgcacttttttaacatttctggtgagtgtgagctcactttcgtttttgttttttttttttttttttgaggcagggtctcgcacggttgcccaggctggagtgcagtgatcacaggtgtagactacaggcacctacaggcacatgcctcctcgtctggctaattttttttttaatttttagtagagacgatgtcttgctgtgttacttaggttagtcttgaactccttggctcaagcggtcctcccactttggcctcccaaagtgctgggattacagacgtgaactactgtgcctggccttcactttcttacaaattcattctgctttcttattaacataacattgggaaaattgtctgaacctatcttaggttccaaaagagtgtagaccaagtccagttcttcttcttttttcgagtcagaatctcactttgttgcccaggctgaagtgcaatggtatgatctcagctcactgcaacctcctcctctcaggttcaagtgattctcctgcctcagcctcccgagtaactgagattacaggcgcacaccaccacacccagctaatttttgtatttttagtagagatggggtttcaccatgttggccaggctggtctcga

SEQ ID NO: 43399 - DNA, 1545 bp, Homo sapiens
tcaatgctgcctccgacttcaaagtcttaggacagcaaaagctgtttttaatgtagaacgtttaaacacaggtacgaatagcagtggtactccttccttatcagtgtatggcttaggtgaatcttgcgattcgggaaagtttctcacacatgcagagacttgaggttctgaatgttaggaaactttcttggctggttaaataattataaactaggttatctttcaagtgctcagtttaagatcagcgtgggattgcctaagtggttgtagctaaaaagattttttttcctaatttcatattttctcaaaacaaattcagagatcttgaaagatttcttactttggttttaataagagtttaaaaaaattagatgcatgttgataagtggcttctactgtatggctgtccacagtaactctgaggaagatgttacggaaacatgacatgtgccaggagccagtggaaatcgagaatcttggcttctgtttctggctttccttttgatttgtgtgatcagttacattctcttttcaggccagatgccattatgataaactacaaggggtatatagtattttgttctgaggttttgccattgtgctcaaaataaataggttatcagctaaggcttaaaaatatcttttggaattacagagatctggggtttttcctgtaaggagcttgacttaaattttttttctgtagctctgttgtttttgcctgtgtacctctttcatgcagttagcaagggggaaatgatctttgccacgctttgaaactattatgagcgacacaagtttagttaatgtgtggttataggattgggattttgtattaaagtgaagctgtcaaactaccttcatgtatttgaagtgactccattataattgtttttagcagcagcatccaggcagcaacttttctagcaataactaatttttggaaggtgtgagttatccattcagtaactctggtggttggtttggtctgggaggaaggagaggcggaaagacgagatggttagctgtgctattcttagctgagtttcctttatcaactgttgcctctgattcaagcttccagagtcataagacaggaggtggcagtgtggtagcaatgaccaaggggtaggattggtattcttagttaagatctcagccccataaatctgatgttacaaattggcttggattgccagaattttgcttgaaggctgatggcaagcatacatagttttgagtgttccattaaaattaagggtgtaatgtatcatggtctgaaattgctgtttggcaagtattcagtattggtaaataaacacagttctaaatattgacatattctgtgaattttgttgccctgaaggggactactttgtagtacataaactatagatattttagagaattatcctgagaccatataacttgattaggaaatagtttaaagttattgtagaaatatccttgggccaggcgaggtggctcacacctgtaatcccagcactttgggaggccgaggtgggtggatcacgaggtcaggag

SEQ ID NO: 43400 - DNA, 1034 bp, Homo sapiens
ctggttagatattggtgagagagtgtgtgctggagagcaggagggtttgctatgcatttctctggtgctgtgcagaaatagatggctacaaaacatctcatctgtatgcctgtgtagatttcagctctcttcccaggcaaagcattttcacaaatcttgtttttaaggatgagttggtttggatttttcttgttctcatacttaaatttcattaagataattgaaagggatttgagtgacctgatagatttagttctagttgggaattttggtaggggtcacatgattttcatataaattgagcttggtttaacaagaattgaaaatcgagggagaagtcatattcccgtaaaaagaagcttaaagccatagcctgaattggttaggaaaaaaacataagcccattttacaaattctaattgttattatgtttggtcagtatgtcttaattttgttaaaatgttgaataaataagcaaatggttgtgcctcaaggactggcattttaacatttgagagagtttctaaatttaaaaatgaaatgttttggatttttacaattcatcgagctacatgtaaatacagattactgtgccttcccctgctgcttttcttttgctaaccgatgggaatttctccccaggtgtaggggattaatttaaaaacattacctgttaacaactgcctgttttattcttaaaggcttttgcttagtccaaaagcatatatatacttagttacttgttactttataataaacaggagttcctctttaggaaagcacataaggtaagatgtcaccagtgacagcaagtatttatcaatgtatcttcagtttattaacaatgtagatttaaattttcaagttcatttttcaagttcatttttaacaatgtaaattgaattttcaagttcattaaaatgctcaggattttaaatgatacagtactatcttactaacaaagtaaacagggatgagaacattggaggttgtttttactgatagaacaatcatgttccttgcttgtgttgaaa

SEQ ID NO: 43401 - DNA, 1057 bp, Homo sapiens
atgaggatagaggagtaatttaaagagctaaagtgtaagggcagtgtgacagaagggatctaggctgaaaataatcgtgacaaccctaacaaaggttaaaaatcacttttagtaatctgtgtaatgagggaagaaaaatggcagtttaattatcattaaagtgttggtgcttaagttgccttaaaaattcatttatggtggggtgcggtggctcacgcctgtaatcccaactctttgagaggccaaggcaggcggatcacgaggtcaggaaatcgagaccattctggctaacacgatgaaaccccgtctctactaaaaatacaaaaaattagccgggtgtggtagcatgcgcctgtggtcccaactacttgggaggctgaggcaggagaatggcttgaacctgggaggcggaagttgcagtaagccgagatcatgccactgcactccagcctaggcaacacagcaagactctgtctccaaataaaaaaagaaaattcattgatatggaacactgggatccctgataatgtcagataagttaaccattctatttgacattcacaagaatatcaagtgcaaacatgtcacaataggctgggcgtggtggctcacgcctgtaatcccagcactttgggaggccgaggcaggcagatcgcccgggctctggagttcaagaccagcctgaccaacatggagaaaccccgtctctactaaaaatacagaattagctgggcatggtggctgatgcctgtaatcccagctactcgggaggctgaggcaggagaattgcttgaacccgggaggtggaggttgcagtgagctgagatcacgccattgcactccagcctgggtaacaagagtgaaactctgtcccaaaaaaaaaaaaaaaagaaaaagaaaaaaaaagtcacaatggaaaatgttcttttttaaaaacttaaaagggatatggatttatattctttttttgagatggagtctcactctgtcgccaggcccaggctggagtgcagtggcgcaatctcagctcattgcaacctctgccttccgggttcaa

SEQ ID NO: 43402 - DNA, 1033 bp, Homo sapiens
caactagggatgctgagacagaaagttattttgagcataactactcaaaatagaaataaaagcttagatatttctggacctccactttttctgtttactattaagatctaaatgtggccgggcactgtggctcacacctgtaatcccagcactctgggaggctgaggtgagtggatcacctgaggtcaggagttcaagaccagccttgccaacatggtgaaaccccatctctaataaaaatacaaaaaaaattagctgggcatggtggtggacacctttaattccagctacttgggaggctgaggcaggagaatctcttaagcctgggaagcataggttgcaatgagctgagatgatgccattgcactccagcctgggcaacaagagcaaaactccatctcaaagatataagtgttttcaactggcgggtaagaaaaactgctgctgttggttctctaacttcttacaacggtggttcccacttaatcttatttaggtcctggagccctaaaaaaaaaatctgaaaaacctgcagtctgtcttcccagaaacacttgtgtgaaacgttctggtgtttttgtgttgagacagggtctcactctgtcacccaggctggagtgcagtggtgggatcacagctcactgcagcctcgactgccagactcaagcaattctcccacttcagcctctcaagtagctgggactacaggcgcacgccttcatgcctggctaatttttgtacttttttgtagagaagaggctttgccatgttgccctggctggtctcaaactcctgggctcaaacaaattgacctccctcagcctcgaaaagtgttgggattacaggtgtgagccaccacgtccagcagagtatttggcttttaaattataatcttgtgcatagaataagatctataagaatatacaccaggggccgggctcacgcctataatcccagcactttgggaggctgaggcaggtggatcacgaggtcagaagatcgagaccatcctggctaacatggtgaaaccccg

SEQ ID NO: 43403 - DNA, 1067 bp, Homo sapiens
taattgggcggaaaagtccttagctgatttggagtcccaccaccatggataacagaaacgcaatagtgaaccaatgcaaagttcactgtcaaatgccccaggtgtactgaggtgggataaaaagttttaagacaggctgggtgcagtggctcacacctgtaataccaacactttgggaagccgaggtgggtagataacttgaggtcaggagttttagaccagcctgggcaacatggtgaaaccctgcctctactacaaatacaaaaattagctgggcggggtggcgggcacctgtagtcccagctacctgggaggcttaggcaggagaatcgcttgaacccaggaggcggaggttgcagtgaaccaagagatggcgccagtgcactccaccctgggtgacagagagactctttctttttaaaaaaaaaaaaaaaaaaaaaaaatttaaaacagcctgaccagttagcttacgtccttgtcatttcttgggtggagggatagattttatgtctttgaatagtctacttgcaaaggggcatgagacagaaaaatcagttaaaaggctgtccttttcttggggttagcaaccatactgttttctgttacagcaagggtctagcccggtgcttgattacttactactcagttattaaatttattatgtgcagaatagcactggctagaatttgagcttagaaatagaaaggagcatgtttttgccttagggcctttgcatttgccaccttcaacctagaacgtttttctcctgtctcatttcatttgtcacctgagaacattgttattcacatatccattattcccttactcttaatttttttatgttgtcactgtctgatttaaaaaaaatagagactcctgaagagtttcttgtttgtttttgtttttgttttgagatggagtctcgctctgttgcccagcctgcagtgcagtggcacgatcttggctcactgcaacctccacctcccgggttcaagcagttctcctgcctcagcctcccgagtagctgggatcacaggcacctggctaattttttgtatttttagtag

SEQ ID NO: 43404 - DNA, 1064 bp, Homo sapiens
tgggaggagggtgaagagtatggtttaaaaagcatttagagaaatttagtaaattctctttgttagaaactagagttttgaacaattttaaagactataaaattgttttttttttttttttttaaataaactagttacttgcactttacctgctggcttttccatttggtagataacattctgaactccagcagagttttataatccccacgtgcttaaatatactaaatgttctttttccattaaggttaatgttcgtgaagaaattgaagagttttttccaagaatgtggaagataaatcaagataaaagaaggctaatgaaaagtattaaagatcagaaaattaaaattgaatgggggaaaaaattgaacagaagattggtcagatagaagcacttgaatatttttttaaggctattttgaattgtttgaattggggaagaatacacgaagtatgaaaaatgaaaaactcaatgaagaatgaagagaagtagaaagcaagagtgaagtagaattaaaagaatctggaagaatgaatgggtcctaggttaagtaaatgtatggtttatgttccagtgtctgtatgatcaagttgtagatgaatttgcatgattacttagttaatagagaattggtgatctggttcaagtagggaattattgaggacagttagcagtattaacagtgggttattattgagctgaaattttttctggagggtgttgtctaaccatttgtttttcaggagcaatcaatataaataattacggtactttaaatgttaggtgttaggcatctacatgaccagtgccatttgtaatactgtcttctttgttaggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtaagtgtgtttaagataatacttaaaatattcttctggggtttttgaggacaaagcagttgttggctgcattttgtgtagaaatttcacg

SEQ ID NO: 43405 - DNA, 1028 bp, Homo sapiens
ctttatataaaggacttcttatagcctgattcctaatgcagagttcagtgaaagtgacatttatttggtaacagcttttgagaaatgttactttatttctaaataattatatacttggcagtttattcttccagttaagtttactaatagttactgatttgttaatataagtttgtaagttgtttttgaaagttaaaatgaagctgggtgtggtggctcacacctgtaatcccagcgctttgggaggccaaggcgggcagatcaaggagtcaggagatggagaccagcctggccaacatagggaaaccctatctctactaaaaacacaaaaattagctgggtgtgatggcgtgcacctgtaagctgagctactcaggaggctaaggcaggagaatcgcttgaatccgggaggcggaggttgcagtgagctgagatcaggtgccactgtactccagcctgagctacagagcaagactccatctcaaaaaaaaaaaaaatagttaaaatcatagtgacaactttgtagctaggagttagagacagctaagaggactgtttttagcttagatgtttccatgaagaaatttgtgcagactgagatttcctctgagataaaaagaaagaagggcagacaacaaaggaggttaggtatttgtgacacctttgataataaaaagcaaagcttcttttaaaataaatctgatgttggccgggcgcggtggctcacacctgtaatcccagcactttgggaggctgaggcgggcagatcactagaggtcaggagtttgagaccagcctggccaacatgggaaaaccccatctctattaaaaatacaaaaattagccaggcaaggtggtgcatgcctgtaatcccagctgctcaggaggctgaggcaggagaatcacttgaacccaggaggtggaggttgcagtgagcctagatcgcaccattacactccagcctgggtgacagaatgagactcctccttcttaaaataaataagctaacatctcttaaaaagacattc

SEQ ID NO: 43406 - DNA, 1511 bp, Homo sapiens
ctctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggagccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggttagtcaacgaccgcaccgacccttaagcgttcttaagacgagagctgtgaggggaaactacgcaaggagcccttttcccttaatgtcccttcgactttcctttcacttcgaaatgaatgtggaaatgctgtcacgccttatttttctaattcctcgatgttgggttttttctcttctttatatctcaacttttaatgctcttcttcctatgacctttcatctaaaaactgaccactcctttacaggtttttacggtaaaaaaaaaaaaatctgtctttctttaatcttacatagctgaacgaattcattggctcagtatttttaagataactagtcagtatatactgttctgtaacttaaaagatgacctgaaaattaacaggccctctcccatttctcttctcactctatcccccaccgaagagggctcagaaaaaagtttttattaatatatttggggtcggagaaatacaaacatcacaaagaatacgatatccccagcttaaatgtactggaacgtttgtcagtgagtttcatttccaaagtttaccctacatagggaattgtagaagtgagttagtagaagtgagttcgtgtgaaaccctggaaagaaaacaaaagccccatgcaacacgttccgggctgttgtgtagatgtttattctagtcactaggggaagcacataaaaacacctgaggtgtgtgtgctgaagggcgaattttgtccttttggggagttcatgatataaacatctagaaccaaaa

SEQ ID NO: 43407 - DNA, 1052 bp, Homo sapiens
ttgcagtggaagaagtgtaggtgaagtatgggtgttggggcagtgagtggatggaaagaagcctttcagactgccggtgggtttgaatcccctgtgaagggcagccgggagcccaggagagccttgggtcaggacaatggaaaaggccaagtgtgaggttcctagtggactcttaatgtctccttaccaaatggtgatgatagagactatttttaaaatcattatttttatttgttattatttttatattttcttagagataaggtgttgctctgtcacccaggctggcgtgcagtggcatgatcattgctcacttgtaaccttatactcctgggttcaggtgatcctctcacctcagcctctagggtagctggtgttgcccaggttggtcttgaacttctgacctcaagggatcctcctgcctcagcctcctaaattgctgggattacaaatgtgagccaccacacagagactatttttagggtggtttttgtttggattacaaaagagaatagtagaaacctggagatgtgagaaggctgacagttcagatatgagatcagacatttatcattttaaaaagggcatgtccactgaccttatcaggaagtcagagataaggaattatatgatgaggaattgaatgactgggtagaggtcagagagagaatcataaatatgggaagggaataatttgactggagatggtaataagggccaggggattgttttccaagactggtgggtgggtagacaagatgcccccagacaggcctaggtggccaaggaaggctgtcctctcgcggtgcatccagaataggggctgctgttctctctctgtttagttgtcttctttgtctagtccctttcagtcttcaccctggaaaagtacacatttaaaatggtctattgatccacctggatagtggttaaacaggcgctaactttattcattagtcctttctgtgcacctttctatacgtattgggattgaaaaccaatgaaagagaaaagcttctagtggagccctggtcactggtccactgtgtgcc

SEQ ID NO: 43408 - DNA, 1025 bp, Homo sapiens
aaatacaaaaattagtcgggcatggttgcacatggctgtagtcccagctactcgggaggctgaggcaggagaatcgattgaacctgggaagcagaggttgcagtgagccaagatcatgccactacactccagcctggatgacagagcgagcctccatctcaaaaaaaaaaaaaaaaaaaaagtaacaaaattatttctggacatctaattcccagaattcccggtcccaacactctgggacgctgaatgcatgtgggaatgaggatggggaaagcagggaggttaggaaggaaagagacttgagaatgtgacgctggtttcaagagtctgcaagaaattgtttcttctttcacaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaat

SEQ ID NO: 43409 - DNA, 1112 bp, Homo sapiens
agtctcttttaaatgagtatattttcacttagtctctgcctaatccacatcagtgtatgatcctggacagtttgtatgtgttctttttttagttggccgagtcagtggaatcagccttatttcacagatgaggtgacagaggctgaagggactgaaaagctgtgaaggtcatacagccagcagatgatgttgcagtcagggcccaggtccatggaacaacaaaaacctttccctcgttcccggacactagtgcagcacatggcagatgctccagaaataggaggaaatatacaaaataataagctatcaatgtaaatctccccagaaagctttgtaaaactcttaaaagcaatgtgggccaaataaaccattcccaaaggcctgtgtaagccataaagaaataagcaaagttactgatatttgaaggttgagacttattcagaaaatgtgttgaacccatctaaacataatctgctaaacattcattcattatctaacacaatagtttaaaaaaatcaaggttgggtttttatgagatgtgtgtatactgtaggggttctcttgtaattcatatggatgtatatttatccctgttttatggggtttaaaattattacagaagaggcgtatggtttttatatactgtgtttacattcggccatacctgtaaagatgccaaattcttcatcaaagctatagtgctcctctcccacattgctacattgtttttgtgggatgaatataatctacttcataataatccactttaaaatatgtttacattatgggggagaggaacatttcatagctttccttccatttcatagtgggtcatgccagctggggtggagaagtggggagtggggattgtcttgagctgattaatggttattattattatagatagtgtctcactatgttgcccaggctggtcttgaactcctggatcctgggctcaagggatccttctgcctcagcctcccaagtagctggaattacagggctatgccactgcaccttgattttgttttatatgatcccatggtttcaaagctagctccgttgttttcatcgaaagacagctagtgaagaaaaggagaagaatgtagcat

SEQ ID NO: 43410 - DNA, 1026 bp, Homo sapiens
tctgcttatcttacacctattgcaatcttgtcagctgtacattttgaaccaaatattgtatattctgccagtttttaaaatttatgtaggactcttctcatttggtggaaagccttgtttttctgtaggtcacctggaagccagaggaattgatttggaaagtggcggctagctgagtgccacatttattttatttggagcaataaacaagacagtgagaggtagctccccaggggacccactgagatggccatgggcatcctgtgtgtgtggcaggcaggggaggggcatagtgcctatctaataggacataggatgcagtccgtaactgtgtggcttgctgctctcctcccaaggctgttctcctacagctccatagattctggccaacccctcattcctagaatttctaccctgtgtgcagttatttacaagcattttcctggcaaaagagtaaagcatcatctagagctgctgccaacatttcaagagactgcagtcaccatcactttcatcctcatgtgtctccttcatcggtatcactatgatattgcagtaacatttgttatttattacataccacgcattgtgttatgtgctttacctgcattccctctctcattcaatcctcatgacaaccatttaaagtaaaagttattattatccccatttacaaatgtggaaaccagggttcaggcacatcatttactcatccaaggtcatggagttaataggtgatggagtggggaagaatccagggctgatggtggagccccagctgttgattactctgttgtcctgcccattattttgctcaattaaattgtttaaagcaaggagctaagtgtgtttcataggcgtcgttagaaaattttagttccatttgacccccatcttctgttggcagaggcagcaccattgtgtgtgtttgtgtgtgtgtgtgtgtgtgtgtgtgtgtgtgtgtgcgtgtgtgtgtgtacaaattgttgtgactttgttaagatgtttcaggtccatcactaaatg

SEQ ID NO: 43411 - DNA, 1029 bp, Homo sapiens
tagaacattaactctccaatcttgggtccacccattaattggttctgtgaccttaaactctccaaacctcagttttttcatcaataaaattggaataataatagttcttttctcatagcattgtggtaaggatgaaaaataagcacttattccagggtcagactcaggataggtgctgagtaaatataaatgtatgtttttatcattataattaacattaatttgaccttcaagtcttatttgtgaaagtcctgaatgcccatagtgaatagttctagctttttttctcccaggaacttttacagtatcatacgtgtatccactcatacctttttagtgttgtacaaaagcccactaaaatatacactgtatatgtgaatatatacttttaaaataaaaaatgccttactctacacattaataaaatgcttttgtgacgaatacaatagaatgtttaataattgggctacatttgacatctttaggcataacctatacctaaaacaagtgaaaaaagttgatgaattcttaccccatcctgctaagccttgcccttgcttgggtggtaaatgattttcccctctcgccctctatgccagcatctatctcttggtagtagctgcacagagcattgtgttaagaaggactttgcagctgagtctgcattcaggggaaagattgccgtgtttttagctgtgacttctgggcataaggcagggagagcacagcatggacattgtgtttgtcaccccttagtgatagagaagagttaaaatcaagagctctctgttgcaatctttatattgtgttattggatgaacttcaggcaagtgtaggttgtctcagttctccattcataaaatggaggaaaactcaactcctgctttttcctgtggaatgcggtaagagaaaattgagtgttttcagtggctaaaagacattgacagtctttggagaaaagtcctctgtaaatttaagaaactggtataattacggatgagctgcttttactttggccagttctggaag

SEQ ID NO: 43412 - DNA, 1025 bp, Homo sapiens
catctgatacatgacccactagggtattttgtttcttgttatttgagagtgttcagttagcacttatagagcattacccattgttagctggctgtttacatttctgaaaagatgataagttgatttttgtaggaaatagggaagttttaaaacttcatgctcacatttcatagtaactcaattgatagtctttttagataagtaatgaaatgctgcctgtggttgccaattgttaaaactctaccaagcttccgcaagcagttgtcggttaagggagcgtaataacacccactgataaaattcaaaccaccagatgttattttaagttcttgggtggtgctatcttttcttaccctttaaactgctaagtcacatcctgctttgcatttcaatttggtataaattggatgcagcagacataggtctggcataagatgctcaaacaaaattaaataccaaaattaaagaaggcagttctgtggagtaaatctgtcatttctggatgcaagattatgttagagcagtggctcaacccttgctgtgtatccaaatcacctgggagtgtctcaggatgcccttgccctggcctcatccccagtgtctggaccagttagtatgaaatggcaccaggctttgggattttgtagaagcttcccagggtgatcctgtcacgcagccggggttgagaaatgttgcaggaggtgcccctcccgacccagctcacagctttgtcctccatgcttctctctacctagtcaagccctatccacatcttcacggctccctgcaggccacctcttcctaagctttttctcacaactccagccccactgagctcttcccttgtgactgcccatagcacctaccagatggcccaccctggggtgtgttctggcttgtttcatttgtgacatcttatctccttgatcacagtggtttcctccttggattaagtttctgtcacttagtttccatcactgaagggttagcacagcagtggacacatagtagttactttataggat

SEQ ID NO: 43413 - DNA, 1082 bp, Homo sapiens
cgtattttggtcttaatttgcttaacttttcttctactgttgggcattgaggttgtatacactttttcctattataaacattgagtccaaaggtatcaatattttatagaattttgttagtgatagccaagtaggtttcccagatattttaacttatttatccacaatatgtgtcaaaattgccagtgctgcttctcattaggtgttgatatttgaaattgtttttctagatttcataagtgagaaatagactggatcaggtaagagagggttgattggagtgatgcaagggggcagctctcagagcccctggcaggcagcaggaagcactgctgtgacacaggagggcctcccactcagcagacagagccccatgaagatctctcttctccccacccggccgcccgcctgccccactgcagctccgcatcttcctggtctcctttgggtttctatttgcctgcccctgtctcattgcatgtgcgtgctgtctgtctgcctgtctctgtgcctcacactctgtatttctctgggactcctgtctgtcaatctctcttatcttttagtctctccctccctctctctgccctgccgtcccatactcatccctgcttgcccagctcatggttaaaaatagctgccctggcagtcctacccatctactgagttcagtggtcttcagagtctgcctaggtccctgtgtgtctaacttcgaaatacttccacgttctgaggaagggaatctggttggctcagctaggtcagcacagtggctaccctttgttggggttactccagtggacagggagacatgaggcacagacctggatgctgattcaccctgagagtggaagaggctggttctaggagcaggttgctgaggagcagagacgctcttctagctctgactccccagtcctgaggagctccactctgtagagagaggtcaacaggcatgcttgggctcctctgtgggcctagtgatggccctttctagatagataacctattgtgattgatggaaactatcttctaggattagatttgctgttctgaactgaggaagattcgcttaattggtt

SEQ ID NO: 43414 - DNA, 1049 bp, Homo sapiens
aaactagagaatgctcttgcagagaaggatttattcctcaggagttaaacttgaaaggaaagccatctttgtagaattcctttgagacattttagtgcgtcttgcctcaaacaggcctgtccactggctgcttaaaaggaagacagattttattattaaataagaaccagcaaggaaagatggggaaactgtattgggtctttgagtattccggctggaattgggatatttcttcttttcttgaaaagacatctggccacatgtattataggcagacatcaccccccagtgttccaaaaactcagacaacaataacaaagtcagatgtgcatgcccgtgtcagcccagaaggctaaccacccaccctctacatgtgcttctggggttgatgttgaaggggctgagggaggtttgttatcacagcggtaggcctgtaaacagtctaccaggataatttctgtttcagctgctggctttttaaatccaactctgtgctaacatacatggtgtttaaaacacctaattctgtggtcatgtcatttagaaatctttagtaacgttttttgaatgttaattgtatgtatagttccactggctcttacaaagagcagaacgacatataaaaatgatgaattgctatgccttctcccttgtcttcttagtgtataaacacacaaaaaagaaatgaaaaagggtaacagctatatatagttgactcttattctatctaaagaagggaagacaagcagaccacctgagccgggacaaatgtgactgctaggcagaaccgtgagcagctataggtctaagtatctcaagaataagggaaacttgttgggcatctaacagccttctgattactgtcagatcagtgagctgctcatacaggcctcaggacagctgattaagttggagataatcagtgtcacccaaacacttaaaaatggaattggctgtctcagaaagtatgggtagcgagtagcccatcagagtatcagcagccattaaactcaaccttgtacaaagtgggcaggcattgaggaaatgtt

SEQ ID NO: 43415 - DNA, 1056 bp, Homo sapiens
acataggcatatacatttgctccaaactcatcagtctgtacacttaaaaggggtgctgtattctcttactgctatacagaaataccctgagactgggtaatttataaagacaagaggtggccgggcacggtggctgatgcctgtaatcctagcactttgggaggccaaggtgggcagatcacgaggtcaggagatcgagaccatcctggctaacacggtgaaaccccgtctctactaaaaagacaaaaaagtagccgggtgtggtggcgggcgcctatagtcccagctactcgggaggctgaggcaggagaatggcgtgaacctgggaggcggagtttgcagtgagctgagatcgtgctgctgcactccagcctgggtgacagagcgagactccatctcaaaaaaaaaaaaaaacaaaaaggaaggtttaattggctcaccattctcaggctgtacaggacacatggttcgggaggcctcaggaaacttacaatcatggcagaaggcgaagggggagcagacacatctttcatggcctgagcaggaggaaggtagagaggaggaggtgctacacacttttgaacaacaagatctcacaatactcactatcatgagaacagcaccaaaggggaaatttatctccatgatccaatcacctcccaccaggccctacctccaacactggagattaaaatttgagcagggacacagacccaaaccgtatcaggtgcattttattggatataaattatacctcaagaagcattttttttctttacaaaaagagatagggtagtgagaagctaaggtgtggaacagcaaagcacagttggtataaagtgtaaaatatttttatcatgccattgaattttctgtagtcctattttctctctcaaaatggtaaaccttctgttattatgcccttaccacttgtctcagaacacagacataactacaagcaagtgtatcacggtgaaaaaaactgaacaatccacccatacacattttcatcagcaagcttcttctgtgcctgaggatattttgccaacttaagca

SEQ ID NO: 43416 - DNA, 1138 bp, Homo sapiens
caacgtggatggatatttgttcctggagccttaattgcattactaatgtttattctggtaaagaaaggcagtgtggcaaaatgacatgttttcttaggagcttttgtgctggcactccatgctgttatgaatactttttatgacctggcttatgaatctaatcatttataatagcatttctgtggggaaaacaatggattgcaaattccaagctgttgacttataaacatatttttgaagcatgaagtattgataaattggagactgttgaaatagtccataaggcctgggcttagtttggggcccatgaaagcagagcctgaagcaaggagttgggtgcaaataatttatttgggaggtgatcttaggaagcagcgctgagggagcggggagagaggcagggaaggagaaagtcaataataacagagtgtgttatagttagagcatttacacagccatccctgtacccctctgcttgaggttgtgcactgggccatttgtacttccgcctttctgggtcactcttgccttcaggctgagttgatgccacccagcttcaaagaaggctctggggacaaaagagacacttatgctgtctttagtgggagctgtcagcttgaggccaccctactctgaactccccgccatggcaatggctgaaatcagaggtgggtggagggaatatgacaaggggacatcaagaggatctgctgccaacatccaaaatggattgattatatacagttcagctaacctatttcattgaatcaaagactgtcaattgtaagatcccccattaatttatgtaccactaagaaagaaaatgtcccactgaggaaggaaaatatgctgccaggtaaactatgatggctgttaaatgtgagacacacccaatgtcagagatattaaaatatgagaaagagtgtgttccagacttggtggaacacagtatgtgatgaatactgtgaagctatgctgtaggtctgtatgtcatattatggaaagatgtcaggaatacattgttaaatgaaaatggcaggttatacagtgtgtaaaatgtggttctgttaacgtgaataagcaaattgataaattctaggtgaatttacgctcaactactaatatgaattctccccag

SEQ ID NO: 43417 - DNA, 1030 bp, Homo sapiens
ccatttattaaatggagctccagttgtgccttgatctaagtgacttggagttctattttcattcatttgttcagcgtttactgggcacctactgtaccaggatctgaaataggtagtggatacaaatctgcagcttctgtttagagtaagcttccttccctgtctgaactgtttgatcactgatacaatctgactgcttcctaatgtgcctaattctttttctgatgatctatttagttttcatactgagagtaataatgaatgttcaattaataaacttttatttaagatgattattcaagtctgattacaattcagcagatacgtaatacttttttttttaacacaatactttaataagacacatttaaactcaacttctgagcagcctttctggcagggataggaaattagaacctgctggtataattttttttgaaagaaaccccagggaagagttgcttggttaggaaagatggggcttactccttggcagagctgacaaatgatggcatattgagaattgaactatagatgggttgccagaataattaaagtgatgaagcaaaactacttaagtgaaggctttaatcttttaagatagtattattagcaaaagcccagagtatgtatttatttaccttttagagacggggtctcactctgtcgtccaggctggagcacagtggtgtgatcatggctcactgcaaccttgaaatcctaggctcaagtgaccctcctatcctagtctctcaagtaggtgggactacaagcatgcaccaccatgcctggctaatttttagatttttttgtagagacagtgtcttgctgtgttgcccaggctggtcttgaactcctgggctccagggatcctaccacctctgccccctaaagtgctgagattacaggcattggccatcccagagttattttaaatgagattggggaggggaagcggggttgatagggaattgggtagggaaatattttaaatctgggaaccttgatggtactcttgtttatagattca

SEQ ID NO: 43418 - DNA, 1033 bp, Homo sapiens
ggaagcgagatctgtgggtcttgctgtagctagttaactcaggctgaggtttagcaagtcatggacctcccacatccttttaacagtactgtttctcctctctctcagatgacttgtgtgagacttagccaggtgtcaatggatgtgaagggggtttggaggaaacaagggcaagacaacattctggctggacagggagccagctggaggggtggggccacatgaatgggacacacccttgagggaagtggttctaaacctcagcagtgtcagagtgtcctggagggactggtaaaacacttgagttgagtccgtcgcagtggctaatgcctgtaatcccaacactttgggaggctgaggtgggaggattgcttgaggttaggagttcaaaaccagcctggttagaatactgagactcagtctccacaaaaacaaacaaattaattatttaataaaacagattgctgggccccacccccacagtttctgatttagtgggtttctgatttaatgggacctgagattctacaattctaataagttattaggagatactgactctggttcatggaccccttagcaaatccaagcattggttcagcaggcagaagaccaagtcttaaccagcctggagtccattctgattccgagaagaaccagagaattctggttatcattagattgtcataacccccttattttatataacacttccacatttgtaaatcactttaatatatgtttcttctcacaacaaaataaccctgtgaggtaggcaggggatttattaaccttgttggacgactaaggaaaataagattgaagacagatgactgacttaccctaggggcaaaaatagttgagctcatacttatatctagattttcttactgtagatttattgctccttctacattgtcttttttccttggaaaatactacattttattcaaatgattttgagacaaaacaaaattagggagatgtagaatcctttcgctcatgcattaacagtaaatattttttgaagaca

SEQ ID NO: 43419 - DNA, 1053 bp, Homo sapiens
tttaagctatgtgaacatttaaaaattcttttataataataaatggaatagcagtgtgaagaattgcttctttagttattaatctaaatgattttgttttgaagttggtgatatatttccttcatcttggaaaaatacagaagactcactggtaatttccttgttcttagccacattgtttgtacccctgaaattgaattttctctggacttggtttataactgcctctacctaagtctgttgtttgagagccagaatatggttgtttctagatgctccaagaccccttgagtatgagtggaatatgattcttagggaataataataatattgtgtgggtttaaagccaagaagcaaatttctttcataaaagtttctttagatgaaaattatgttgctgtctatatgtctgtgtttacttatgaaaaaaatatctgaggtaatcagcccagttctctgagtgggtgtgggctggatgaacaatcttagtggaattttcatctgtgatttctgagattgtgtgagagtagatctgagttaaaaaaatagcttaaatgtaaagcagagcagaatcaaattgcaatgagcaatccagtgtgggattggcagaggatctctgacagttactataactaaagtttgctattttgtttaccctctacagttaaaatactaaaatctttatttttagtattgtgtgggtcagatactttcctcaatgtaacatttctccaaatatgtattaaaatgtagtacttgtaaagattcccacactggtttcctgtcttgatatcaaatattgtaatagttacaagaactttaaaattatagtttacatcttataaaacaaatatttctccctccccaagtaatttgtggtggacagtcatctgaaatgtttagaagctaaagctaatatatatattttaatctacatatatgtatatatatgtgtgtgtatatttatgtatgtatatattttttaatctcagcaactcttattaaatttgaagtagatgcctccctagaattaaagcatgcgctaagattttt

SEQ ID NO: 43420 - DNA, 1029 bp, Homo sapiens
taatttgaaagagcctttaaaatatgaacattctggcctaaaacccttcccatctccatcaactcagtggtcaataatgctcaaattttcggaaatttgagcaaaatgtataaaacatactcgtttactaaacttacttttgttatacacaagcaactctttaacatctagaaagactagatgttgtaaattaggtattgtttatcctttatatacacagataagtacaataaaatgcatagaagtaaggaacagtggttaatcttgcctcactgtggacatcagcatagagctctttgcacttccttttcctgtctcctcccctgaaacagtgcacaaacacaatgtgtactactcaaggggtggtttggccattctcccccaaacatttcttatggaattttaacaaaaagacatttacaaaatgtatcattttacaacctctacttttacttttaacaaatgtatcaggcactgaatacctacaaagcctagatatttcaaaaaagtacttagcattgtcaatgatatatacagtagtgaggaataaaatgcacacaacaatagttatactgagagacaggactagctggatttcctaggtcgactaaaaatccccaagcttagctgggaaggtgaccccttccacctttaaacatggggcttgcaacttagctcacacccgaccaatcagatagtaaagagagctcactaaaatgctaattaggcgaaaacaggaggtaaagaaatagctaatcatctgttgcatgacagcacagcgggagggacaatgatcgggatagaaacccaggcattcgagccagcaacagctaccctctttgggtcccctccctgtgtatgggagatctgttttcactctatttcactctattaaatcttgcaactgcactcttctggtccatgtttgttaaggctcgctcgagctgagctttcacttgccgtccaccactgctgtttgccgccgtcgcagacccgccgctgacttccatccctccggatccagcaggg

SEQ ID NO: 43421 - DNA, 1051 bp, Homo sapiens
aacttgaccaattcccttgaagcgggtgggttaaaccctgtaaatgggaacaaaatccccccaaatctcttcatcttaccctggtggactcctgactgtagaattttttggtttaaagaagaaaaaaataaagctttggacttttcaaggttgcttaacaggtactgaaagactggcctcacttaaactgagccaggagagctgcagatttattaatgggtgtgttagtgtgcagtgccttgcaggaatttaaactctctacccttaaagaaggaaatgtatttgtacaaaagccacagataatggtccttttactcaagcgacctgctggataaatgacagcctgcagggattgagtttggagatctagtctcaattctgcttccgatttagatgcagttcacttttgttttttaaagtaagttttattaatggaaaggaagaactttttccaagaaagcattttgaaagccactgggggagggggacatttatgcttttgggctgtggagatcctttaggtggagagactgctctctcatccctagtggaatggaggtttgggttggtgagtttctatcaatagcctgctctctatagtgggtcagtgactggcaccaaattgtagtcctgttccatggacattgccctgttttggttttatgagcttttggccaggcacaggacgcagggtggtagggaaaaaaggaaatggttcctgtgcccgtggtgctgacaggtaagggaagggccttctgatgtattttatgggatgcttcagaaacctgggggttgcttgtgtctctgggaagcccttggtaaagaaagccaccattttttttacttaggtatattccagtggtttatcatcgggagagggatgataatggaggaaggctcaatgagggagaaagtattcagctgcttgatgttagagcttaatggcaggacctaccagttgcttttcacagaaatgctgtgtattgatcctaaggcagcatgtgttctcttttgtgtggccattatccattctcccacttttccatcagtg

SEQ ID NO: 43422 - DNA, 1049 bp, Homo sapiens
tgacccctccaggagggtggagaagcttgtctggcaacagcctacacaaacggcaattctgaagagcaacaaacaaaccagtttagccccaattcccattttgcataagaatgcgccccacaaaaacaacacccgaagaacattagttgatcaccactggttgatcgttaccagttgcaaacactaaagtttgagccaagacagaattttaaaagtcccctggaaggaactttgggtaaagtggttttgtggaaactggtgttaaagtgtcattagactgaactcaaacgttccatggggagcaccagatgtttcaagcaacagatcttggtaaacttggtttcagaaagaagttaagccagagaagggtttggacccataaaccaaagggaacttgttagtcactaagtgactgccaaggtacctgttttcgttatgctaataagaggttacacaaattccaggaaggaggattgctaggtgcaggggatggttaggtcacagggggaccgcctgccggctggcctctgaatagaccctgaccatggctccttaatccagggaagcagcaaaaacgaacagcaattgggctgaaaacagggcgaaggtccttgcgttaggccgggagagtcgttcttaaaaacatgcatcctcccagaggtcacggcctccttcacatcgtccaggtcgggcacgggtcccagagaacgacaccccagtgtacatgaggtactgagcgaagacagtgggcattgcttctcccctccccatccccgaactactcttgccagccatcacacacaaggaaaggtattctctataaccaaacggatgatttcgtccacttcttccttaaacacctaaaaaccacagcgacagcactagtagcccttcattcggaatcagagcagcagcatctgcgaacctgcaaagaccaggggctaagggtgccaggacacagcgagagtggcccctgctcagatccgacacaagcctcgggggctcccggcggcgtagacgccgcacttcgctcgcttcccgctctgcac

SEQ ID NO: 43423 - DNA, 1117 bp, Homo sapiens
atacaatcagaccctgcccccttcacatcttacattctatttttgttttttttgtagagatggggtcttgctatgttgcccaggctagtcaaacaattcttcctccttggcctcccaaaacactgggattataggtgtgggtcatcactcctggccagatctcacattctaaagagagagggaaccaaaaatacaagtgaactaatgaaataactgcaagttatggtaagtgaaagagctagctagctatgtgaaaaaaggagacaaaggaattcaaggcatagataatatccgaatggtatactcatttgcctcttaccatagtttatttaactggcttcttttttttttttttcttttcagaaggagttttgatcttgttgcccaggctggagtgcaatggcgcgatctcagctcaccgcaacctccacctgcagggttccagcgattctcctgcctcagcctcccgagtagctgggattacaggtgcctgccaccacacccagataatttttgtatttttagtagaaacgaggtttcaccatgttgaacaagttggtctcgaactcctgacttcaggtgatccacctgccagcctcccaaagtactgggattacaggcatgaaccaccacgcccagcctaactggcttcttaatggtgcatagttgtttctaatcttttcttgtaacagatattaaaatctcctcatccatacttctttgcacacgtgtgcaagtaggatacattcctggaatttatgctgggtcaatggatatgtgtgttttttatttgatggattctactgaaaagcccttcaaaaaagtttgtgccaattataattcctaccaacaatggataaaagtgccaatctgatagatgaaaactggtgatcatggcttactgcagcctcaaactcttgggctcaagtgatcctctcacctctcagcttccccagtagctgggactacagaaacatgccaccatgcctggctaatgtttactttttgtagagataagggtcttgctgttttgcccaggctggtttcaaaacttctaggctcaagtgatcctctccactcagccttccaaaaggactgagtcatgcaggccaagagc

SEQ ID NO: 43424 - DNA, 1031 bp, Homo sapiens
ttacatttactccaatttgtttttttaaaaccaatttatcgatgcttcatctcactcctggcctttatgctttagcctctttctagttgaaagaactcttcagagttctttttagagaggacctgagcagtaaacccagtttttgttacatggaattattttgagacagtcttgtcctgtcgcccaggctggagagcactggtgagatctcagctcactgcaatctccgcctcctgggttcaagtgattgattcttgtgtgtcagcctcccgaatagctgggactacaggcatgtgtcactgcgcctggccaatttttatatttttagtagagctggcgttttgccatgttggccaggcttgtcttgaactactgaccacaggtgatccacctgccttggcctcacaaagagttgggattacaggcatgagacaccatgcccggcctacatggaattattttgccttcatgcttaaatgatgagttaactggtaaaaatataaggtttaatgttttccctcagtactctgtcttatggcatttattactactggtaagtttgctctcagtgttatttataatgaaacttttctatctcaggtaatttaaaaaatgtttcttcttagttcttgacgttctgtttcaatctggtatgtctaggacttaatttgttttcgttaggagctctgtgtagtcctttaatctgaggacttttctggaaatattttgccataaactcattttaaatattgcttatctttcatattttatagtttcttctgggactcctattagaagtaacttagatttttctcttctatcattgtctcaattttgctttcatattttgcatcttctctggtatattctagataattttcttagatctttcttccaacttacccttttccttagctgttcacatcacttccactgaattttcaatgaaaatgacttttttcatatctagaatttcatttgggctcttttctagatctttttcttttttcatgatagtctgttcttgcctt

SEQ ID NO: 43425 - DNA, 1050 bp, Homo sapiens
tgccatcactgatactgcctggaagaggaatatctcccaatgagatgccctgaaaaacgaaggagaaacacttcaaacatgaatagccctatttctgaagcagttctattacctaacaactttctttcccctcttttgtcaattcctctacatttaatagagatagatgctgttggcagtaacttcctagttaaatacaggcaatacaatacgagatgtgagtccaaatcagaatacctggaattctgagtaacctagaaattaagatggattagtataaaagctgactggattttcttaaaaagtctaatgttacaatcttgtaatttgctactttataataagatgcaactcatcctagcggttggtaatcacattgtggagggtcagggataataaactacagtgaagtagtctggaggagagaggctgtttaaatgcctctaagcgctaaaactacaaggctattgtgaatattgctgcaataaacatgggggtgcaggtgtccctttgatacactgatttcctttcctttggataaatacctgataattcttttagttttttgagaaatctccacgctgttttccatgactagtctaaatttgattatacctttgggattatttggaaagaggaatgctatacatatttggttaattctaagctgaagtgcttctgtaaaaataagcattactttaaactgctgtgtcatccaagtaaaggagttgtatttgttcaccaaaaggtcagtgcagatatgttcctgcgaggataaaagccaaagttccaattacctccagtgaattttcaggctgtgatgaaagcaactggaataagtcttccagagagaaagaagtatctgtcccattcagatgtctctgtagagaaacacaaaaagtgcatctttcacataaaagactgaactggttggggctttaggctttatctttaaaggatcaccaggtattatttccacactggatttttatgctattatgttccttggttggaagttctactttttattatattttgagacggatctca

SEQ ID NO: 43426 - DNA, 1732 bp, Homo sapiens
gtgttgctttttaaatgtgtttatttggacatttatctgaattaagaaaaccaaaaagaccaggttaatttgtttctatgataatttgttttggttttgataatgtgaggtatctaacaggtaagtcaaatttaacagcaggtaacacatagaaagcagctttctgtttgaaatagctgagttcgtcaattaaagacgtacaaatatcccaactttaagaaaattttgaaggtttaaaaatgtgtggatgtacaaagacgttgaactttgaaatacatcaggttgatatgcataacctcaaaataccaactcctatccagccaaggtcaagggaatatcacacaaataggggagaattaggtaattgcacaatagactgaaatgaactgattgaaggagggtttactgaagcatgggggtaatgttggatattcaacataggcttatttcctgtgtgtatatgttgtgttgagctgtttctcttgtagaaattgaagtttaaggtagttcttgtgtagctttgagacagtgccctaaatgaagaaaggctgctttttggccaaggctttatattgttgctgtgtaacaacttacctcaatacttaagagcagttcagagaaacaaaccagcatctatgggtcagcaattgggagcaacttaactgattctgggtaaagctcaaggttccaatcacagaaaactaggattggagaatttttttaatatccagagtggcatactaacagctttaaagttaatcctggttgtcatcttccctcggtgagtgatttgagcaagaaaagctgtaaaatgaacacgctctacgaagtagtcgtgctatcttgcatcctttatggtcacagaatgtggtgggagggttcttttccctggtacaattaccaagcaggcagggagcattgggaactctcagatgccagctgtcacactcaagggggtgcccttactcagtttattcactagtgtgaaaccagatttctgtatgtgtaagcttttccatgtagcccaatttggtagatgccaaattgcttgacctaataaatactagttaggcattgggagctaacaatgtaaggcaacaagtctcagtttgtcactgatggttgaaaagtggaaaacatctgtcaggacacctggactgcatgttacataaattcgctctctttaaggtttggaactaatatactgagatgttgacaggccctacataatttttgacatttccactatttagtaatgcactaacactggcttgttttggggtagtggaggggaattggtaacaaatcagttgagttgcatggacttaacagagaacaaatcgttcagagactgagatggggaatgatttagctacttgagtgcgtttaaaagacgttaatattaccacacaaaaccctgtatactggttctgaagctctgctgaaccgaagcctaccttgagaccaggggaccactagaaatctaggtctttttttgcttggagttgccgtacaattggcctaaaatctgatcacacttgtgaagatgctcaagtgatagttttaattggaaaaggagatgtccaacccacttgggttgtctttgttcttgtcttcctcattctgattaagacgttagatgatgcaatcaagactgctcaactaggtaggtaatgtggagggtcctaggcaatggtcagctttcgggcattggctttgtaatctagttggt

SEQ ID NO: 43427 - DNA, 3460 bp, Homo sapiens
tttaccaaggatagttattcagtccttgaagctattttagaggaatttcattaaatatttcacatggaaacttggaaagctggaaatggatgtgaggagacagttcaaaatggtattgaaaatattaagtgattacttaaaggcttattttataataggtggcaattttggaggtagccccggttatggaggaggaagaggaggatatggtggtggaggacctggatatggcaaccagggtgggggctacggaggtggttatgacaactatggaggaggtaataaattcacctgcaacctttatgtgggaatttggaattaatgtctttgtaacacttgatcttttgtttccatgtttgtcactagatgcccataaaatttgtggataagtgtttgcttttatttgtttttatgggagctttgtcctaagtccttggtttaatgtttgtattgttctgagtattccaattttttaataggaaattatggaagtggaaattacaatgattttggaaattataaccagcaaccttctaactacggtccaatgaagagtggaaactttggtggtagcaggaacatggggggaccatatggtggaggtaatttataaaaattgaggttattcagatttttgtgattaaaggattagccttttgtgacttaaagggaagataacatactaagtagtttgtactgtgggcagtgctccatgtacggtcttagtgaaaataaagaaattttgcataaatctccacagaagtactcagcaagcagttatgacatcaaattgggattagggatgttggaggtgggggtgttcagtagtttaatttctggtggggactcataaacagctaaatacagttgcaacccacattgcaagtggtatacattggaatgagggtctttgaagttaaatccttaaaccatgattcaaaccattgcttagcttatttttgaggtttttagctaggagtaaactagctttgtcttgggcttgatgtacttttaaaaaaatcccttactcagtccaaatgaggatgagagggtgaaaggaccctttatttaaaagaatagggtcagccacgaaataaaaatgtctatgaacccgagtaatttatctcctgagtaattctgctaactggctgcaaaggattaggatctgcttgtttaaaagactggatggatataaaatagaatcaactgtagtgttaggctgatcatgggaaatcaaagtaagtttgttttctcttgctgttccaacaattataggaaactatggtccaggaggcagtggaggaagtgggggttatggtgggaggagccgatactgagcttcttcctatttgccatgggtaagtagcttttgagttttacaattattattatcttgggagacatagctgcaggagtaaaagctttttaggatcatgttatctttccttaaaatctggttagatggataatttcataacctattttttttttactctttacttctgttgaaacaggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaattgtgtaattatagactttttattttaaataagttaaggagtgggtagtataattaaggtccgttgcaaagctgttgttatatttgtataagataaatgctggtcagatgtaagtgtgttgtctgcaattcatcaggattaaattatgtagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaattattttggttgtttttccctttttttccttcttttcccaccccctccccctccatgtgaagatttgggtgcttaacatatcatttttttccctgccggaattttagcattgatatgaaccatggacaagtatattctgctgccacaaagactgtaaagtgcttcatttcaacagctgaggcaagccaagtgatcattaataaagcttttcttggttccttcagtggtgttggtagtaaaatggtaggtaaaagttaggctgcaagttcaataaatcatgagatttcccatcgttacacccttgtgtattcacatttcttggatcaaacattttgagtgaactaggggtttttattaaagacatttgttgtatttatggttgtaactgtacatgcttatcaggatgagactgaaagaaggtagggcaaaaatggttgaatctattttcagatagtagttcatacttgagtgaagtgtcttgtctgcattatgaagcctggtatgtatccagtactaaataggtgggttaaatgtggtaattctagttcagtgtcttaccctgaagagaaagttgtaggttggctgttgaaattcattccttagatatgatcagtttgattgcccggctttattgcctttacaggaatgtgatactcagggcttactctatacaccaatgagtcttctttgatcctaagaccaccactgaagttgtttaggttcttttggacaaacatgataaacttcttcagatactttttttttcctttggcaggaaggtgtcttgctgcaggtaactaatgaagaagtggtcaaccacagagtcttcaagaaataagaaat

SEQ ID NO: 43428 - DNA, 5798 bp, Homo sapiens
aagggaaggctactaagatttttctggcgggggttatcattggcgtaactgcagggaccacctcccgggttgagggggctggatctccaggctgcggattaagcccctcccgtcggcgttaatttcaaactgcgcgaccgtttctcacctgccttgcgccaaggcagggggcgggaccctattccaagaggtagtaactagcaggactctagccttccgcaattcattgagcgcatttacggaagtaacgtcgggtactgtctctggccgcaagggtgggaggagtacgcatttggcgtaaggtggggcgtagagccttcccgccattggcggcggatagggcgtttacgcgacggcctgacgtagcggaagacgcgttagtgggggggaaggttctagaaaagcggcggcagcggctctagcggcagtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggaggtaacgggtttgaaatcaatgagttattgaaaagggcatggcgaggccgttggcgcctcagtggaagtcggccagccgcctccgtgggagagaggcaggaaatcggaccaattcagtagcagtggggcttaaggtttatgaacggggtcttgagcggaggcctgagcgtacaaacagcttccccaccctcagcctcccggcgccatttcccttcactgggggtgggggatggggagctttcacatggcggacgctgccccgctggggtgaaagtggggcgcggaggcgggaattcttattccctttctaaagcacgctgcttcgggggccacggcgtctcctcggcgagcgtttcggcgggcagcaggtcctcgtgagcgaggctgcggagcttcccctccccctctctcccgggaaccggatttggcggccgccattttcatggctcgccttcctctcagcgttttccttataactcttttattttcttagtgtgctttctctatcaagaagtagaagtggttaactatttttttttcttctcgggctgttttcatatcgtttcgaggtggatttggagtgttttgtgagcttggatctttagagtcctgcgcacctcattaaaggcgctcagccttcccctcgatgaaatggcgccattgcgttcggaagccacaccgaagagcggggagggggggtgctccgggtttgcgggcccggtttcagagaagatatcaccacccagggcgtcgggccgggttcaatgcgagccgtaggacaaagaaaccattttatgtttttcctgtcttttttttcctttgagtaacggttttatctgggtctgcagtcagtaaaacgacagatgaaccgcggcaaaataaacataaattggaagccatcggccacgaggggcagggacgaaggtggttttctgggcgggggagggatattcgcgtcagaatcctttactgttcttaaggattccgtttaagttgtagagctgactcattttaagtaatgttgttactgagaagtttaacccttacgggacagatccatggacctttatagatgattacgaggaaagtgaaataacgattttgtccttagttatacttcgattaaaacatggcttcagaggctccttcctgtaatgcgtatggattgatgtgcaaaactgttttgggcctgggccgctctgtatttgaactttgttacttttctcattttgtttgcaatcttggttgaacattacattgataagcataaggtctcaagcgaagggggtctacctggttattttctttgaccctaagcacgtttataaaataacattgtttaaaatcgatagtggacatcgggtaagtttggataaattgtgaggtaagtaatgagtttttgctttttgttagtgatttgtaaaacttgttataaatgtacattatccgtaatttcagtttagagataacctatgtgctgacgacaattaagaataaaaactagctgaaaaaatgaaaataactatcgtgacaagtaaccatttcaaaagactgctttgtgtctcataggagctagtttgatcatttcagttaattttttctttaatttttacgagtcatgaaaactacaggaaaaaaatctgaactgggttttaccactactttttaggagttgggagcatgcgaatggagggagagctccgtagaactgggatgagagcagcaattaatgctgcttgctaggaacaaaaaataattgattgaaaattacgtgtgactttttagtttgcattatgcgtttgtagcagttggtcctggatatcactttctctcgtttgaggttttttaacctagttaacttttaagacaggtttccttaacattcataagtgcccagaatacagctgtgtagtacagcatataaagatttcagctctgaggtttttcctattgacttggaaaattgttttgtgcctgtcgcttgccacatggccaatcaagtaagcttcagctttcagtaattgttatcttagagattatgccacgtgaatgtattttattgtacatatggttaagctgagtaattcatattctgtattgtcatatatcaaatatagacatgtccaccaaaaattaaactttttaagcttcgagtgctgctggtcataaaaattaatttgtcctggttataagagtaatttttaaggttatttctaatgcatatctttaaatattttcgtaactgagagtcatatggagaaacttagtgtttgttgtaaaaagttgtgtttttttggctgagatacttagaatcaccaccagagggggcagttaagggaaaataaatgatacttttcagatattgaatagtgaaataaaaactttgggtcataagtaatgaaccaagagttattttctgatgtttaaaaatagaaatttgcgtttttaggttgtagggttgaaatttttggtaaagattctttaataatcctttgataatcacggtctacatttgtttatttttccttagaaagttttttttttaattaataatttaagataatttaatgttgagtaaatttatatcaagcattaatgactttgaaacttgtgtagatcagctgaggcaattttttggtgtaacacaactaatatgcagtttaacatatggtttaaatttgatgtaagttttttttttccccccagaaaactttagaaactgttcctttggagaggaaaaaggtactctgccagcaggtcacctcatatttaagaatttaatttcctgcatacaaagaggaaaatgtaaataaaaattgaaatggtattttcctttgcagagagaaaaggaacagttccgtaagctctttattggtggcttaagctttgaaaccacagaagaaagtttgaggaactactacgaacaatggggaaagcttacagactgtgtggtatgtaaattactgaattgttactggatattagtcttttagctgtatgttaagtgaatcatggaggaaataactatcagcatagtaaaaaattctattatgacttcacttataagctataatgagattaaatgctaaagtttaccctttggtttgaaaggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggtaagcaaacaatgactgtcttgtgcattaacatgaagaacgctgccctgctgaaaatcagaaactatttctgaatttagttttaactcaagattttttctcttattaaaggtgtgttgggtttctggaccattttcttaagctagcttatttttcaaaagctaggtccctaaaagctattttatatctggtagttttaaggtggatacaagcgaagtatggtactacggttgggtgctttgaattatgcttgtgtttttttctgtttggatgacttttaccccaccactattttaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtatgtaagtgtctaaccacaaatgtactgtttttttccagtgtattcaattttgtgtatgttaacatctgtaactttattgaaaggtaaacttttgaagctgcttaatattgttgatttaatttaaaaggagtctgaatttttcattccagtgcagaaataccataccatcaatggtcataatgcagaagtaagaaaggctttgtctagacaagaaatgcaggaagttcagagttctaggagtggaagaggaggtaattttaattctgtttcttctttatttttgttcatatataagggcttgcttctaactggggcatttattgtaggcaactttggctttggggattcacgtggtggcggtggaaatttcggaccaggaccaggaagtaactttagaggaggatctggtgagtttcaagttctacgtgtttaaaggatgagtgtgcttttattttaaatatgattaggttttcattagtagaatcaagaaatccaacctaagtcaattttcctaagacttcaaatagattgtatcctggcaagctcttgtgatttggccagacaagaagttaatagagttgtattaataacagttgtatttatctggattaataatgtaacatgaagtgtcatccgaaaagctttgacccccatcaagtgtcattcttacgtataaataggatggaatctctaagattgagacttgttaagagtccaaaatttaggcggtagatttaattatatgctttcatgttttgtgggtaaactggtagcactggtgtgtccttttctgcggttcttaattattgtgctgaggtagtaagagaactgaaaatgaatattagcaataatgctgaacagtttatagtaaacgtaatctttttttggcccctaacagatggatatggcagtggacgtggatttggggatggctataatgggtatggaggaggacctggaggtcagttttcctctacgttttggtttgtttatgtgactaatacttaactatatcgtatatttacttcatttatattttgagtttttaaacattttatattagtgtctataaatggcttgggtgatagtggtccagttatttctaagtagttttgccatcttagctgttatagcctaaggaatagagtgccattttaaatgaaaatgtaaagataaccatcagagtatctcatcttttctcaagcaaaatgattggatctagatatatctttgtacgtgcttctctggaaaagtacagaatactggatttaacagagtaaaacctaagggggtggtatatgtaggaaaaaatatgaaatatgtctaaacccgtaactagatgggaagcatcccaggataactttcaaaaagcgtaacctacggaaatgttccaaaatgtttagtgtgctcctggctgcagataaggttgtgaa

SEQ ID NO: 43429 - DNA, 1030 bp, Homo sapiens
tttatttattttattttatttttttgagatggagtttttctcttgttacccaggctggagtgcaatggcacaatcttggctcaccgcaacctccgcctcccaggttcaagcgattctcctgcctcagcctcctgagtagctgggattacaggcatgcaccaccacgcccagctaattttgtatttttagtagagacagggtttctccatgttagtcaggctggtctcgaactcccgatctcaggtgatccgcccacctcggcctcccaaagtgctgggattacaggtgtgagccaccgcgcccagctggggggttctgcatttaaagcacagacataagaaggggacaggagtgctgaggtctttcctgagggcacccttcaggtctcctccataggtatacacaatctcctcttggggaaagagaagagctttacatctcagaaggctaaatgaactaaagatgcccaatagtgcccagctgggtgacctcagggaggccactggacctctctgagcctgttttctcactgataaaattgagcagaatgaatactgagtgttttacctgattaaaactttataaccagtgccatgttgtgtttggcttttataagtattgggattacggggaattataatgaatgaccagaaggaaatactggtttccaagggtttaagcagatgaggagagactgctttaacacaacacatttgtagtgcagataagatatagtctcacagcctaattcccatgcccactccgcatcctcatacatgattacattgcattcaacttggtgacttgtctattcgcagcttggctgcagaagctgctgtcagtggtgttgacattaaattccatggggcagaaggcagtgggccctttgggatggaaactgtcccaactgtaccatctttcctggcatgaccaaactggcaggcagggattgctttacctttcttgcccaatcaccagcattctctgggctttttcctcttaagcttaccattttcaaaatcgtgttgat

SEQ ID NO: 43430 - DNA, 1043 bp, Homo sapiens
gtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttagggattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaa

SEQ ID NO: 43431 - DNA, 1033 bp, Homo sapiens
ctttttcctgccttcttacccagtcactcttactgctcaataaatattaattggggactaaaatttcaactacaaaataaaacaaataaaatgactataatggtatgaaaattgaaaacatgggagttagatcacaagcattcactaccgccttactattattttctcggattactgggcaagtttggcttttttttgcttctttgattgccacactacattttgccttgaagccatccattttgcagatattgaatttcttttgagtactatttttatacaataagcatcactacacctctggatcttgatagcattactgcaggaggagaaagcagctttgtgttagtaattacctaacattgtcagaagctgactgcaggcctctttctagtgataacagaataaccgcataatgtagctttatagcacatgattaatagaaaataattacacgtcctacaaagggatgcaatatttcttataaattgactagaatggtttcctgtagattaaaggactcttcattattttatcagtcctcctgaagtacagtcacttgcctatgttagcatttcagctgatgttaagagctgaataggtgaaggataccagatggcagacctccttgtacctgaaaccttgtgttccataaagattacatgatgcttcctaacatttcaaagatttagacaacagcctggtatggattgtctattttttgtttgctaagaagataaagtttgagagttttcctttttgttttttaaatgatccacttgtgactttatagaacaatactataattagtttgtggactgcaaaacaacattgtatcagttgcattattttccactgtaagtaatatatcattcataatcacatttgtttgggggtggaaaagaggaaaggcatagacaggcagattttctttttcagaaggaaaccttgtacaatattgaatgttcaggccaaagtttagaatactgtactccaagaagcattttcattccaatttataggctgcaaatgg

SEQ ID NO: 43432 - DNA, 1050 bp, Homo sapiens
actagttttttttttccttcagaatgctaagtgctttctgatttctcttataacatttttttctttttcttttttttcttaaccactgcgaagatgaagggatagaaaggttctttggcttaagatcacagccagtggcacagctgttgtaagaaaccaggacttgcttctaattatctactgattgttctggtactgtaacttcataacaatatgaaatgatcgcagtcagctttcattaagtctaataaaacatcttcaatgtattttataactattcaaacccattttcttttttgttcttagaagctatagtgattttgttcttatttgtccacacattccttaataccttcttctgaccaataacaaatttgtgggttgtgggagtttgaaaagaggtggtgatatgatttgaatatttgcccctgcctacatcccatgttgataatcccagctattcagggggctgaggcatgagaatcacttacagttgggaggtggaggtggcagtgagccaagattgagccactgcactccagtctgggcgacagagcgagactcggttaaaaagaaaaagaaaaagaaatgtaatccccgctgttagaggtggggcctgatgggaggtgtttgggtcatgcgggcagatccctcatggcttggtgctgtccctgcaatagtatgcgacaatgagtgagtacttgtgagatctagttgtttataagtgtgtggcacctccccctccctcttgctcctgctctgccatatgaaacaccaggtcaccctttgcctttcaccatgagtaaaaaagcttcctggccaggtgtggtggctcacgcctgtaatcccaacgctttgggaggcagaggcaggtggatcacttgaggtcaggagttcaataccagcctggccactaacatggtgaaaccccatctccactaaaaatacaaaaattagccaggcgtgggtggtgcacgcctgtagtctcagctactcaggaggttaaggtaggagaattgcttgagcccaggaggcagaggttgcagtgag

SEQ ID NO: 43433 - DNA, 1050 bp, Homo sapiens
tgaaaaagcttgaaagtaaacagtggctacttaaaaaaattaggtaatatgatgcaaaatacacatttaaaaaacactggaatagtagaatattcagtgtaataactctataactgtaacacaaacaattgaatatctctgtgtgagtgatgcttaatgcattgtacgtcaacttaaagcagatcctgtttaaaacaaaattggttacatgaaggccacctgaatatgatatggtcttagttaatgatacatgttgggcctcaacttcctttaagtggcacttataaatcctactagaatagaaggtttttggacatcagatattattgtgaacttaactatgtaataaaaatgtttgagctaaaaatttttttaacctaaaaatctttaccttgaaatttttagatacgtaaattaagctttcttatgttcattatgtcagaatatattactataatggaaaaagaatgttttcctactttccaaattaaactttaataaatgaaaagtctatatactctaacagagtagaacaaatacattgtggtcttggattttgctagtgatacttaactaatggttcatactgtatttgaagtgtctgctgccattttgtggcattagctcacagagtattatactgtttctacatcaatggtagatgtgcttcttagtgcggagtcattttacattctgtttataattattccgaagagactatgttcagaaaattgtcagtctattttgtataccatagaactttgcgattaatttgtgtgtgtgtgtgtgcgcacgtgtgtatctgtgtatacatgtatatggtattaagcatataattaggggggagtgggatttaggatttggaaaaaattacaagaaatttacatgaatagaatttcagtttttcaacttacacacttgattagtgctagagttgcattttgtgctcatagtaacaaaaagtcagctttcttacctgatttttcttttgagctattataaaggggtataagattaatacattgtttggtgtttatatgctcctttatt

SEQ ID NO: 43434 - DNA, 1021 bp, Homo sapiens
gtagtgggagagattttattttttcaagagttaagtgacttactaagtttctcaaacagtactcttcataggtgcctgcttcccttatcattttataagactgtatctggatcatgaggttgttgcccagtaaatctaaatataacataggggcttaaatgatgctattgtttatattatacctcatatttttccaaaatggatttgaggtggctaaaattttgttccacttacagtgctgagaatcgtatcttgctaataaatgttgattacatttaattaactgcttctaaagttatcaaaatgaggttcttactaataagaagaaaaattcaaaaatccacttagaagtttattcatcctatgatctacgataagattaaaataagtagtatttagataatttgatcttattcaaaagcttggagctttctggtaggaaaaagtgataacacttagtatgttcatccagatgaataaattatttactggaaaggaccaacatctggatctttcacattcttcctctttggttgtatataactactgaagtttacctattgcaagtgataaggaacttggctagaatttcaaagaatgaggaatttgatggcataaactgaagcaaatactgtgtagcaagagtaacagtgaatttctgtgactcttctcttttgaacttttaggacattttctgtttattagtaaaatctctttaattggttctcaaacatgtgtccacttatgatcaacattgttttgtctgtgttgtgccaaacctctattaacctcaatagggaaggcaccaggttcaagaggctgaagaagagacccagagccagcaaacgagacatggggttttattaggaacttatatacgtacaggggagagaatccagtggtggctggctggacaagatatccaccttccttgcagtccagtggtggtgggctggacaagatatccaccttcctacagtccagtgctgcgggctgtacaagatatccaacttcctgtagt

SEQ ID NO: 43435 - DNA, 1086 bp, Homo sapiens
aaaatgtgacacagagatacaaagtgagcatgtgcaattgaaaaaatggtgctgatagacttgttccacaagggttgtcacaaacctgcaatttgtaaaaaatgcagtatctgtaaagtgcattaaagcaaagcacagtaatatgaggtatgtttgtataaatacagatgggtaattgaagaccaaatgacatatctgttacgtttactactttggctcatcagttgtcatacttaacagaggtgataatggatgaagctatcaccacagaaataaagaataaagattggatttggcaaataaaatacttacattaataattattattaattatctgacaaatgctaatgtatcagattaagcaggcagagataagagttgtaaggaatggatcaaatgacaaataaattttagtttgttatgggagggagctggaagtgtagaagaaaggaagggcttggtatacttctggggaactcaggcctgggaagaaccggagtgtaggatcaacttgatgggtgggacaaaggggagtaaatagccaggggtagaaccaatggtagacttcatgattatgcttaacgtgaatcttgatacttagattcttttctcagggaggtgatattatctataaagaaagtggaaaggcagataagaaagatcaagtttgttgagcttgaaggagtattgagaatccagtcaaagatatttaagagggagtctgagatatggaatagagatgtggcaaatcattgatttattcgcctaaacatgtttaatatcatgagaaagagaagactttccagagacagtagaatgagatagatgagaagatttagaatagagacattttctccaactttcctcacaggtaaaccaggagaattgctgcttttgtttctaaacctgtgattctattttacagaattttagaagccattaattactttcattccttagtatgattatagtcctggtgatacattttatcttggtcattttctttggcgttcatttgaatgttgatgtgatcttaggctttttttcctccctctttgttttatctaattatttttctccatgtaa

SEQ ID NO: 43436 - DNA, 1026 bp, Homo sapiens
tgccaactggtgtcagtggttagatgttttatggaagaagttggagtttgaactagaatttagtaagggtggatagaaatttaattagtagagaatggaaggaagaatactttctacataagttaagggaatgagggacaaggggaaacggagctggaaatgaccatagtttgatgaactgtggaaagactaacatgactgagaaaggttggagaatgggagatgaggattgacaagggtggcatgtgaaaagttttggctctggcttcaggtatttattttagagtgactaaggtatgggataggacataccttagtcactctaaaaatgaaacatagtagttaagaacatactgcctgggttcaaatacttcattgcctgtctctgtgacctccagcaaatttcttaacttttcagagtcttctcatctgtcaaattaaggataataatagtatctataacctatggttattcttaggattgagtaggataaggtatataaaaagtttagaatacttcctgacccatagtaaagacatattaaatgtgagttactattgttatccagtcaattttagggattatcttaaataaattttcctttttgtgttagacacaactgtttgtgagtgttgtctaacttctatactatatagctcatatgttttactggctaagatgaattttgtaggatttgcagttggaagttttagggattccatatacacaatcattttttcaacagggtattctgtgttgaaaactgttagtggttaaatttgctatagcaaatatatcatgcctttttcttgaacccttgtacttctttgtgccttggcttctttcttttgagtaatgagcatgtaagaataaagaaattttatacctggaaaaattttatacataggcatcatgagccttgggaaggagtcactgtgtttgatacatgagcttgatagctagtgactaaaaatttacaaacttttaagaacatttgaatgagtttggactgcattagaagatca

SEQ ID NO: 43437 - DNA, 1052 bp, Homo sapiens
gaactgttttcagtaaaagaaaaggaaacggatacactaaattgctattcagttttaagttttactttatcctttatttactttcaaccatggtatgtgtagcttcctatttccaaaagagaaacaatgctccagggctcatgatcactgacaataactctggataagcgatgctgtaatttttaatcgaggttctggaaaattaattgtgcctgttttgcagatgttggtaagattgttggcttaataatgaaatctaaaggagtccattatcaacaatggaattataatcatctactggtagatgcaatacattatctttttttttctagttaacaaagcatctaatattcctggaaaacttgaataactctgggactcaatatacatagttggattgcatgttaaccattttcttttgaatttgttataattttcttgagtggtcagagggactaagattctgagtgtgtgtgtgggtgaatatttgaaactcacatggaacttttctgtgctgagaactagaggttgaccatgcagtggttgaaaacaaaaagaaaacagatttaacttttgcaaactgctttctaaatgaaagagggttgaggaggttttcaactgctttttagattttcagggttatcctttacttggtatttctgaagcaggtaaataggccaagtaacaaaatatcaacaacaacaacagcacacaaagatcaggaaactctggcaggattttatggcttgtgcttccatccctcgtcgggagccaaatgacccccatacatcaaattacatagcagtttctaagacagaacctattatcgttaagttggaaggagagttcaaactgtggtcatggagatgaacgctggtttttcaggttcctggaggggttttttttccccctctaatccatcatgttttaacaggtagaatttgatagttgccccgaataacagcaccttagaaagtccaagacaggaggttctgggaaccttctgtaactgggggaaagaagtaaagaagtgggggtggcttgctgggaag

SEQ ID NO: 43438 - DNA, 1070 bp, Homo sapiens
cccacactcctgggaagggtgggaactccctggaaaggtgcaggaaactctattatgctccttgcagtagggaaagggatgcttataaggagtcagaggtcggatgtgcccctttcacttcttaaaatatagattatttctttctgtacgtgaaaaaaaaatcaaatcaggcatcccctacttgagtgggatttactaccccagaacgaaagggcccttctgccctccccagtgccggcctcggcagtaaccaagtgtttaactgaggccctttcaagtgctctaaaacaccccttggaaataaaatgtaagctttaattgctgttcaattacttgtcagcatttcatatgatttatgacctagttctggcgcatttttgacccagttaaagactcataaataatatagttttgctagaaagaatgagagagggaatagaggtttgttagaggcatctttttattgttgcttcagtgccagcaagctgaataaatatctaaggatggactctggttctacataaaagcatgcacagtgagaagccaagagccacatttatagagctcagattggtttttcctcccatgaaagtgctaaagtgagtccattacgtataatgctaaactattagatatcaaaaaaggctagtccccttctacctcgaaatgccagcttcaccctcacaggcaagtacatttcctcaataattttcctctctattctgtgattttggtgcctcttcttacccacgatattcctcaccttcctccccggctgcacagccttggaaccgccagaggccctctcagacgccttcaggaggacaccccttgaatggtagaaagacaccacgggcacctttgctgctccaagtattcttctagtgctgagaaaatcttttcttctagtccccctggatgagagatcgggagccacggggatttgggggaattggtggaaccaaggggtcctctcagtaaagaaaagctctgcggttttgggggagccgggtgaactgctgtgggatttgtctagaaagggcgcagcggcggcggctggtaatttctgg

SEQ ID NO: 43439 - DNA, 1063 bp, Homo sapiens
acttataattccatgtatcactcagttgtgcactgaggaaatgcttaagtgcaagtttagtcagggcactaggtttctctagattttgcaaaacccggacccaccactctatagccaagcacatctttcctagtgggctcccactgaacaaaaccaactggacttggaggagatgctttaaccttttgtcaggtaattatgtgcctttttggtgtttcttgcgtctgtagtgtatggtgtgggtgttagcaaactccatacaatggcaggctgtgaggaagtccgctgtccaggccagttatttctgggcctgccccttgccttttgatatactggcctgtgggccagaggagactggggtgcatgggtgtgcaggatccagcttgtccgtgggtgggaggctgtaaggaaagttaaatggattctaaaaatgtgaatagcattgctgtaacccttgtgtttggagggtgtgtaaagaaatataagtggagataagcttgtatgtcttatatggcattcatgggaggatggctccaagcatcctattgcttagacagaactcttaaactcaaaactgctggtcaaggttccccacctaccctcccccaaagctaaatattctgtttggaaacctagttccttcagtggttccctatttcaaataaaaggatttaagttgacgtatgaccacgtgagcacataatacagcgcattattgtggcatttggagcggagacccagacaggcttcgcctgtgattacgttttctagattctctacagagccagagctttcccccaacccccacgcacccacctcctccttctccttccccttctccggagagcgctctctgagccgattgcagttttcagcactcatggagcggttctgggcgagctagccgatggaagtcgaggctataccaggaggatggaatttattttaaggtatttccgccgattgttcatatctagagtgagttatggctgtgagagacaaaggtcaggcgaggagaccctggctcatggacaggaccctcagcctctctcttcctttgttt

SEQ ID NO: 43440 - DNA, 1038 bp, Homo sapiens
ctgcgtctttagttttaaataaagggaaaaagtgtctccacctcccattgcctgctttcccccatcttctcttttctttcactttttgcaaggttctcccattctgctccaaattttccttgtaaaatagaatcacgagtgatttcaagttaatctagttcctaggtgctaacgaagaggtcataggctgatttaacaaaaagtacagtcacaaacacacaaaaatatccatttcaccctctaatttcaaatggcagtggcagaagcagggcatcctgagatgctggggggccccttccccctgaaagaagaggctcggctttgtgtatctttgcggttagtgcgttacaactgcaggtcaaaaagttgagggtcaaaagtttacattgtgcagtgctcttagtcatctgcccagacagagtttgatgtcaatgttagagctgtgatcttgactatcagcacaaaagataaaatggctcagagtgacgcgtgtatcacggtatggactccaggtgaaccctagtggttgaatgacctcaattacggaggaaaggatagaaaattcctcttttcaagagtaatacatgctgtatctcatcttgaattatcgctcccattctgagggaatagcagcaggtaaataggcatagattactgaaacatcaacaccttaggtgttggagaaccaggagtctgtgggtttgtcacaaaataaaaatgctaaaaactcatctgtggagctttaaaaactaatgtcacaagtttccaatatttcattatgccttcaaaggcaacagaatggtgcaggaaacctcctttatttgaaaagagggattctgattggccggttttttgtctttttagtacacatgatgacccctaaagtgtgtaagaataaatgcaaacacagacacttcttgcaaaatataatctttgcagttttcaaacacagaatatgctttttctgaaactacagtccgctgaatgcaaagcgttctgagatctgagaaggggaaggaaggaagtggaaaccctcct

SEQ ID NO: 43441 - DNA, 1090 bp, Homo sapiens
cgccttccaggagtgcctcttgggctcttcggaggtcgaccttaggccagtcctttcccaattttttccctttgtgggaggagagttcaggaaaaaaattgaaaagcaaggaagagactaagtcattactagattcctactggaacactgccaattgccacctccccactaagtcctgaaccgggtgagcctgcattggccagggttttacagatcttgtaaacagtctccagaaatccatccaaatcacgtaaatagtctttcttcaacctccacagaattgaggattttaaagctaattcaaggggttttacaagcccaacaaacacagttgtaaaaatgccattgggctgctatcacattttacaaaacgagattgatccatgtgttgtaaaagtcaactatctcgaaggcacacctctcaggcaagagtgagcagctcaggacaggcttttaatgtcctgtctggggaccgccaggcctgggacagcagtgaaagcaattcaggatttctggagccggtgagactattcccggttccggagcgactgaggggcggcagccctccctgcggtcccaggaagggcagtaaagagggcggccccaggacagtgccggttgtcgggcgccccggaaaccgagcccatcaattatcccgcggccttgggccctgcagagctgccctctgtgcccagcttggccagggcctctgcgtcttctgtgcctctggaatgtggacagagagattccacatctggatttttatctgcctcagctctgagcggttctcgcagtggatgctgagtccccaggcgctaggcaggggagcaggtccctcggctgtcttaggagcccagtctcacggccactgctctgtcggtcctttcttgttgaaaccagtggtttctggcctttcaattccctgggttcaaaggtgggatggggacgcccagctggaaggagtgctttgacaccaggcaggcgcgggccattgagccccttgggactcaaacaggatgtgtatgtgggaggagggaatgggtgggaagaacctacgtttggctgagtcctggtcagctcgaggtgatcc

SEQ ID NO: 43442 - DNA, 1028 bp, Homo sapiens
ccctgaggctgccctgagaatgtgctgaggtccaggatcagggtattggcatctatttaaatcgaaaaataatatatttattccaaaaagcatcctaagtgcttgcaccctagaatcaatccctccttctctggcttggcacccacagctcaggcccatcaacccccacttctggaggggaatgttcctgagctggctgcagatctgtgggttagcttctgcttagcaggactgtggagatgcttccagcttcgctgtcctttcctctggctcctgtatcttactgttcagctgtgttaaatatgtacgccctgatgtttcctataatagcagatactgtatatttgaacaagatttttttttatcatttctatagtcttggagttcatttgtaaggcagtgtcttgacttggaaaggatgtgttaatggggtgactttgtagcatggtatgttgtcttgagttaactgtagtgggtggggaggtccaatgccctccgcaatgcccttcatctcctgtgttgtcctgtaccctgctcagctccatcctggggttcagggaaggcacacttcccagcccagctgtgttttatgtaaccgaaaataaagatgcgtggtgacaaagaaaaatgtggactgccttatccagaggggactgggaaaggggaggtgagtatggctggagggcagggggcagtggggaagcaaaagtggggtggctgtccttgtgatggtccaagtgttgggtacccatgtattggtgtcatgtatctttttaatgtatttttatgtgtgtatttgtatgagtatgtgcttatttttctgtgtatgtatttctgtgtgtgtgtttttacctaattccacaattgtatatattttggtgtccataattgggtgcatgtgtttttgtgtgtccataattgcatgtcattctgtgcccacaatagagtgtatgcccttccctgtgtgcataattgtatatgtgcctttatccgtgtagagacgtttgtctggtttttgcgtgtgcact

SEQ ID NO: 43443 - DNA, 1066 bp, Homo sapiens
agcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaattggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttct

SEQ ID NO: 43444 - DNA, 1574 bp, Homo sapiens
ctctgaggctggagcacagggctgggtcgccagccgcctgcgcctgggaatcctgattgccagctgatgagaaaggcgggctgggcgcgcgtgtgcgtggggtcgagggccggggaccgagcgcgccgcacaaccaaccaggccctcaaaaccttcgccctggtggcggctggccgctccctcctggccagctcctccgtggggtcctcgtagcaaaggcgaatttaagggttgcccgggcgcccctcgctccaggcgggtagctgtggggacctacacccgcggtactccctgagcggccggtccctgcctggagtgccctggtagggccggcggcggctccgtttgggacggatcctgcgttgaatttgacttttcgagggcggccgcgggtaaactcgcctctcccggggaccgcagggattatttacagggagctcgccaaccaaacacaacagtctaacctttccaagtcctcgtaaatttttacagctgggagccacggcgaggcaaacgaatctgttggtcgtttccgacttcccgccagcctgtgtggcttctgaaacaataactccttatgaaatatcataaatatagatttaaatacagtagagcgacaatgcgatttggctgcttttttatggcttcaattattgtctaattttatgtgaggggctccgctggccgcactcgcacgcgggacccgcgccttcttgatggcgtgattaattgtgatataaaatagtccgcttaagaagtgtgtgtatggggggggagacgggagagtacagagacaaggctagatttgatcttttaatcgtcgttggccacaattaaaacaaaccccatcgtagagcggcacgatccctttacataaaaacatatggcttttgctataaaaattatgactgcaaaacatcggaccattaatagcgtgcggagtgatttacgcgttattgttctgctggacgggcacgtgacgcgcacggccaatgggggcgcgggcgccggcaacttattaggtgactgtacttcccccccggtgccaccaagttgttacatgaaatctgcagtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcaggtacatgcgctcctggctggagcccacgcccggtgcgctctccttcgcgggcttgccctccagccggccttatggcattaaacctgaaccgctgtcggccagaaggggtgactgtcccacgcttgacactcac

SEQ ID NO: 43445 - DNA, 1080 bp, Homo sapiens
caaacctttgggctgaaggaagacaatatttggttttctgatttttctccgctttctaggcaccagtaacatctgcttaacactcaacgcctgctaattgttcagtaactctcttattttggggctaaggctgtttaaaggaacagcttttttacttaaaaaatactgaaataatcagtgtcttctcaggcataaaacgtggaaaaggcatccagacatgcccagcccatttgcagacacttaaaattgggagccagggtttcctccagggttaattttttaaatgaaaatctcagaggcctggcggactgcggggtatttaggacacggtggactgtggtgggggtgggcatgacctagaggaatttatggggcaaggaaaatattagggggagggagatgaggcggacaggacggggccatttcggagttcattgtgtcggccacttccctcttccaggcgcgggtgcaggaaggggcacccagtcggtatccgcgcggcttggcagcctcgctggtatttgggagtcccagccggaagtgtgtcagggtgtttgagggggggattactggaactgctggtgaggatgaaggcaaaagagagagagagagatggaagcgcccgaggccgccagcctcgccgccagggaagtgggctaatgaaaaacacactgttgcaggcacagtatccacacgtgaatttgattacccctgttctaggagtcgctgctttctgttaggaattgggggcagggggagtttccttccaattaacggagtggcggcgaccttttaatttacccccaacgggtgagaaataaacttccccaacgtggccaggcccaggaatgggactggagtcgatgcccttttacccctccccgttctaatttccagccctggccttgagctgtggctgcctctctttgggccttgtacctctccgccgagtctccgggccccgtaggtaaccaaggcgaggcccggagtagcagctggaaagggaggaaggagccctgaaaggctcacgcggccccgggacaggccacatcggtgcgggcctcccaggttccggagctg

SEQ ID NO: 43446 - DNA, 1030 bp, Homo sapiens
gcgcccgcttccatcctgagcctcccactggaggcctgcgcctgcccagggacctcctgccattctcttgtaaggctggaacacacacacacacacacacacacacacacacacacacaccagtcccgggtgtgagctcaggaaagaacctccttccagtggagactcaggctggactaggaaggatagggcaggctgggatcctggccttgtcacttacccttctctctgtaagctcggccgctgctaggagtcgcctctcttttcttccttcttttccctgtcttcccttcctcttttatctcttctttctttttttcttctttcctttgctccttcctgctttcttttcttccgttggtctttttttcatcttccgtctctgccagattctatctcacctccttatctccttcccaaagcatccttggggaggggcccagagctggcttcaggagagcctagggggtctcactttcctctgcggctcaagtagaggttgggaagtctgccgaggaagggcccgcgtggggcggctgccgagggcggtgggtttgggcctggtgtgttactctgcagacaaggcctcggttatgatcacgaccggatggcggcagccttgcgtttcttcgcctgtcgctaacggctgactaggagatctgattaggggacattcgctgcagctttgtgtgcccatatcgagggcagggaggccttcgccagcctcactggggactggagctgaggcccaaccagcctcgctggagcctggccattcgctgggaagctcttagctggctcttcccggcctgccggtcacagcttggggtttgaccgcattgagggagactggctagggcaaagcttgactgcttgcttactagtggcttccattaggtacaaaatatgttccatacagcacctttgtgcagctgggtgctggagaaggggacccttccaagagccagtatgttttaaatgggcaaaaagaatcccaaattccagagccattgatataaacttgagtcat

SEQ ID NO: 43447 - DNA, 1045 bp, Homo sapiens
tttctgcccttgcagagcataagttctggtgtctcatgtgtttgtgacagacaagaaatatgtatttttcagataagaagaactaaaaagaaaaagcaggataacggggatggatagggagtgccaggggtattttcttagggtgataaggaaagttctccccaataaggtgtcaattgagcagaggtaagggagtaagcaatgcaggtatctgaggaacaaacattccaggcaaaggggacagaaagtaccaaggccctgaggtaggacagtactgaatatgaggaataacagggaggctataagtgaagtggcacagaatgagggtggccagatcatatggggccttgcagggtatgttaggacactggcttttattctgagcaaaatgggcaatgtatcagttagcttttgctggataacaaatcaccccaaaatttagtggcttaaaacaacaaacatgtattgtttttcaagattctgtgggttggccatattattattctggcctagaccagctcatctgcagctagagtgtctagtttggctttactcagctgggacagctggaatggttggggcttctctccatgttttcatgcattctccaggaggctggtatgaatttgttcacatagtggtggaagcatcccagcagcagcataggacaagccctgactttctaagcctctgcttgcttcatgtttgtactttccccttggccacagcaaatgtcatagccaagcccagaatcagcatatgtggggtctgcataagagtgtggacacaaagaggggcattatggtggcctttttgcaaacagcctatcacaagcagcctgtgaaactttttcaccagattgatgtgatctgacctacttttttaaagggatcactctggatgctgtgtggagaagagtctgtaggagcaaggctggaaacaaggagaccaattcggaggcaatagtaataacccagttgagaggtggtagctgggaccagaatgttaaaatgatggaggaggcaagaagtggttagattctgaa

SEQ ID NO: 43448 - DNA, 1025 bp, Homo sapiens
agcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgttcattcttactacgtattttttgacttaagaatgacatctttagatgcatttcagagccaatgatgatatttgctttagataattattatattattataaatatagccatattattttgaattcaaataaatttctatactggtaatactttcttggtgtttttgtttcttccccatcatttggtgaactaatgttctgacaaactgatgttcacactaatggggaaaggatgggaataaagagaaaggaggggaggtcaaaaggaacaa

SEQ ID NO: 43449 - DNA, 1060 bp, Homo sapiens
agttagatatgtcgtgaacgcataaaatatatgtagatagatactagtttataaatatgcacaaatctgttataaagagttaaaatttatcaaagtttacaaatatttatagaccatacatggcaccatttacagttgagagaaatgtaaagaaatgtaaagatgcattaaatcataatggcataaaattaactctagtaatactgtactactgtaataattttgtggccacctgttgctattgcagtgaactcaagtgttacaagtattgagcataaaatgtcatgtgacactaatcatctttgtgtgagtggttcatctctttagtaaattgtgtatcatagtaaaaattgatctcttggaattctcttgtatttttttatcatgtttagtgcaataccataaaccttgaatgacaccatgggacccatacaaagtgccactagtgatgctggaagtgctcctaagaagctgagaaaagtcatgacattacaagaaaaagttgaattgcctgatacataccatggattgaggtctgcggctgcgtttgccctccatttcaagataaacaaatccaatgtaaggaccattgtaaacaaagaaaagaatagtcatgaacccatcactgcagctactccagcaggcttgcactttttgcagaacatctttttatctcacattgaaaatgcagcttttatgtagatgcaggattgctgtagaaaggcatacttacatctaatatgattcaagaaaaatatgacaacttaaagcaaaaagaaagtgaaggatctaaagctggagaatttaatgccagcaaaggatggtttgataattttaggaagaggtttgcttaaaaaatgtcaagaaataggcgaagtagcttctgccaaccaagagacagcagacagttcccaggcgccattaagaaaaaatcattgaagagaaagtatatctgcctgaatgagtttttaatgcagacagaagtgccctattacggagaaaaaaaaaaaaaaaaggatgctcgaaggacatttattaggaagagaagcaagcagcacca

SEQ ID NO: 43450 - DNA, 1085 bp, Homo sapiens
gtgaagtcagtgttaaagtttatttcttcttcttgctcatatcactaaaaataaattgcccaaaagatgtatagcaggaaggaaaagaaaaatcaaataatattgaaaagtacatatgagaataatcagtcaaaataagcaaagttttccttgccttaaaaaaagaatctaccatctgaaatgcctacttgtttaaggaacaaagagccaggtctccctctttgtagatctcacttatagatagtatttggagagtgggtgagtgagcaagaaccccgaatccaaacgtgggcagcagacctctctctggctgctcctttgctgatcagggcccaggtaaaactttttttttgtatactttctataacttagtaggtttcttaggagaataatagatgcatgggaataataacatttacattttaagttcccttatctgttaggccatgattgtgccaaaatgattaaggtgagttgagattgagagtacaactgaatctgtatgtctctcttggtttgtgattaatctgggtgatacttgattgctgaatatttctgtagagatttagagtatcttatacatgcctggcataaatacagattggaggcaggatgtttttagttggtttctctaattttattacctgcctaaacattttaagaaatatattcttttgcttctatccctttacccccaaatgattcaggtgtaggagctgcacgatctgggaacctcacgtttatggtgggaggagttgaagatgaatttgctgctgcccaagagttgctggggtgcatgggctccaacgtggtgtactgtggagctgttgggactgggcaggtaagatttttacattaatgaccttgacttgatgatgtaaaattgactaatgttcctttctctttcctgaccatatttttattcttctttcttcaacctatggattctttgctcagattttaaaacatttatttggaataaattagttttgcatcattcctggtgggcttaagcagacatcagccaatttacttatttaaaaaacttccattattggccagacgtgatggctcatgcctgtaat

SEQ ID NO: 43451 - DNA, 1030 bp, Homo sapiens
taacttaagccttgagcctgttttcattcttatatcaaataaaactgcccaaagattaggagacagattagcataaatgttagaatgaggtgatgtaagttttacttcttttataggtataaggctaagattagcctgaaaagggtataaagcaagaaccaagcttcaattcagtttatcttgggaaaaaaggtcactatttttgatgcaaaaatgtgaaaacattgttcattacttcatttactgttcctgcatgaagttccaaatgagaatttttaaaaaatatgttaactgagttcaaggaaaatatatgcttgctctcaaatagagtttcccaagacttgtaggatactcagatctatatttgagatttgttgtgagatactatggtttctttttttattcttaatactgattttgttttcctttgaaaattcgatttcattttttaattgacaaaaattgtatatatttagcatgtacaacatattttgaaagatgtaaatattgtggaatggctaaaccgaactaattaacatatgcattacctcacatactatttttgtgataaaagcacttaaaatctactctcagcaattttcaagaatacaatacattgttattaactataatcaccatgttgtacagtaggtctcttgaacttatttctccttatttctgattttctaaaagctctctattttttttgctctgataagcaaacccacattgattgtgaagagtggtggagtattatgtgcatttagataacaggcagaactcagcgtctaataaaaagcataccagattacttgctcagttcatgttaaactgctctgaactagattcacaaatggattcagaatacctgtattctcatcagtttttatatgcctacctacagttgacagcaagaatattactcttcaagaacaatatcttgttttttcaccccttctctgagaattcattattctttcaatgacgagggttgaaaaatgaaaggaaagggggaatcaggatttggtgg

SEQ ID NO: 43452 - DNA, 1032 bp, Homo sapiens
tgaaagatacgttatttgcaagacggagttttaaaaatcatattctccaggggcattaagttaactgtctttgtgctccagctatttagctttcaggagtttagtgttttattgtaaaccgacattgtgcaccatcttgatctgaggtgaatgccaaggaattgctttttaaagtgatttttagaataaaagaaaaccatttcatctctgatttgccctccctttaaaaaccccactctgcatttctgtcttacggcttctgtactgcatcagtcctcctcaagccagccagctccatgcggaacattctgttgctctttcagcataagcaggtctattgtgatatttatctgaattcaggcaaggctaattaaaagagctgctgacagttgttgtgatctgactttgactgcagcttgatggtcattatgggtaaataatgaaccaggtctgcaaatgtagcagctgccaacttgggatagaagaacggctattgcttccaatttaaggatctatcgaccgcttctcttctccctgcagatcttctgcagaaaactaatgttttctgctgctgtgtattgtggtttcagctgtttcagatatagcctataatttccttctttaatatttaacttaggacattattagctttcagagttaacaacttttctattttgaagaatctcagctttgtccttgtgtaggctttagctaatcagctatagtttatttatatgcatttaatttgtgtgttgtgcaggaaatggctagtctgtaagagcaaggtatagctttattaagatgtttcacaatcgtatataggtatctcttctaaaaaaagagatagatgcatgtcccttgcttttgttttcttaaacacctaccaaatctcagttttgaattttgttcactttgtcaatggcttatgaaatattttgatgcagagctctatttatcaattcagaggaactgctgcagtgactttcattaaaatgcaatactgaatatattgtcactccatcatgagctttt

SEQ ID NO: 43453 - DNA, 1025 bp, Homo sapiens
agagtccacattttcaagggattttcacatgaaagagataattcctggttagccaagtgtagcttattagcacagccttctcttaatctttagttttctgctgtccccagttttctactgtttgctgccgggttatcatcttgccttttgcttatttcttcttactctcttccctctctcctctgacagccattacttctgtatacctaccctcaaagttataacagaactcatgtgaataatcagttctctttaaaatagagggcacatgattattatgcctgtttttcttctcaagcaaactagacagggaatagggatgggaggatacccagaagggtgtggtattggtggtaattggattactgagaatttggttattggccttgttttactttgtgattgttaatgctgaatgaaaggatgcatgtgaaacttacaggaaaatagccaactccaatcacagaaatgttacaaaccacgtgttgcctaaagaaagtaaaatagaaggacataatgattacaagctatttggcttttttttcctcttatttggcttttaaaaatgacttttggctgggcgcggtggctcgcgcctgtaatctcagcactttgggaggctgaggcaagtggatcacctgaggtcaggagttcgagaccagcctggccaacatggtgaaaccctgtctctactaaaaatacaaaaattagccagctgtggtagtgggcgcctgtaatcccagctactcaggaggctgaggcaggagaatcacttgaacccgggaggtggaggttgcagtgagctgggatcgcaccactgtactccagcctaggcaaaaagagcgaaactccataaacacaaacaaacatacaaacccagctacttgggaggctgaggcaggagaatcgcttgaatgcaggaggcagaggttgtagtgagccaagatcacacccttgtactacagcctgggcgacaagagcaaaactccatctcaaataaatagtaaaaataaaaatgactttta

SEQ ID NO: 43454 - DNA, 1025 bp, Homo sapiens
tagctgggaccgcaggtggattgcttgagcttaggagtttgagaccaactggcaaatggcaagacgccatctctacaaaaaaatacaaaaaagtagctgggtgtggtcatgcctgtctgtggtcccagctatttgggaggctgaggtgggaggattgctcgagcctgggagttggaggttgcagtgagtcgagattgtaccaccacactccagccagggtgaccgagcgagaccctgtccccccaaaaaatggaaaataagcagatcctctaaaactcaataaactagaataaaacaaatataaatctatttaaataagaagagaaatgtgacaaatgtggtaattggaattaattaggaaattagttaacaacaagaaaaatagagtcattgaataaaaccaagaactggtctttcagaagacaaatctttaagaagtttcaccaagaaaaatagaaaccataagcatcaagaataagataagagattgcacacagatatggatgaaataaggaattataagtttgtgggcagaaaaatggaaagtccagaagaaataggtgattttctagaaaaaaatgttaccaaaattgattcaagaagaggtaaacacatgagtaaacttccaacgaccagagatattcagacagccattactaagaaggaacaaagtaaagatggttttaaaagacaaatcttatgtagtcttcaagtaatacttagttcttgtatattgtgctacggtttgaatgtgtcctctccaaaattcaggtgttaatacttactggccaatgtaaagatattaagaggtggggtctttaagaggtgattaggtcatgagggttcctcctttcctgaatgggattaggcccccttataagaagcttaatggagggattttgttctgcttgcccttctgtcttctgccatgtgaagacacaatgttcctcccctctggaggggatacagcaacaagctgccatcttggaaacagagagcagccctcaccagacaactgaacctgt

SEQ ID NO: 43455 - DNA, 1039 bp, Homo sapiens
ggtggacacatgtagaacctcatatccagcaattgaagaaatgtatttctcaagacacatcaaaaaattattaataattgaccacacaataggccatgaagcaagtctccagcatcaatgaatctgtatcttatagactgcattctttgactacattgttgactacaatgcaatgtaattagtagtaaaaatacaattaaaacctatacatttaaaatttagaatcacatttctaaagaatttattttttttagtcaaataagtcatataagaaaaaatgttagaactcaacagtaatgaaaatcctgtatattaaactgggatgcagctgcagcaggacttttaagaaactgagaatgcaagttttgagtggaatttgaaaatataaggggcaaggtgagtattagaaaacttaaattttttccaatataaagtacacagtgaaaactaaaatgaactcaacaagaagtgaataacccagtttaaaaatggacaaaggatttgaacagacatttccccaaagaagatacacagatgactaataagcacatgaaaatatgctctacatcactaaccattagggaagggcaaatcaaaaccacaaagagattacactgaacactcatgagaatggctactattaaaacaacaaatagaaaacaagtggtgttgaggatgtggagaaattagaacccttttgcactgttggtaggaatgtaaaatagtgcaaccactgtggaaaatgatattggtggttctgcaaaaaattaaacatgtaattaccatatgatccagcaattttacttctgggtatatgcccaaagaattgaaagcacatatgttcatagcagcagtactcatagtaaccaaaaggtggaaacaacccaaatgtccatcagtggataaatggacaaacaaaatgtggtatatgcacgtaatggaatgttattgagacagtattctcaaggttaaagaacaaaatgcagctctttgctctttttaagaaatacctgaaacaaaattatattaaaggctaaca

SEQ ID NO: 43456 - DNA, 1030 bp, Homo sapiens
caagtaaatgcttataaacagtaaatgagtttcctaaggtcatagaacacaaggtcaacatacagaaattcatcatatttctctatactagcaatcaacattggtgttttaagatatagagtttattattaagcaggtatagtgaggccaacagatcaggacaccactaccattgagaagatagtttattacttacagttcccaagaggaggggccgtgtcacaccacacaaggccatatggggatgcatcagggtcgatcaggaggcagaaggaacagaaggaaaacgtgggcaagagcctttgttgtggtttccacatgaaagaatggatgaggcagggtaagcaggcttaggcttggctagtttgaataatttcagcagttttggggtgtaggggctatctctaagtgtctggtacttggccctggggtgattagagcagagaaatagtggcttggagcataagagctctataatgcaggtagttggggatgtgagctttagattggttggtttgcatatgaaaggcacgcttaaaggttagtcttttactctctctaggaattgattagccctgggaggggtagtctctccaggatcagcaagggcccagatttcaaaacatcagaaataaattaaaaggcataattaatgcaattggtaactgacatttaaaacattattatttacatttgtttcaaaaactaaattacttgctataaatctaaatgtgcagaacatgtgaaaactacaaaagttgatgaaagaagttaaagaagacctaaataaatgaagtgtactgtgttcatggattgatggatttgaagactctgtgtagtaaagatgtcaatttcccccaatttagcactattactttttattgcatctatagagaaattgacattaattttatatggaaaaacaaaataactaaaataaccaaagcaattttgaatgtgattaataaagttggagaagtcacattactcaattttcatacttacttcaaagctatactaataaaatgtg

SEQ ID NO: 43457 - DNA, 1051 bp, Homo sapiens
cctaggtcagtcacacacgtgtgcacgcacgcacacacacaccctatacaaagatgcaatagataaaatggaatatcaaagaaatattcaaatactgtaatgcagaagaaggtgggaaaggagaaagagaggaactaaaaacatagtggacaagcagaaaataaactagtagacttaaatccaaacctatcaatactaacattaaatgtaaatgacctaaatacaccaactaaaaggcacgatattatcagattggatttaaaaaagagaccaaaatgtgtttacaagcaatccactttaaatataatgatgtaggtagattaaaagtatagaaaaagatataccatgtaaatactagtcaaaacaaagagcaaggaaaattaccaaaggtatagaaggacattacataatgataagagtcaattcaccaagaagacactaacagtcctaaatttgtaggtacctaataatagagcttcaaaatacatgaaataaaaactagcagaatgaaaaggagaaatgaacaaatccacaattattattggagacttcaacacttctctctcagtaatggatatgacaagtagacagaaaaatcaacaacaatataaaagaattgagcaacatcgtcaatcaaatgaacctaattgacatgtatagaacactctatgcagcaacagcagaaaacacatgctacttcagtgcacatttaccaagatggatggtatcctggatcaaaaccacccttaacaatttgaaaagaactagaattaaacaaaatgtattctttaatcataaagatttaaactagaaaccagtaacatatatatggagatttactcctcaaatatttggaaattgaataacacattcctaagtaatctatgggtcaaagaggaaatgtcaagggatattagaaaatattttgaactgaacaaaaatataaatacaacatatttgtaggatgctcctaaagcagtgcttggaaggaaatttataaaattaaatgcttgtattagaaaaggagtctcatatcagtaatttaagttct

SEQ ID NO: 43458 - DNA, 1022 bp, Homo sapiens
cctctcttctgaacctgcagttttgtggtggcagcagcagccaaccagacacttaaaaatccaagggaagtgaatcctctctgatcagaggaactatggtccaaacagtgtagaatgattcctattgcttttttctttttttaattctcttgctgtttggccccagagacagatctagttgcaggaagtacaagactttctagtcagaggaccgggtggcagtgggggatggaggtggggtagtagagtgtcagagagtggggcccttcacagataagagggagctcataaagggaccgcatgatgttatgtatgaacttctgggcccacccttgagccatacaacatagatctgaccctaaacagcataccaagtagctgtgggatagatagcccacccagatatcaggctggctcctggctgatgcacatctaggacagattcaaatacatcctgttcttcatagaattggagcaagacccagagtctcatagcatcttatatcccaaatgttcatgatatgatacaaaattacttgacacaaaaagaaccaggaaagtctgattaagtctcaagggaagagacaagataccaaccctgagattacccagatgttttatattaggcagtgattttaaaacagctgttataaccatgctttaagaaataataatctcagttaagaaaaagaagctataaaaaagaaccaaatggaaattttataactggaaaatacaataattagaaatttgaagaaaatcactggatatgttcaaaagcagagtgcttgtgacaaagaaaagagtcagtggatttggagacagaaattacatgaatggaaattatctaatcagactaaaagaagaagactgtaagaaaatggacagagccttgggatcccctgagataataccaagaaatatctaacatttgtgccagtggagtttcatacagagatgagtgtggtacaaaaaaaaaaatttggaaaaaaaaaaaggtggctgaaagcttcccaagttta

SEQ ID NO: 43459 - DNA, 1049 bp, Homo sapiens
tccacctcactgttctgagatttcagtctgcccaagatatacttctgataaattgttcagaaactttctctggttcctgatgctcacccagtccagcccagtcttccttctcagcctgccattcaaggctctccacactctggatccaacttacttttccattcttattttctgctacttctttccacatgccttaaattctaaccaaactggactattcactaattcttaaatatttaccttatttactcaagtcccaatgtagatgccacctcctgtgatctctccttaggtaaaagtcaccctccctgtgaagcaccatgacaggttagggtctcacctacattgtaattactgtatacctatgttctcagctacactgtaagtccagagattcttgacaaataaatcaagagtgctaaaatttccaattaaaaaacctatttggcagagtatctggctttctaattttattctgggaaaagtaaaataattttataatgctaaggtttgtaatattagggaaggtcatgggatatcctagaactctcatctacaaaagataagataagcctttgtccaataagttgagctctgtctgaacacataagaatagtagtcagcttgcccttctcgattacctgctttataatatcactgggaatacaaacagttctctattaaatctcctaaatgagaggaaaatgtattttataatttaaaatggtatgttcattttgtatgtacatagctctattttgaagaaattgagttttgttaaaacagtcttttgcttataacagctccagattgcttgtgttttggtaaaaataagagatgtggaagatacatggattttgaacttgaactatattttgggggctcttttcaagtattagttccagtggctgagtacagtatgtaaatttcattattattagagggggaggtgtgcataaccactttttttctctattagagcagcaataataaagttttgcatgtctgaacctatctatgtacttagttatgacagaagctaacttgca

SEQ ID NO: 43460 - DNA, 1020 bp, Homo sapiens
gaatttggctgggcgcggtggctcacatctgtaatcctggcacttcaggaggccgagacaggcggattgcctgagttccggagtttgagactagcctaggcaacatggtgaaaccctgtctctactaaaatacaaaaaaaatcagccaggtgtggtggtgggcgcctgtaatctcagctatcaggagtctgaggcatgagaattgcttgaacctgggaggcggaggttgcagtgagctgagatcgtgccactgcactccagcttgcgcaacaaagcgaaactgtctcaaaaaaaaaaaaaatctaaacattgaactttagaaccaaaatgaaatcttactgtaaccctaatgtacaatactaagaaaacaaatattttcattgacatattgaacttataaaataatgtatcttcaaaaaaaagattctcttagttttaacaaatattcatgcttaagtaatgtcttcagctccacattttcagaaccctattaactctcacttagcaaaattagcatactgaactctctaaactatttaatgatttgatttatatatgttcattctaatgaacaatggatgctaataacagtattctgtgaggagtaaggttttttttgaggtcagcagtgtttagattaatcaggttgacatttcttgctggtgggtcatgaactgttgataatagcattaaatggtgattcagttgttgcagaaggtacaactcattatccagctactatattaaatcattacagaaacaattggcactccacacccatgtgttctgcagcaatggtacatcagggaagtatatttgtttcttttatttacatctcaaatttttttggaggcttacctacattcttaaaggatgctacagcattgccactactttagggaacgaggatgattatcttgactgatttggggggatgaagggatatataatccttttaataacacacccaaagtcttctctttatattgcgagcctttctgaaaccttgttttcataatg

SEQ ID NO: 43461 - DNA, 1052 bp, Homo sapiens
gattgaagcgaacagagtccctcactgaaaggctggaaatataatttcacttaaccgtacctggtagtatcttcttaaatggtataagaaagtgcttttctaattcaaatgattcaaataatatttgctaatattatgaccaaactttgaagaaagtgatagttgtattttataggattaagtgagatccttatctgggactatgacgggattaacagataccttcagaatgctttacagctgaggtgtatgtagatagatgtagagctctaaagggattaggtgggtggtggttaagcaatagcagatgtcccttttaaaatcttcaaactagaggtctgttaagtacagtgcttattttttgctgacttggttccatgagaaaccttgatgttttttagtgcttctgaaagtatcaagaagaaactattcagatggtttggaaatttggggcctactctttttgctttgtaaaatggacagttttggataagcaggaaattctgactgatgggcagcagaacaattaattgcagtatagaagtgcattaggtatagtgaaaagagcacttacatgagaaatctgaactcagatctgagttcttttatttcctctatctgttgtgtgactttgggcaaattaacttttctgagtctcaacttttctgggtgtaaataaaagtgatgggactgttggtgctgagtctaaatgcattgcttattttgagacttaaatgaaatgatgtaccattgaatctcttggagtgggcatattcctttctctaatgccatttttagggcctgactttttgtgaaaatcaaatgagattttggtgttttctttttttctcaccaaaatcctaacctcagggctgactttatcagaatgttctaatgtaatcattgtggaaagatacacattagtacttacttgagaatgttgtaacccaaatcagaactcttactctggttcacaaaacaggacttctagaactttgagaagaggcagtttggtgtgatgggacgatcacgggatttggattcaggactcc

SEQ ID NO: 43462 - DNA, 1045 bp, Homo sapiens
taaatttttattttccaacattacccagttaaatgcacttttataactttttaaatacccaaaattgacctttacaaaatatcaatgagaatttcagtattcaacattaatcactgataagcttttttttagcacgtttatagtataggtatttaacgttaatacatgattaacagtgtatcaagcttattgcacaatcataataaaatacactattcagtgctaattaggcattgcaattatcatttggtgttgtactgaaagaattatattggtaactgatgcttttcatcttgttagtatttttaatccctctcaatatatataatctttcagtagtttcatcaaaagaaatctgttccaacaactttaaacagaggaccttcaagagtgtgaggtgtgtgtaatagttttatcttgaagagaactcagtgaaagatactttctagattatgttaaaaagatccaatcaaccggcccatactcatcatgatttaacttttacagttttatacataggtttcattgaaggctgtaagaaaatctgatgtttataacattttcctttgccagtgtttgtctgaattttgcaaagatcaagtatccaaagtacgaaatgctagtgtatttttggaaaacaaaccaaaacccacttacccaatagattttacatattctaagaacgagaattcagtagtctggtaagtctggcttcataactcatagatttcttgcaccaaataagattgtcagcagtttggaaagaagagtaaagaagaggctcttcttcttacattggtgtgttcaaaagtaaaatataaaccagtatttttgttactatagcttagagcactaaagaagagccatctaccagtttccagattgttttagaagtagtgtctgaagaccttttcatttcaacttgttcttattctaaagattcctggctcgttatatactaaattgtttctagaaatgcttactagataggttgctgtgaaaggaaaggtttcgaaaaggatgagtagagaaaattacttttgaa

SEQ ID NO: 43463 - DNA, 1031 bp, Homo sapiens
tatccaggtgataggatatgttgtcagaataaataaagctcagtgtatattctattgatttttattcttttaaaaaatgtattcaccatgcagagtgatgtttaatgcttagctttgatcatttagcaaaaagcttagtgctactcattttatactcttgcctcttctgaggcttcttaatgtgcacaacctgttttaagaaatgtatatgttttcaaagtaaatgtttgacctcccaccttgatgttcccacttaaaagcaaaaccctcccctcccttatattttgaataacttgatgagaatgtgtgttgtactaaaactaaatatatgcacccttcagtattaccaaaagagaccttttggttttaaaaattaggaaatttcacttttgaaagtagtctagacaaaggtactcatgacatttgaccctgaaatttttacttttaaacttgatgcaacagtctgcttcttagctttgttgtatgctaatatttctacttatttaacatcaaaaagctgtagaggtttctctttatagattatgcctgtgttctggaattgcctcctgctgtccatgaattgcttcttggcttgttgtgttagaatttctcaccagggtcttttgtgagctatgtagccaacattaaaaaaaaaaaaatcaaatttgatagagtaaactggactagtaaaaattatacttactattcataattataattgaggtttcttggctcagcatatcaattttatgcagtaagagtaagcacatacaaatctcatgtaatgatatgcatacatatagttgcctacaatgactgtttttctagttatttctataatattaaaatgatttttttgctgaaattccagaaatctaaaaacattgaaaaataatgataatgagaaaaacaattcttacttgttagggtatatgttatttagtaatgaagcatttagattttggattctctcatttcagttggaaatagtattggtgtaagtgagtgttgccatgggaacctccacatag

SEQ ID NO: 43464 - DNA, 1055 bp, Homo sapiens
aggaccactaggtttgattgcttgttgcatgataacagaccagtatgcagacacaatgggagttgcagtagagaaagagtttaataattgtagggcagtcaaatgagacagaggaaccttcaaatcctcctccctccagggtttggggatggagcttgtaaagggtctgaacaggtagggctaaaatgtggggattgctgattggtcaagaagcaagggggaattcctgggacagggagatgaagaaaccgcattcctgtgcagagttggttggttccttggttgaggtcttgagactggttggcttcagccattctgctggaattcaggacctgaaaaacaccataagcaattcttgggtaaaaaggtccagtgtcagagattctgtgtataggaacaatgggggagcaggtggtcagcatgccgcatgacccttggttagttaccagctacagggaagtgggttgaagtaccccagtgcaccctggtcaatgcctgactataattctgcctaaagcctggcttgtagttctccatcaactctgtgagggtggtttcaaaagggatgtggggaaagcatggcttagatacccagaatgggcccacagttttatagaagtccagtgttcatcagtcttgaaacatggaatctttgagatcatttgaacaaaacttgaagaatttctccccatccctttctcccaagtcttcatctatttcctattccagactttaaaaaatgcatcatggatttatatataggtacgtacaaatagagtagtattctaaaagtgtaaatgggaacatactatacttctattatcctatggttagtattttaaagagaagtttttttaaaaaactcagatgaatttaaaatagtaatgatttttgagaagcaattggtttcttcagtcaagcgtttccccctacttcctggtaagtattattctggggagtaaagtaagaattattacttaatcatttttctagcctatggaataacagatggaaagttttcctcaggtttcattttgatacttattagacccact

SEQ ID NO: 43465 - DNA, 1051 bp, Homo sapiens
gtgatatgtagacatatttctaaatgaaagaatgaagatacaaattaaaaccaaactaggaggtaaagtgatttgacagcattcctgtttaagagtctgctctgcactgccccttctgacccacctttattttgcagaagatactggtttttctttttaacttaatccttagcatcaaggacatgtgacttgtgcttcattttcattgtctaggattttccttggagatgctgctgatctatgccaaaagtctgggatgtatgcaccacttctgtgtgagtttattctgattgaactaggcttaattagattctcttttcttttgttttctctttaaaaacttggaaaccattttgttgttcctgagttgtaaggctgaacatgtttgcttaagtaaatctcttgggatctaatctggcatccactcaggtcttgttaaatgagagctttaaaagcctcttgctgagtgggctccatcattgttgaccaaatgtttcaagatgtaggcacaaagcgcttttgtcagtttttcaagtgtagtttaattttgaagtaattgtgcttttctacttttaaagtatttaaaaagtacttttaaagagtactgttaaagattaaaaaacacaggagtggcaagtttaacaagatcacattcttcttgtttctttataaatttctgttacccatctggtttacttggaagcaatgctgaacttaacttatgtgactgttttatctagaagaggcagcaagatttttctcttcatgtaaagcaactaggtaacatttgtcttcttccaatggatatgtaaaaagggggtgtagtcccttcagattactcttggctcttcacccccctcctcatgctgcaaagcagattttttgttattaaacagatttttaatttattttagcagatttttaatttattcagtcctctgctctttatattacacacccaccattgatgcatactggcatacagataaatcaaagtctaattcagagaaattggctgcaagaattcttaaagactatattgtggtttaca

SEQ ID NO: 43466 - DNA, 1064 bp, Homo sapiens
catcgtagaaacatagtcagaacagccgggtgaggtggcttatgcctgtaatcccaacagtttgggaggccgaggcaggtggatcacttgaggtcaggagttcaagaccagcctggccaacatggtgaaaccctgtctttactaaaaatgcaaaaaaaattagccaagtgtggtggtgtgcacctgtaataccagctactcaggaggctgaggtgggagaattgcttgaacccaggaggtggaggttgcagtgagccgagattgccaccactgcactccagcctgggcgacagagtaagactctgtctcaaaaaaaaaaaaaaaaaaaaaaaaaaatcaaaaccatgagacacacccactagaatctagattaaaaagttagataacaatgtgtttgtgaggttgtagaaaagttggagccctcatacactgctagtggaaatgtaaaatggtacagccactttgggaaagagtttgggagttcctcaaataattaaaagtttagaattatgccatgacccagcaatttcacacctagctatatacccaagagaaataaaaaatttgtatccacacggaaacatgtatttagcaacattattcatcatcacgaaaaagtggaaacaacgcaaaaatctatcagcggatagaatgtccaaacaaaatgtgttatatccatacaatgatgattattcagtaataaaaagaaatgaagtactaatatttgctgcaacattgataaaccttgaaagcatgctgcgtgaaggaagccagtcacaaaaaaccacatactatagacttttcctgaaagtccagaataaggaagtctatatagagacacaaagtagatcagtggttgcttagcgctggggaagagggaaagttgggcatagaggaatgatagctaatgcgtataagatttctgattttttttttttttttaaatggagtctcactctgtcaccaggctggagtgcagtggtgcgatcttggcctactgcaacctccacctcctgggttcgagtgattcttctgcctcagcctcccgagtagctgtgactaca

SEQ ID NO: 43467 - DNA, 1092 bp, Homo sapiens
caacctggatgtgaatcatccctttgtccagcgtctccatgctgcagacactccctggcccattagtcacttactagccgcctcagtgatcgggtgttgtgatatcgcgtgcttattttcaggtaacccttattttatttcataatggtccaaagcgcaagagtagtgttgctcgcatattgttataattgttctattttattgttgttgttaatttcttactgtgactaatttataaattaaactttatcataggagtgtatatataaagaaaaactggctgggcgcagtgtcttgtgcctataatcccagcattttgggaggccaaggcaggcggatcacctgaggccaggagttcaagaccagcctggccaatgtggcgaaaccccggctctactaaaaatacaaaaattagccaggcgcggtggcgtgtgtctgtggtttcagctacttgggaggctgagacatgagaatcgcttgagtccaggaggcggaggttgcaataagccgagattgcaccactgcagtccagcctggatgacagagggagactctgtctcaaaaaaaaaaaaaaaaaaaaaaaatgctgggcgtggttgtgtgtgcctgtagtcccagctacttgggaggctgaggtgggaggattacttgagcctaggaggttgaggctgcagtgagctgtgtgctccagcctgggtgatggagtgagaccttgccttaaaaagaaaaaaaaacaaaccagaaaacatagtctatatgtttatataacatagtctgtataggatttggtactgtctgtggtttcaggcatccactgggagtcttggaatgtatacctctcagaggaggggttaccactgtgtagtgaatgaatagcaagagccaatgtctaaacaaaggtctttgacttcggagttttggttctttttgaaattaatgtgaaagacatttttgagtgtgtgtatgtgacatctgtgttgatgattctgaaatgtagctacctgttaacctatttataaactagattgctggaaaataaggtgcctagatcagtcaagccactgatcattggtctcccttgccttctcttgt

SEQ ID NO: 43468 - DNA, 1024 bp, Homo sapiens
ctaatattaaatgaatgtttacaataaaaaatgttatttgcccctattgaaaataatgtattgaaatcagtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtaagaccttttctttagatttgttttagattttgagaatgaaaaatgaatatacattcaaataagtgacagcttcttagaagtatacccaatggagttgtaaacctaattcagtgttaattttatatatatgtaatcattcatccaacatccagatttgcagtaaaggagagttctcgttagacattcaggggtatctattctttggcaggtgacttggaacattttgcacatttggtcagagggccttgttttagctctgtatcagttttctgagatagtaactttactgattgtgctgttaaagtagttagtttggtggaaataacctcctgtgttattaaaagcacatatgtctttaaaacaagagtaggcttagagatataaagcttagtttgagttgaagctcagatacatgctttcttactgggggcaagttacatcacttctgctgatttcctcattcttaaaatgtgaacgatgacaacctatgccattaggttgtgaagctcaaatgagagaatgtatgtgaacatactttgaaaacatcatatggcagcactttgtgaataattattagttattggccataaaccaggagacagcctaaaaacactatgtcctataatgaagagttgagttatagtggatctctagtgtttttaggctatcattcatgtttaaagaattttggtaccagagtttatcatgttggatgataacatctgctggttaagtcttgagttgtttggatttgttaaactttatcaataactcaaattacaggagacca

SEQ ID NO: 43469 - DNA, 1028 bp, Homo sapiens
ctttaaattataatcttcctagttgctgaagtttttagattgctaaattacaccttttcaaccttaacacagtaatgccacattttctttctggctattattgctagtttgtttatgagcattagttagagttctctgatgaagtgtactcattctgtttaatatcaaaataaaatttcagtttggtgtcacttttctgtcattgaattccttgcaggccagaaagacaaactataccagtgtactattataccagtgtactattataccagtgtattaaacttagcgcctgttaaatgatgttgcacagaaatgacacccacatttaatggaagtgttagagtcagtcattaagttaaaggaattaaatatgcttccaacccaagaagacctctagttcttaagcattagggcttcaaataatttgcttttaacaaatctcattccattcagattcagttcagggaagagcagattaagttcagttgaggggacctgaaacttaaaagagggactgtgattagttgttgcactacaaattttaaagctggagttcttgaaagaaaaaagaaaaagaatgctgggaaatggaagagcaaggagagttacttctctcttttccctcactagactgtgagcttttaaaggacagggaccatacgttgcttgtgtctgtctctgagctctgtcatagtacttcatgcagtgaatatttattgagtggagttctaaatctagaaagtgaaaaattgcatctaacgctatttccatagtactgtaaagcctccccactctgtaacgcattactttgattcatatgcccacggagtaatttcaaaaagtcttatatgaaaaataaaagaataaataaaacctgtgtagtttttaaggcttttttttttttttttttaatggcagcctggtcaacatggtgaaactctgtctctattaaaaggacaaaaattagccaggcatggtggtgcgtgtctgtgatcccagctacaccggaggctaaggcatgagaattg

SEQ ID NO: 43470 - DNA, 1048 bp, Homo sapiens
gtctctggttgatttaacctcctctgtgattcttgttctaacaaacatactgttacataatgctcatcacctggtcctttgactccctcccttttcctccaagtacatagacatgctttcttgtttcctcatttcataaggtctctctctaggtttgtctgtacccattctcaaacttatttataattaggaatttcactgatgcctaatactgtttttttcagcctcttgttgtatttctggataaatccattgttgtggtctgtttgtgcctttccccagctgtcacttagcttggtgatatggagagtcacagaagtttgctgattagatacaatgctttcattaatctcttgtttattccccattacattttcagattttccacagcatttccagaactttaacttagggctggcagctcctgaaccagtcatttggcagaaggatgccattaccatgtattagtttagacagtttgaaacttgacctcggatctacgggaaagaatattggagagtcaacctgcaatgtgtaatggttgctgtgacactgtttacctttacacagtccacttttatcagcagcattactttgtaattgctttagaactggcttttattcccatatgcccatttgatgaaacttacctagtttattattcattcacatagcatatattaaatttcactgtgccacttcatttatttcattttattataaaagtagttacaaaagttacatgctcatggtaaaaaatgggaaaggttataaaattaaaagtaaaattttcttcaactccgacccagtagtccaactctccaggtgtaagtactgtttcgtgtgtatccatacagaaaatcagaaaaattaatgcatatgtatcattttttcttctcttatactgtatcctatagataatgctcagcattttttttccacttaataacttatcctggagattttttcctataattttagataaatgtcacctttttttaaacatttgcacatttcattgtgttgatttactgtgaattatcaagtg

SEQ ID NO: 43471 - DNA, 1053 bp, Homo sapiens
gatgttcaagatgctagattaatgaaaaactttcacaaataaatttgacaacaatgaaattacagatcttgaaaaatgtgtcctctttctttaatgttagtgacagttctatacagcacagacataactgaagaaacacattactttgatttgggtttatgtattgtacttttaatcacttactgagaatatttcaaatttatattctcatcaggaaaatgtaaaaaagatactgatatatattctatgatttttatgccacaaacacccctgttatgagatcatttaataggaaaacaattatactgacatctcttgttccattttcccattagatatatacatacaacttcaagatagtttaaaaataatcattcaggttattctaaaattttgccataaaattagcaaagtatgccttctgttaattgctaaaaccaatatttcacatataaaagcatgtgatctcattctacatgcagctccatttctgaaaattaaaaacctatcatttcatgggctaaattatagaactttctatattcgaagaactacttcataagactgttatgacaaatgctttttattacataatatttagtagtcatgctcaatcaacaaggtcaacagaaacttgtgaatattctgctaaataatctagcacactaatacatacacgtttttcagtgcagtaacattgaaataatccttgtatcctttattcagacagttctgcaaactagggaataaataaagatacgaacacacaagaacttttttttaaagcaggtaagattaacagagattaaaatttattgataagccaaagactgaccctgatcctagtaacaccaaactcaaagtagctcctggtcagaaagtgcagtaaagggtgcatgaaagcatccgctctatggtctcctcagtggtctattttaggtgtggtttttttttttttttttactgctaaactatattaactcataataaaaagtaactagtcaaaatttagaacattctgatcaaaatgggtctgcacatgcctttcaaaca

SEQ ID NO: 43472 - DNA, 1094 bp, Homo sapiens
tgggtataaagacaagtgccagaatttaaggagctaatagcttagagcaaaaggaggccaaatcaaaaaacaggcattttggctgccatgacatgtacacattcctacaatctgcccatttgttcattaaaaaataatagggcctcaaaaccgtggcacttcaatcagagcatcagcagaaacaattaaccatcccaataaaagggattgctgggctgactctccaccctactgtcgcactcacccagtgtcacagccggtggatcctttgtgtccttaaaccttgtgtccttttgaaaggtagatctctgagcgcattctcctctgatagagaatggtttcatcaaagttacaaatctaatccaactgatttttgtttttaagtacagaggaagatgaattcagtaaggttgcaggatacgttatcaatatacaaaaatcagtagcatgtccatacacaaataacaacctagctgaaaaagaaatcaagacaacaatcccatttatgatcacatcaaaaaaaggaataaatttaatgaggaggtgaaagatttgtacactgacaactaaaacattgatgaaggaaattgaagaagacacaaataaatgaaaaatatcccttgctcatggatcagaagaatgaatgttcttaaaatgtccacactacccaaagtgacatatggaatcagtgcaatccctatcagaatcctaatggcatccttcacggaaacagtaaaaacaatccttaaactgatgtagaaccacaaagaccctaaataaccaaagtgatcctaagaaagaaaaagtaaagttggaggcatcacagttcctgctttaaaattatattataggctgggcacggtggctcatgctgtaatcccaggactttgggaggctgagacgggcggatcacctgaggtcaggagttcgagaccaccctggccaacatagcaaaaccctgtctccacaaaaaatacaaaaattagctgggcatggtggctggtgcctgtaatcccagctactcaagaggttgaggcaggagagtcactcgaacctacgaggcggaggttgcagtgaactgagattacaccact

SEQ ID NO: 43473 - DNA, 1072 bp, Homo sapiens
agctgcattttctgaagtgagccccgctgaacggagcacatgccacagatagtaccaccactttctcccagccttccatccttgacatgtgtgtctccccaccttccatccttgacagttctcgtgtgacagtcggctgaggcagaaaaagttctgcccacttgaaccatatacccttcacacgcttctaattctagaacccaccccaaaagattgggatcatcatataattaacattcgaagcatgtttttctaaaccttcactttttagaaaaatatagacatagaaaacatttctcttggatgcacaaacttgaaaattttgcccctgaagcagtttgaaatggccatttacaaatgcatactgtgcaggcttcttggacattgatgacactacccattgcagaggttgtctgtgtctcccccgaaggtttgctgagtatctgttcattaatccttatttagctaactggaaagtactttccttattgtctgtgacacatggattatcccattaggacatctgtggatgacatatcgttggtttgttctgagatgaaaagtggtattctccttatagagcaaaacaaagcaagggaagaaacagttaatagacttgagctgacaaatgggaggttggctaaagattgtgatcatctccttacagatgtcacaaccccgttggcacacagcactgaccttgctttcccaaggttgacctgtatgtctctagatcaagattgatttgaaaaatgagccatttgtatttagtgctggtctcaaatcaaactccaaaccagttgaggaggaacagcgaagttattcagtggtttgagaacttagaattggaaaatctctcctttttatttccctcaggacccaacttgtaacttctcgttacaatgacggtttaagagacacatttaaacctggtattcttcctctattcatgaaactgcatctacatatacgtactgtggctgggggtacatgaacccagtcaaaatcatccaggaagcattgctaactactctggagttttcaaaagcactccctattcgaacctcatgtt

SEQ ID NO: 43474 - DNA, 1044 bp, Homo sapiens
aattatcttgttacacgagaaaatccagtttcaaaactgcataagcaatatgatctcaattttttttttttttttgagagaaagtctcactctatcactcaggctggagtgcagtggtgtgatctcagctcactgcaacctccacctttcaggttcaagagattctctgacctctgcctcccaagtagctgggaatacaggtgcgcatcaacaccacccagctaatttttgtatttttagtagaggtgggtttttgccatattggccaggctggtcttgaactcctgacctctagtgatcctcctgcctcagcctcccaaggtgctgggattacaggcgtgagccaccgcacctggcccatgatctcaattttatcttttatttaagagaagttaaccatggttaactaccttaatatgataggaagatgaatattattttcttctttttcttttcccatattttctaaaatgagtttgtctttctttttataattaaaacaacttaggacatatgattggaagatatagaattactggccctaaaaagagttgaatggatctctttccatcaaattaattgacctttgacgtgggatcatcctatagcaaaggcctttttgcttttgcatccatcattagagagcaggttgtcttggttattattgcctacagcttagttaagaaagtaatttctcccccctccccccatatttccccattgaacctctgaaaacagtgattttcgatcaggatgaacgttgaaatcacctggaaaaaattttaatctacctctgcctgggctccacccacagccactctgattcagctggtgggtggggcttgggcattgggagtttttaaaagctcttttgggtgggtagttctacaaccagagttaagaaaccactgttttaaaacatggcccatctcattgtagtatctatgtgccttctagcttgaattttgaacatattccacgttgtctggagaaagattactgtaatccgtttccttgacctccgggatgaatccagtgggactg

SEQ ID NO: 43475 - DNA, 1045 bp, Homo sapiens
agagagtgtagtgtaattccgcaatcctcttttctgggtattgctatgatacttattcacatataatatgaattatgggaacagtttcccattggctgtgttttatacctgaagtaatatggactgactcatgtccaaccccagataactgtgactgccccaattagtgacgggtgcctaggaccccatgaaaataaagacagtttaaaagtgagagtttattatttttcatgtaagaatgtttggaagaaatggaatcatttcccttccttcagacataaagaaatctttctgacaccttgcctattttagcaatttcccattgagagaattaatttatgttgtggtaaagatgtatcattttcagtctgtcaagattattggtaagttatttgctgctgtaagaacattccatgtaaacatcaaaaattagcaggggaaatggtttcttaaacccctaccacgtacaattttgattgtgtacatttttcaatgtttggaatgttattttacctgtagttagagagatcagcttattttgcctgactaatgtggtttcagtcactttcattgccaggttataaaattccacatttctaccccttaaattcactcttgcaagttctatattcatggtgcattcccacttcagaagtaatagtcatcttgtaggaacttcatttataaaatgttctttaaggtatactttcttgacaatactgaattagagctcagctttatcctaaagtttcgagtatttcttaggtatagttggaatcaatgtttgttttgcaattttttttcttttctgtttgaaacagggtcttactgtatcactctatcacctaggctggagtgcagtgatgctatcatagctcactgcagcctcaaactcctgggctcagcctcctgtgtagctcacgtcagcctcctgtgtagctgggactacaggcacatgccacaatgcccacttaattttttgactttttttgtagagatgaggtcttgctatgttgcccaggctggtcttgaactcttggcctca

SEQ ID NO: 43476 - DNA, 1017 bp, Homo sapiens
tgttaacaattataataaaattatgacttgatgaagttttaatgatgtaagtaattttgctccccaagaggcatcagttgccaaatgaagctgaagttttaaggaacgctaaggactcactgtactaaaacatcaccatagtgcctttaatattggatgtaccttacaataatgtggattagttttgggtcagggccaggagcttttggttcctcaaacaccaaaggcacttcccttaaggcattcactcctgtaagagagtccctttagcttggattctaagggtagcaatgaaggaggattccaaggtgcaagcagtaatacaacttgcacacagagtaaactccacaagttgttgattgtaaagttgtttggaaaccaggattgaatttgcctctacatacattgtcattagtgatatttagatttagagccagttcccagctagtactttttgaaatgattacgtattaattatttaataaatggtgtgggtagaattggactgctggtccaatcttccttggcgttccagagcactcctgtagtcaaatagcacaaaactgagcttgctccttccttttgtaaccataagtcacccctcttttgtatgacttcacccaagcaaatttggcactattgtattgattataaatatgttatttcctgttgctaccttatcatcgtaaaatgcatcctcatgcttgttctgtgttatccagctctgatagttacatttttgacaagataagcagctactgagctttaaggcattgtagacatgcttgcattttccgtttacctttgaaaaattaaatgacttttctttaactctcatcacaggttttagcatgaatgacttatgatctttattccttattggtttatttctccaaattttcccattttagtttctattcacaatggggggccaggttcaaaatatttttctctcctaagagctcaaaaatcataattcttcaaaatatcattttacatttcatgctaatgagatag

SEQ ID NO: 43477 - DNA, 1194 bp, Homo sapiens
cctgagctcaggagttcgagaccagcctgggcaacaccgtgaaaccccgtctctactaaaatacaaaaaattagccagacatggtggtgtgagcctgtagtccagtccagctactcaggaggctgaggcaggagaattgcttgaacctgggatgcagaggttgcagtgagctgagatcgtgccactgcactccagcctgggcgactgagtgagactccgtctccaacaaaaaaagaatactttataaccaacataaaatgtggttcgaaaagtaccatctaaatgaaaatcagaccttatttatttgttctgtttgtcttcaatgcacttcctcatttttatctttatgtatttctttctgtaatgatttatatccatttcatccaaaaagtttaaaacacaatataaaatgccctgtaaaaatttatactaagttccctaaaacacttaagaaattcactgaatttttctaggcatacacttcattcattcgaatgaaaacttggctgaggaaatcatagagttcgtataactgacttctaatttcttcttccttatacctaggcttctaaagcccaggtgtgatataaattctttttttaaaaaaatacttttctatttttgtagagacaggatctcactacatggctgatcttgaactcctggtctcgagcagtcctaccacctcggactcccaaagcactgggattgcaggcttgagccaccatgcctggccagaaattgcatttttaagtgaacagttcagagccctgtatttttcatggattattttaagaattacgatgatgatgaagatgatataatccctaacactgcaacccattatgaagttaccaggggccctccaaaattttgctatcaaggcaacatcccttaaacaagttaacagagatgctctttttcagtgagtcttctggaagaatcgatgccagtctgcccttatgacaaacatatttcttaatgagatctgatttacgaagttttgacaattatgcttttcccctctcttactgccactttaagaaaaatcatgctggtaagctacactacaaaacttctggcctgcagagggctctataataccatattttcctagacaacacttgtaaaaaggaaaaaaaaaaaaaaagatacttgctggaagggggaaggggaagcccagaggctttataa

SEQ ID NO: 43478 - DNA, 1146 bp, Homo sapiens
aaataagttaatgtttgtaaaacagttagaacagtgcctggcacatagtaagcaataaaactgccagcttttattgtcctggtttctcatagaagttcaaacagtaagtcctcaaatgctgtgtttccattttgatgaagaggtttgattgactccatttgcttctgcactgcctgctctcacatgctccctctataacaccccagggttttctttggcctgtcatgcttctcttggactcctcattcttagctgtgtttgttgtctgttctgcccaccttcagcatctcccctctgctgcttcccttgccattccttccttgtctgcgtaccttcctgcacttttctcccagcagcctccaccaggttatgagttggagcctcacggacctgagcctgctgggtggcttgggaaaccaggctttgttcctccaggtttcaccctcctgtggctttactttttgccagatttctccaattctcattctgctgatgtgccaacccctcaattgtcagggcaaccacagcaacctcagccctctctgctgtccaaaatatgtcagcagccaggctgaacttccacctcatgccacagcttaactcctacagaataccctgttgtgcactgaagaatataccagcaagactgtcagacattgttagagccagtcaatccttgttacatttttacacaatgccttctcttctaagtctgcctgctgggttcatttggcatgggttaccccaaagtgagtgtaacctaaagaaattgtgcacacaagataaacgtagtgcccttggcaagaaagatatgcaggttaaaaattagcatttagaggttttttccccaaaggagtaaattctcactactggattccctgggtcctttcagtcttgtgatttaaaggagacacatgaattgattaaaattttccagtgaaaatgccattcaattaaataagcacaacaagtctaactgggaagatttcatgttctgaagtttgcgtttttctcttaggaggtgctcacagatgtataccttttccagagagaagaattgagggatttaaatgcatttttatgctgagtaaagtaggtggcaaggtagcagtatttcactctaacctcattttagacccccagtac

SEQ ID NO: 43479 - DNA, 1059 bp, Homo sapiens
tacattttaaaaagagaagaactgcccttcagaatatgaatccaaatgcagaaaagtgttccgtgaacaagaacaatactcagtaggttttcaaattgatggagctttccaatggaaactaatttgttccagcattgaagtgagcataattaacagagactttctttcttaggccgatgaaccaccaaaaaccatgccaacattgtaactgtaagcagtgaaaaccaatatttataagggggattgtgcaagagtttgtgtgacagatggacattttatcactgttgatgtttggaattcccttgaaaagtaatgcaatatcttgttatttatgaatgaatgaacaaatgattgtgcttcgccgactcagttttctttaaaaagtggtgtactaaattaatctttttctctgcttagcctctgttactttgtgttaggtagcctcatatattctgatgcaaaatctaaaaaaaatcgtaattgtgtttttattacagatacagatccacgggttttagaaaaacaagaattacagcagccaacctatgttgccctgagttacataaataggtaagccattttcagaatttattataacaaccttatatctgctgcttattgactttttaaacacatcttttttaacagagtggaaaaatgttttcagtcttaaaatatttgcatgaaactatttaaaagcaacctgtatatggaatgctcttgtttctttgttagggagaagttgaattgtaatgctctgtgcatatgctgcaaacatgactgatttataagctcattttggaagtactttatatgcagagttagaatatgctcttttgacttcatagggcagtttgggagattaatggatttatgttcgagtgaaccttttaaatcctgaggtgaagaagtactttatgaattcaaaacattgttgtaatatcagaatataataaattgaaataatttaatatcagaaagttatttagaagcagctcatcttttagtaaaaacattctcaacaactgaccccagctgtagagtaacttgagtttttac

SEQ ID NO: 43480 - DNA, 1034 bp, Homo sapiens
tttaatgacaactgtgcctttgttggtatgaataatgacacaaggatgaaaatgatgaatgtatttatctgaatatatcataagaaggtttatctttatcatgggggcagttaggtagagcttgacaaccttcttagtaaatgtttatgaaatacttttgggcaagaccaaaatagaaatcaaaactttcatttttctctctccctaaaccaaaagagagagagacattaaagtttaagttttaaaccaacacaaagataaataaaaactattttaaagtcaagatggtaactgacgacctgtacttcacattataaatagtataattgttcatagtaactcatgtacttttttttagtggtacaagtctcaatctgacaaatagataaagcaaaatttacaagatctttgcaactgtcttccaaaaggaatgaagccaggccttgaaaggacgaacagcccttacttatgcagagttatccataacaagtcacatttaccatggaggtttacctggtcaaggcatcgttgcttttctcaagaaggtagtgctgtatcctgtgtggtttcataaagcgctataattggaatagccagaccaaaattttccaagtctcctcttttggcagtaaacgtgggctgcagaaacattttagttgtacaagacatttaaaactgtttatctcttactcctgtccgcattgatttgtttgtattccatgcctgccttccacaagcctataaaacttccctaaactacagtcagaactgaggctgtgttctgtatctgtatatttaaactgaacactccttttcaattctttagaaacattctccatcctgcgccagcccctacagggctcttgctgcttctggtttgctcaggtctgcatctagaggggcaccgcctgcagagtccttgtctttattttctgaatctcatcagctcacctgctctgacactctgatataatgatgccaagttgtattattaactcttgttatttttcagattttgaaagtaaggatgcttt

SEQ ID NO: 43481 - DNA, 1031 bp, Homo sapiens
aaaaagaggctctgagaagtgaagggacccgttcaaagccgcacagctagttactgatctggggaataagaactcagatctcatgactcacctcttccacttttatctcactatgtcccctctttttccctgagtcattttcagaatgttttacatgagtcataaaactcgaccaaggttaaaatggggcctgctaaactcttataatactacacagatgaatcatgtcagcattgcttgagaattttattaagacaggtttaattggtcctgcctggaaaactgaaacataaaacaaagtcactgatttctctgactgtgcagatctcttggatgtgctctttaaattcctctgcttctgtatctcattgctgaggacatttgcaagaaaacataatatttattgtgtttgagtacatctagtcttgctgctttttcttttcctacatcataattgtctcttttcaggcagaggtggacagttaagcaagttctgcacgtacccaaataaactctgaacagattgattccctctgcaccccagtaagggtgtgctccactgtgttcccttgtccccaggcccagattcttcctaaagtaaactgggccactgaactgtgcccattagtgagccaaaagattggcatctgctgtacctagagggagtttgttctgtagatgccaatgggctgccgtgagggttgctggttattcactttctctggtcttgctatgtgcattctttgcagatgtttctccccatccctgaccatactttcctaccttctccaggagcacagcctcacccccaacatcccatacccctgagtgcccaggcagggttaggaacctctaggtgtctaataaagggaggtaaaagccactaacccacgttaagaaggtagctttccctcctttcctctgtttggcacaaggcatcatggcatttggggcaggccccagaataatctgtgtgccatgaggaagcccaaatgtcctccagagatgaccctacctcctccagtgcgagc

SEQ ID NO: 43482 - DNA, 1047 bp, Homo sapiens
ctgctacacacctaggctatatgctatagcctattgcttctaggctacaaacccatatagtatgttactgtactgaatactgtaggtgattataacacaatggtatttgtgtatctaaacatagaaaaggtacagtaaaaatacagcattacaaccttatgggaccaccatcacgtaagtgttccatcattgaccaaaatgttgttctgcagtacatgtctatatgttatagtgcataggagacaaccaagacaacaatgttttaaaaacaatccctcctgccaagcagttggttaaaggacagttgttactttggtttttaacataaattaatttgctttctgctttggctttagtcttcacacctccccagccttaacccatccattcttcagctgctgccatttccagtggtctttctaaaacttgatcatgtcaggaacccaactccccccagctccccctcagactcagaattcttctgtgcttctccatttccttcagggcaattgtcccactctagcaggaactctaaggtctttctgaatggagctggcagtagtctccccttccctccccacaccctgcacggtaatcagatggggctacttgttccacacatcacactccaccttgcctctttctgtcacagttggctccatctctttgaaatattgtcaccatctctcagccctcttaacgaactcctattgatccttcaaaacctatcctgtgtgctttcagcacattcttcctcttggttgtcactgtttacttctgtgcttccccaagagggctgcctcttttaggcacccagggctttattttccttgggtgaccccaccatctgtgactgtacagagaatgtgtttgagggcagcacttcatagggtgatctagatccttggtgcccagttcggcttgatctcctcctacaggagtagaaaggagccattctttgaaagtcaaacagttgtggaaatgactccctgccagtttcttagagaacttagtcatgagtagcatttgtgggtatgagaaatactg

SEQ ID NO: 43483 - DNA, 1057 bp, Homo sapiens
gctggtgactgccttgccatacactagttgaatatccatgtatcagttgttataaaggacaactgggattggttaaatttaaaagggtagattctttttaagttgtatctcttcaacttctataactactatggggtcagttttatgctagagcaaataagagagccatcctattaatagataaatggtattgattgagcaagaatgatgactgaaagtagtgctttgtatatttaagtagatataggattatatgctctgtggaaaatagaatttgaaggttttgttctacttcactaattggtttgaggcacatttacttttcagaatgaagatgggaagtttatacttggggaggtatatatgcaaagtgagaaatagacaaggattcctaccctaattgaagaaattgaattttaatcctggaaggagcataaagactaatggctttccttttttccttttctttttgctttattcaacagttttttaaaaagattgatgcagagctgctcggggtgtgaggtggggtgggaaaggtgaggatggaagggtcctgtgaggccctctagcatcttctcagtatgagtggattcagcctgtgtcttcttagccccctccagttctttccgtacctttccactcctttgctcaaaagccaagtgccagtgttatgaaatttaagaaaagctatttcatttcaaactcttattggttgaaatctgtcattgggatcacaacatattttggttctttgggatactttttgccattaataggaggtatgaaaatactgttttatctattgttttcttttgctatatagtagaatcaatttcttcaattatttcctgaatacactcctgtaaaagatttcttcctcctatctgtgtaattgtcatagaattggcaaggatgcagaaaaattggaaagcttatgcattgtttatgggaattaaaaacagtacagccattatggaaaacagttccacaaaacattatagaaaacatgttcctcaaaaaactgaaaatagaattactgtgtgattcaccaaac

SEQ ID NO: 43484 - DNA, 1056 bp, Homo sapiens
attcatttatttagcaaattgtttactaaggcgtgggttaaaggtaagattcagcctagcccctatcaggtaaaccctctttaatgtgcagtaatttctgaacttcagtgatgagggtcacagcatgatggatagctaggaacttgctttaatcttactttctattatggagaaattcagaaaaatagccaaaattgtgtcattgttcaggtgttccagaatgaatgtatagaattaacattttagcatgctctagaatagcagctcaaaatcttatcccctaaagacacaaaacattctgatatatatgtattcataaaggagagtacaggcagccctcagtttaagagatgcgtgggttctggaatatcgttgtaccttacttagttcttaagtcatggaggtgaggagctacagacttgggaaagggtttcaggagcaggggacaggagtgtgtgcatcaggaattgttaggatgaagaagacaaagagaagggtggtatgcagccacactggagattgtagaagcagcctgagccccagctgagcataaagccagatagctctcctgatttcatgagctgtgtttgcttttagtttaatccactagtttagcacttgtgacatggtggatgtgattcttaaggaggaaaaggtttataatgatttcttctgtgaaatttcatgctcacactcagataatacattcagtccagcctcaagaatttctttcttattgtgtgtgtgtgtgtgtgtgtgtgtgtgtgtgtgtgtgtgtagttgttgaaatagttcaaggaatgaagctgccacgtgatgttgccctttgagtcttgtagttaatttttatatggtaaagacttgcgctcccaggagtcccatctgacatgaggctgttctctcctgtcatgtacatgtggtatgaactgcctccttttactaattaacttgcttccttttattaattagtgctcatttatgctttagtttattgcgtgctccaggtttttttttttagagatactccctaaatcatattcccccacccctttatta

SEQ ID NO: 43485 - DNA, 1023 bp, Homo sapiens
gtattttactacctagataacaagatgctaggcaggatgtaaaacatttttggtaatttttcgaaatagttgcaaaatttgtaggccatcctgtgctgacttaacaacacatgttgggataggatcgtgacatttatggtctgcttgttggcaggagaaggtctgtgaaacattgtgcaataaacaaagtgtgtttcttccattccctcacctcactgtctgattgttctcctgaggcgcctccccgcttctctcacccactcctctactctacccaggttttcactgtgtttcttccattccctcacctcgctgtctgattgttctcttgaggcgcctccccgcttctctcacccactcctctactctacccaggttttcactctgcttacatttgtcaagaaccccagactatgtctcctggacccaagtctggctcccttctgtcctctcctatttaaaacctaccacccccaaatcttactcccaaaagattccttatcagcgcttagggagaaagtcagctgactgattctttggtcattttcaccaacaccacaattaatatgtaggttattgtctgccaggatctgggactatggagttaaagaagatccagtcatttccctaaaagcacttaacctaaatgtgatttggatatgctgcttgagtgagtttggactcaggatctacaaatgcccttcacacttagattctcagatctaaagtttagattcttagatctaaagttatataatgaataaccctatagaatgaatctctaatggtagaatttaagatatcctgttaagctggtcaagaaatgttaaaggctaagtgatctagtgcctctgaaattgtaccctgtttattccacctgccagtaaggtcattagcagagcagtttttagaggaaaacaaaaaacaaaaaaacttctttggttctcaagttcctaatctgtgaaagaagactgagttagatgataataagatctctttatgctttatcccacattcctgata

SEQ ID NO: 43486 - DNA, 1055 bp, Homo sapiens
gttgggcatggagagcagctcttctgccctttgaacctggtacagacccaggaaacctgggcctctccctcggtacctctcattacaggtgcatggctcaggctcatggaacaaatcagctgacttttcctttgtttcttaatgctagggagcaggcagggagctaaaggctgaaggaagttgaggcagttgtccttaagactatctttagtgaagtgaaaggtgcagaatctgccatttgtcatgtcaccttagaacaaggcaaaatccccagggtacagacatccaattgatgtaccatacttgatctccaggttaaaatataatacagctatgatgcatgagtctcattgtgaaaacagctgattggtgaggaaggtcagttctcactaaattggagagatgaggccgtgagatcaagaggaagcagcgctgagctgggagtccagatagctggctctgctctctgctctgccaccagctgtggtgctggttaagttactgggctcttccatcccctctctgccttgtcagtaggcagattggatgatgtgtaagttcctcctgtgctgaagatccttgaactgaggacctgatttccagagcccagggaacatcttagaaatggagtaaattacatgagattttcccaggggaggccttgatcacattttgtacaacattcagtcatgtatggttgctatgataccaggcagcattttgaaaccatacacagggatgagtctttcagtcagtggcctaaaccatctccctttgctgcagagccagcttttctgcaattccaggggaaagtatgggcaattgttaataccccaaagattttatatgattttaaaacaaagtggccaacagtgtcaacattgtttaccagtgactcgtgtcttttttttcctttgtcctcctccttttttaaaaaataacatttccttggcctgttaatttctctgttctatgttgcttgtatggaaaagtatctcaaaacctataatgtaaacctctcaatttgctttacttttcctgctcttgagattttc

SEQ ID NO: 43487 - DNA, 1058 bp, Homo sapiens
caagaatttgtatgtctggagatacttatctcaaaagtgaagcaatgccaatttacattacaagacctgactttgggaattgttatatgctatttaagcatagagttgcatatagccatatccataagtaaatatggtaacaattatttgaagtgaactttattcttcagcctgaacagattatattctatagtaggcttatgccgttttgttaattgcattaattatttattacatgctgccatttcgcacagttcagtgggttgtgggaagttgattatagaagtttgtttcaagtcagttttacaccctggttgacaaaatcatcacactttctcactgaaatgaaagagctggaataatgcttggggcaattataacagatgcaaggttaaggtgcaaactgtgtgtgaagcccagccaccatatttttaatgagatccaatttatgcaagcaatatatacagtgtttcctttattcgtcttctcagaagttcttcattttgatggattttagaacagaagacgtgtttgattcagacacgtctcccagacttcatactacgatgttaaacttacaacatcatgaatttcttctttaacattttctgccttctgacaagaaaacaaaagttaaaatgagctcttttgtattgttagtagttccattacatatttttggaataagaaatgccgagaacttgttaaacatggaatcgcttgaaacagcaggatctctcctgaacccgagcagtaataatgcaaatcgaaagcagcttcctcctctgcaaatttgcactttttctgatcacagatgtgtccttccatgttgcctgtctttgtaaaccaagcatatttttgtcatcacctccaaaccctttaatcagctgtaagtgccgtcactggatagaaggtccgtccttgggtctgtatgtgggtggcaaatggtaagtgaaaggtttcactgaaatcttggcagattaggagctggttaaaaatacttttatgggacatactaacttttgtgtattaatatatttattgaaaaaccaaaatct

SEQ ID NO: 43488 - DNA, 1050 bp, Homo sapiens
tggtgagattccaaagtgtagaagttttaacttttctaagctggaatttattagctgtaaaaaaaaaaagaaaaaaaaaagctttttagtcttgctggaagttgtgaacagacaatgaaaatttcatagaattttttttagtcagactgaatacatatttaagaaataagtatcaaatgctaaagaacattggaatttggggatggagatgtggccgactgtcatcataagagacaagatactggacatttgaacaaagtacactatcctctttgaaatgaagaggaaggtttccattccatactacaaataatccccacattattctaagtcacattggctaacatgccagcaataatagaaagtcccaagaaagtggtgctggcatccctcagtcctagtgctaactttgccctgatgcttattaggaaaaggtagagtagcccatggatgcctatcatggcccgagagagagaacatttaattcagaacattttgctttgttttatgaataatcccagactaggagttgggcatgactagcggacctccctttatggactttcttgttgcactggaggatggtcatagttctgtcctcagagtgttttcctgatggtcagatgaaatgttgtgcatgatatgcttagcacagtgccaaacatgttgtcagtacacagtcagtgttagcggttaccattaccatcgtaattactaatcatttcttaccatcaaatgcttagttgtgagtctagcattcatttctcctcagtgggacacattgtgaggcatcccagagttcaaaggagctagaatctagttgcactttagataaaggagactctgaaataaaaagtgaataatgttccattctgaaccagaatttacattttactggggagattatgattgagtgctatttgtttagtaatgcctcttggtggtcgctgtatacctcctatgtgccaggcacttggctaagtgctaaaggcataaagatgaagaagacgtacttggtccttgcactcaggaagtgtcttaggttgagct

SEQ ID NO: 43489 - DNA, 1028 bp, Homo sapiens
cagacttggtccagctattctttggattcttcttttccagacacacctttgcttctcagaatttcagcacatttttaaagcagtgcatatggatggtggtcttgtgattctgttttcttttcctttcttatacttctttaagtttgagtctagagtgatcagaatgtgaaggcacttctgtgatgggttaagttaaactgagccattttgtaggacactaatcatgttgctcatagagccttaacttacaggactgtaaattaaacttgcagaatcacgcttagcattgagaagttgtctgagatataattccatccatctgaaagtacctcttcctgctggtaaatggagacctcctcatttaatagggattatatcttgttattattatatatatatgtatatatatatgctctacctgaacaatcagtagtttgaaaaataaaacttttttgatttggatttgcagtgatttactttatacaagttttaggcgagctcagagagatgctaatctaaaacccagagttcatgtaaggattgtggtttatagaaatgctcttatgtattggtttagtaatcctggtttatagtttattttgaacttgatttatgaacagaagtattactctcatttattaaggctgatgggtttctctccccaccctctcttcagaactttctgctttgtcctttctaataaatttgggagtgtggaacacactgtccatgattcttccttccaacattagattttagactaattaacagaagaaagcaagcatctttcaaaaacttgactttaagtacttgggtatatataatcaggaccattaaaaagaacacgatgtttagtgcatctctcttctcttagtgagcacagaaacttctcttggctgtttccagtgttgaggcaggccaagtatagctccaagcactgaaatcttggagactaaaaggccatatctttttgtaggaaagtgaggaccccttcttgttcatcagttctgtttttgtcactggttagc

SEQ ID NO: 43490 - DNA, 1044 bp, Homo sapiens
agttcactttctctctgccatgagagtcctctggctgtgcttgacctttgagtgctgttttatgtcatcgtgttcttttgcattggaggtggtattgtgtttgtactagttctgatattttagcagcagtatcttatgattttgtttttcagtatgtatgaaaattttgatttctcatatttttatataactatggagtgtatgctcactatagaaaaattagaaaaacagagaagcaaaaggaaagacaaagctgttgattgtagttaaaccactcagaacctaccatgtttacaaatcagtatatgtcctttcagactttttttcaaccacatatgcagacattttttttcaaaaaatgaatttgtgctaaatattatataccccttttcaccaactatgtataataagtatacattgttgtatttttttctcagatagtgcctggatatttatgatatggtttgcaaggtcatggtgataagaaataacctagggactgccaatgagaacaagcccagaaatcagagagtgatacttatgggaatcgtttctattcacagagccttaagcatgctctgggcgctatcgccaggcattttattcacaatatgtcttttaattctcacaatagtcctgtgaggtgtagctgttactgtttccacttttgtagcaaatgccctaagagataaagacatttgcttgtggttaccttgcagcaaatgttggagcagggatggatttggtccatctcttatctctttctgtgtttcagatttgagcccaggctaagctgtccctccagctgcctgcctctgcattgtcccttgggggtgctgggcaatcagggtggtggcacaggctgggaggggttgttggtgccctgcctcccactcagggtggtaccactccccagttctgccactgagacatgtctgatgaggcaccatttattcctctgtggttcataagacaacgtgtagaaaattagcattttatccctctagctgtattctgttaaaaatatatctaaaagcatcccat

SEQ ID NO: 43491 - DNA, 1049 bp, Homo sapiens
gaataggcactgtttgcactcttcggtgatgacgtttaatcttttaatctccccttattcttccccatgggaagacaaaaatgggaagattcagataattatttgtagggttggacattgagtgggtctgcgaacctaatacgttccagaatcctaatgttgtaggaattctcagttaccaaccttggtactgaaataaataaagtaggagggaggtggagaatcacaggtcaagcatgaataaggccacatctggcagaactgggacatatcttcaatacaacagtgataatagtaacactatccacatgtttatctaagtgacaaattattaagtagttacatttacattccttattttgtgggcttcttatgtaactcagacatgtaagggcaggttgttaaatcctatttgtttattcagtaaacatttattgagtgcctagtatttgccaggccctgtcctaggtacaaaggatacaattgggaacaaaacaataaagaaatcctgtttttgtggaatttatgtgttagctgtagggagacagaccacaaataaatgaagtgagtgaaacaaaagttatgttgggaaatgaaactgccatggagaaaagtaagataaggaaagtggagagggggagtgtggggttgtcacagtactacctagggtggctggggagtcgccccagggagaagacatttgagtaatgacctgcaggaagtgggaaggtggccagctgggagaacagcattccaagtagagggaacagctcggactggggccctgaggtgggagcctgcccggtgtgctggaggaactgcagggaggccagtggggctggagtgagtgagaaagagggcagggggagataaggtcgtggtgggcacccacgtaggccagtttgcgcttttgaggcatttactctctgggagatggggagccagtggcccttgagaagaggaggacaggatggatgaatgggtgctttcatagtgtgactctggctgcagtgtctcgagtagactggaggggacaagggtggaagcag

SEQ ID NO: 43492 - DNA, 1027 bp, Homo sapiens
ttgttctgctttcatattctcctgagcttgacctggttcagtttctccctggagaggctcactattttttctggggttgagatcctcgtcattcttttgacaagagatacagaatcatcatttttaagaggaagtttatcagcaggctgtttttaaaagtgagttttgtgcttgatacaaatttttatgatgtttgctttctcttaagcactcgaggtctgtacggtcagccttctttgcctcatttgctccccttcctcccctgcctcccatcttatttgactgctaacctgggcgggcccaccattcattcttgtttgagacagatgaacacagtactttgtatgccttatgaccagataattcaagctgacagtaatcaagtttggggctaattatcattaaaaggtaatttcattgctgcccataattgatcttatcttaaaccaattgtagcatttcttttgtcacatgatttaaaaatttaaaaaaaaatgcttttggcaataaacttttgaaaacagattttctacactcagttctttttaaaaccaactttacaaactttaagtgtgctcttattaatgtgatttgtctgctttgtaatattgcatattcaaaataaaaagaaaatggagacagttcatcactgaaatggatgttacaaaatcagcatctggtttgaataatgagtcttctggtccaagttttgcttcagtgaatgaaactaatgaaactggcctccattgttatgtcagtgacttcacctccactaacttttggtttctttccgttgccaatttggaggccactaaggtttcttcagaaagttctttcctagtggtatttgttctaagtaactctgggacagccaagtatctgtcaccagcaggggagaggcgaagacacctcatgatcataaaatcataggtttgggacgtttcaagtatcctttgccaccagtcaagctctggaaacaaaagcaaagtgaaaaaacagctctagagttggaacgattaaaaattag

SEQ ID NO: 43493 - DNA, 1063 bp, Homo sapiens
tttttgtgctcctcttggcagcacatatgcaaaaataggaaagatacagagaagattagcatggcccttatgcaaggatgacacacacatttatgaagcattttatatttttatccttatgaaacactcaaagaaacgtcatttaccacttttccagctgcggtggaccagacattttccgatttgcctgttttccctgtcctatttttgttgtaatttttttttaataccgcacgtactggtgttcatataaaataaacttgagtaaaccagaattctgtgagttttgccagactttaattgtgttgtattgcttgctttttaaacaaattaatagtgaaaaataatttagcgacctcccagttgtaaacttctaaatggcagtttgtgtctgtatatctcttcaagtcaagcatctgctcaaaagatattgttgatgatgtgataaatgcagtttcatgaaacttggcagttcccataaataattgaataacataggttgtatttacctctgtagtgtctagactagaggattagaaccatgagtttataaaaatctaggttgctgtctacacacaaatagaatagtatttaaaattgtgttttccatgggataatgatgaaatttttattgggccaagtgggtagctatctggagaaaggtgaggttggtttcatatctcataccattcagataaactccaacctgatcaattaattttatatgatgaccagtgtcatattcaacagagttatgacaaagaaagaaaggaaggagaaatcagaaaggcaattcagcaaatgtctagtctacctcagttggaaaaaagtgaaaaatgatatttttaagaaggatttcaatatacaaatatatttgtatctgcataaaatgctgagaaactggaagacattcctttataaccttgaagtaagaaggactttttaaccgtgaatcagaatccagcagccattaaaaaaaatgataaatttgactaaattcaaataaagtatttttacctgattaaaaaaatgccataagcaaattcaaatgacaatcagagaa

SEQ ID NO: 43494 - DNA, 1696 bp, Homo sapiens
tgcttgaaccaatttcagctcaagccaggagacacccaaaagagctccagccctgtggtctgggtcagcagttactgttaggctgacctgggtcatggtggctgggttctggaaaacaaggttcagatgttcacataagctgagctacagagcatgttccagacatggtaggagcctggattgggtggaagttgcccgtcctatttgcaggggaggaaggggaggaaaaactgaaacatgagtttgggagcgcattagagaagactccctggcagctgtatcactgatggcaggacttgtatgtatttggttttggctcagacatgaattcttacttctttcccccaagaaactaaaatcagatagaagatttaaaattggagcttagaatggtatgtttctcctgcttttaacaattcatttaaacagaaataaacaaggcctcttgctggctgctgctaggtagaaagtctctatacttcaaagattttcataaatgcaaggaatattctttgatcttgaaaacttttctttttatgtgaacattggcaccaaactatcctctaggtgtgatggcagcttgggagagaacttttgtcagcttccaagattatgggattcggctaaaccaaaagactgggacattgaaggatgattataaactgcgggtgcagatttattgtgaataatgggaaagctgtgtaaaacaacacctgaagggtgtctaacttggtcaacatggacttcagaatctatgcccaattaagtgctatcactttttctaggccccacagagaaatgtacaaacatatgagacattcttatctacattggtcacgtgtatgcaactacgcctctgttaaatttgactttcattattaggggatccaggaaacagtattgagcaccagttgtcatttcagtgagcacaggggtgggatgaaaataggatcacacatttcccccttgagtgtcatacgaatagtggagaggaaatcacatggatacagaaatggagctcatgttaaaaatcttatagcaggatataccatgctacatctcacagctttatagatgattcctggactctaccagcctgtttcaaattgaacgtctcatatgattattcttactttgcgcttgtagatccttttaattgtagtcccattctacctctagctgagggtaacagctatctcccttagagagctctctagcttccagcaggggcagctcactggccagaggggagggtaaagcattgatatggcacaataagggaacctccggatttttttttccttttctttttctttttttttcgagacagtctccttctgttgtgcggtagtgcgatctcggctcactgcaatttctgcctcccagattcaaagggttcttcagcctcagcctcctgagtagctgagattacaggcatgtgccaccatgcttggctaatatttgtatttttagtggagatggggtttagccatgttgtccaggctggtcttgaactcctgacatcaagtgatccacccgccttggcctcccaaagtactgggattacaggtgtgagccaccatgcccagtggaacccctggatttcaaggcgtgggggtaatatctgggcctagggtttagttctggtaagtatctgggcttagggtttagtttattagcattgtctaggtcccaa

SEQ ID NO: 43495 - DNA, 1036 bp, Homo sapiens
attttaattccttgatttaaaaaaaaatcagtagttcctgtttaggcattctttcactttatatcttaaagaattgaggagtggtggaaagataccgatagtgttattagatgtaaaaaacacataacacagtaactgcatatactctgatcccactattaaaaaaaaatgtatttggaaacagccagcacgttatctgggaaaatgtaatgtaccaacttatctctggatgatgtgattgtgggtattttatactttctcccttttgtttttctttcttttcttttttaaattttttataatgaacatgtataacttttattaaaataaaaaattacttattaaaaacttactttaatgagagacatacagactttttctcaactgctttagtaaacacccaagggaaaaggaacttgtagttcttttggtatagcattgctttgtttccctaagttaaaaagccctctctcattatgccatattaataccccttgaaaactggaaaagttaccatgtagataagttaaacacaaatccctgtatgaaaatcacctgggcagattcttgggccccagttcacaccaaatgaatcaacaatgttcgggccccagaaatctccattcttattaggcatcacaagtgattctgatgtgcagttacatttgagattcatccttctgcttgtagatttgtccatgtgtagctgtcttataatgttaaagtattttctaggctcttttttcatcttcagactttttaagtaaccatacacctgcataatatccattttgttgtcaggaacactaagagattatatgattctctctaaaatatgagaggtagagggagtttggggggtattcacagagggtcttcttgtatgactaagaaagaccctctgtccaatgctagggagctcctgctgtttaggatggagacctgacagctggccatgaagggtcaaggaaaagagtcttgcataaaaacagagaacccagtgattctcagagctactctcagaaggctaccccaa

SEQ ID NO: 43496 - DNA, 1083 bp, Homo sapiens
aatacaggaagaggaccagagatgaattggttgataatctccatccacctagttacatagatacaaacagaattttatgtttataccacctacttagccagaataccaccagcttgtttataagtattttgttcttggtgttgctgtaaatgtcactgcacctcaccctgaaatgagtttttaagaggtattttatagttcatgctcttcactattgatcagacttaaaaagtaattgcctcttttgaagctttcttttgcccttgaaaacttcttctccgtgttctttcaaaacagtgtttcaaaatgccgtccccagatgtccatgtgtggggggcggttatcagataagattttggcagaaagtcctaagtaaagttattttgctgtaaatccagtccagttcttattaaaatagccaaagaacatgtggctgtgagcatgtggcaaggtgctgtttgttcttataagcaattaactgacataagaacaattgtaaaactagtaacatgtagcaacccttacatattaaacaatatatttagtgctacgtggtgaaagctctgtctcatatctgccttttagttaatgtttgtggtagcaacacagcctgcttgttaggtatcaagccagttgaggagagagggctccttagttttgcggaacacagactttgggaatagaactgtccatgtttacatgttcacatttaagtttcactcaaacctgtgtctgtgtgtatgcaatgtaacctgtgcatgtttgtatttcaaatagtctatatttctcaattgtcatttaggctgctactatataaggaaaatatagcttccctacaatcacccagttatcacttagggaaattgctactgcaaacaggataggtcatagtttgagtcattttaagtaatagtgcaagtataatttgtgcattcatttggggtctgttgagcacgtgtatatataaagcacaattctaggcattcgggaggtagcaggaatcagatgtggattccactcctcaaggagcttatagtccaagcgagagaatatgtgtatacataaagccttaatacaaaatag

SEQ ID NO: 43497 - DNA, 1063 bp, Homo sapiens
tctgggccaggtgcactggctcatgcctataatcccagcactttgggaggccgaggtgtgaggtcaggagtttgaaccagcctgacaaacatggtgaaaccccgtctctactaaaaatgcaacaaattagccaagtgtagtggcgggcgcctgtaatcccagctacctagtaggctgaggcagaagaattgtttgaacccaggaggcagaggttgcagtgagctgagatcacgccattgcactctagcctgggtgacagaacgagactctctcaaaaaaaaaaaacaaaaaaaaaccaccaaaacgaaacaaaaaaagcaaaaaaccagaattccaaagtgctcaggtttcaagcattttagacaaaggaaactcaacctatagtagattaaaagcaagaacagcaacagtatgactagtgatagttaacattataggaagaagatcagaacttctatttttaaatggcaatactctgggaccatttggaatagggagacaattgtctgccatccctgaggacaactctatttaagggcttatcatgcagtcagactgttgataatgatcactctgcctcatcaagtaaacacttgattatattcagtagactctgtttaagaaggcatagaattagcaccttttaatacttaattagtacttacagtacttaataagataaatttcagttatctgaagattcactcctgtgttacaccagaacaccctgaatcttcaagtgccatgggatagctcatgtcaccctcacagtgggacaagttacagatcatctggtatatcactgttccctaaatggaaatacttactgatcaatcgatcaatggggaaacggttttccttaatttaatgttgttctaatcttttacagtcaagaggtttcttcaagatggtggcctgtcatctgctggcttctgctccttagtatggctaggcatttccaactctttgtttaaattcttgttggcttgcctagcttgaccctcctgacaggtgctatttttgttcctggccaagtggccacagctgtgttgacatttctgcc

SEQ ID NO: 43498 - DNA, 1030 bp, Homo sapiens
tctctaaccttaagaaggaacttggtaaatgtgtttcaaataaatgaatagatggatggataaatgaatgaatgaatgcaacagtttcttaggcctcactctgatgataacaagtcaagtcaagaaatactcagatacgccttctcagtagattaaaagtccaaagactaaaccgtatgcttaaagatattccctggagtctatttacaatagcaaataattggaaatatcctaagtgagtaatgatgagagaggattggttcaataatgggtacattcacttgctctgctatgcggcctctaaaaaattatggtgtgtagcaatctaaagaaacacgtgggccaggcgcggtggctcacgcctataatcccagcactttgggaggccgaggtggatggatcacctgaggtcaggagatggagaccagcctggccaacatggtgaaactccgtctctactaaaaatacaaaaattaactgggtgtagtggtgcgtgcctgtaatcccagctactcgggaagctgaggctggagaattgtttgaactcaggaggcagaggttgcagtgagctgagatcgtgccactgcactccagcctgggcaacagggtgagactctgtctgaaaaaaaaaaaagtaagaaacatgtgataaagtgacataccacattatatatataatgcacaaagatctgggaaacccagttgcatggggataaaggaaagaaagaaatttaccaaaatgtaaagagtggttgtgctatgttaagagtgatttctttttcttttcttttccttttttttgagacagggtctcactttgtcactcaggctggggtgtagtggtgcaatcagtgctcactgcagcctcaatctccccatgttcaggtgatccttccacctcagcctccctgtcccccctccccccagcccactcccaggtagctgacactacaggtatgtgtcaacacacctggctaatttttttttgtgtgtatatatatatgtatatatacttttttttttttggtag

SEQ ID NO: 43499 - DNA, 1075 bp, Homo sapiens
gcaaccaaatttagtaaaccgcaagccaattttatttttagttttagtgagcaagggcagatagcaattgcaaatatcttactgtatctacttctaagcttttacttttctttttttttaatgttttgcctttttctctccctagtatgttttgtctattttgaatataattgtttttaggagaaaaggccattttttccttctatcattgagagccccctttttttttcaatattgtaggcatcatcttagtaggaaatagaatatatttataatcaatgatgttacagaaattttgaaactgagaaattaagtaccataattaataaaaggtaggaatagggaatcataaataattatttagtattaattgtcagcagcagcctaaggttgctcagtgatagattaataagatcaagcagaaaaataaaggatcccattggccagagaatgtgagtggaattcctttttcacctgtatggcacaatggttggcattcaagagacattcagtaaatgtggtttggttagttagttggttgattgttgaataaatgtttgagtcctgcactcactccagaacatcagactattggatatgaggttaagtttgaccagaggatcttgaagaggctgtataatgatcatatcttaagtactagaagagtcattagtggtctcaaacccatctgctctacccattggagacttctgtagggaccctgacagtggccctctgccatgcttgaacattgtgatcactaagggcttatttcacatcagcttatttcaggtctattctgttgctggacagcttagattatgggatcaacttgtgggattgtagcaaaagctcatctgcgctttgcagattctttcttaaatagtcatataagccagttaccctcatgggttgggatgggagggggtcagtcaaggaggacagcagtccccaaaacttcggggaggctttgttaggggccatcttcatgtgtacctcttcatcccattatgaaagtacccagggactgagaattcttggcatttcccagtgttctccctggatttttcatagt

SEQ ID NO: 43500 - DNA, 1095 bp, Homo sapiens
aaaatagacaaatcatattttggctccacatttattctagcagacagtggcagactctgccaaagccacgaagtgactccccatgcaattggccaggtgaccaccaccaccacacagagcaatctcagtccttgactggttcctctgtgtgaaaaggggcctctacagccttgacccagtgactttcagattctgaggaaaacagacgcttgatgcctgtccaaagtaaacagagccaagagaacctttcacaagcctggttaaggatcgatggttccacccaaatgatttagatgatttggtgtttaagtatgttgttgcataactcttggcagccagagataccagtgtgctggagtgagtggcaatttggattgaatgaataaggtatctatcaagggtgtatgtatatgtacataccagctactgtgatttggacattacctacattagcttatgtaacctcatagacaccttatcaggtaggtacccttatacccttaagataattttccagatcaaaaagcagaggcattgtgaggttaatttgcacaagatcatcttcccaggaagaagcagggttagaatttggacccaggtatttggttcctatacttcccatgtgcgcgtgcacacacacacagacacacacatacattctgtgctgtcacagcctagatgtggttgtttctcttggtctcttctgcatgggtcatttcttgtatgataattctgaatttaggtggaggttgtagttgctgaatgggcatgggtggccaggccctccatactgtgttcagtacctttgatgattaactctgaaagggaagaaaggattacttagtgcaggccagagagctgtaaaaggttcctaaattactcatttcccctctgaatttctcctcttgcctcgaaaactaaaacacactttataggggaagaatgaagaccgtataactctgtggcagcacagtttggtaattaatggacttgtgcctctatcagaagagtgatgtattattccagagccctgtagaatgagttaaactgagagtgaattatttggtttgactgatgtgtacagtaactgaagat

SEQ ID NO: 43501 - DNA, 1086 bp, Homo sapiens
gtaaaggctttgagttagtttcatgctttacctttcatcagacgttttatacacccaaggaagcccctggtgtctttatatcagaagagttgcaaaaagcatggagactaattttcatggtgtgtctgcaagacttaaagggtatttaaagaatatatccttctaatattcttctaacacctgtccttttacttgtctgtcaggttgtgaccatgatcttaccatttagcttgttgacaggtattgtaaatgtttcagcttaagtcactgatcccaaggagcggtcactctaggacaaaaagttcagctgttgtaacaaataggcccaaccttacatgaactaaaggctcaagaagtttgtctctctttcacataaggtagaagctggattctctggggcctgaggatgaaactttgtgttcctgtagagggaaaggaaaagagtatggaggagtacacatacaatatgtatggcctaggctattagtgataacttcttatttccacttttattgcattagtgagaacttaattgcatggctacatggaactgcaaaggcactggggcatgtatcctcagcatggcctagctataattctattactgtagaggaaaggaaggcctgatttgggtagacagttagcaagttcctgccttggaccaaataagtgagcctgctgttaagaactttgcctttcctttgaataggtaacatatagcctaatggtttaatggagagagtagatggttataatgacaattaatagcaattacaatttattgtgctgcaactaagtactagggactacaaaacacaattgaatgcattttctcatttgaccctctcggaaaggctgcaaaggaggtactatatattatttggattttgtaggcgaagacactgagccttaaggagagtaagtaatcccctcaagatcacacagtcaggcctgcttgactccaaagccttcaccatactgccatgcgaatggtgagattcttggggaataaaggataatcatatactgcttctaagtctggtttttatagctagttagcagcaaaggctgtcagggaaagcagtg

SEQ ID NO: 43502 - DNA, 1210 bp, Homo sapiens
aattaatacacatactgggttcttttcctggattctgattttaggatgttttggtattgcggcttgtaaaattttgtgatttgttgtgatttcttaatctcaatagataatcacttttgtaaacattttataacattcaattttttttcataagaaaagtctgaatctgcaggcccacaaaacttgggtctattccttgagctcccaattcgggaatcattactatatgtgccacagacagtgctaaataatttttgtatagtatttcattggccctcacagcaagcctgtgaagtagacattacccccatcctgtaagtactgccttccgctttggagttaaatatgctaccatattagttaaataacacacttagtgaaatatgaactagagtgtttgtttatattggtataaaacagaaatatttttcttcaggacagaaagcctcttttacctcaataaatatcattattttaatgggtcttcccctctctgtcctgtagcccctgcccacagctgcaccagcgggggtgtgctctgaactgtgtggtcacctcctgtgcactgtttcctcccccagaaactcagggtcttgtcatcatcctatcctcgtccccaagacgtgttttcagaaatggtatgaaaataaaaattgagaagtactttgggctgtgaaaaaaataaattacaaaggtaactttggacagtgaaaaacatctttgaaattaatttctgtaggtttgcatcaatgagggctgtatatttatatgtttatgtgtttatggcattcacacaaatatccattatgcaattagtccagtatggtttatattaagggaatctgaaagagactctttttaaagctgatttaaaaaggaaattgattttccttgttaaattgccaggggtatttggtacacaggaggcagaggcctgggtggtgagaagcatggactgtgaagctatacagaattggattttgaatcctcctgatctcactaacttgagcttttcaaacttgggcagctcttacagtcttatttatatgagatagtaatactattatttattatttggggggatcccgagattgattttcctttcacagtacctactggctagttgctttaatatgcattatgcagtgttagtcccatgcgacgcaggaggaagccaggacacagagcaaagaacagccaggaaaatgcc

SEQ ID NO: 43503 - DNA, 1017 bp, Homo sapiens
gggcccacccagcactttccagggccctggaggagccctagcagtatacgtagctgggccttcatgggatcataactggtaaaattggaagaagattttaagcaatcctttaatgtttttctttctcattctgacttccctgctgtcacatttctgtttgggtttgatgacattggacttgaaagtgcttttgagatatagctagggggaagtcgaattgggtccacattttgtttgggtttagtgggatgtatttatgcagttcacagtcatctctgtgtcaagttatccctagccatcctagtgtagaagttgcttcataggatcgccacccaccgtgccagcttacctggggtccttacacaaaggggagggtcagagagagaattgcagtgttaacgggtaccatgacatctgctgtgggatggtttatggtgcgtggagccaggtctgtggagaattctttcacttgttagatgtgtaaaattctacgtggaggattcagttcttatctaagtgtagtcagtatgaaaattctcttcttttaggaatatactcaataatacaaatatactattagaaatgcaccatttttaatgggaattctgtgtttaagattcttgttcatttgacatgaatatgcctgataccaaaaatactgacaacaaactggttaatgagtatcattgataaaaagaatatttaaagttagtcattgcacgagaaaacttgaaatgtcctggatttttatggctcatatgtgaaagaaaattaagagatgtgattacaggtttgacaacaatcctaaaaatgtatatgtcattgccaataaagaactataaggctaaaagtaacttttctgaattgtcaataattaggaataaattttgatcacccatgcttgaggggagattgattcatctttctgccctgtggaaaatgatatgaatataagtcattgtgatatgaggattcatcagagtatacagcccaaaagaagtatttatagcagtgtgt

SEQ ID NO: 43504 - DNA, 1343 bp, Homo sapiens
tttaaatagattggtcagggtgggccttgctgagaggctgatatgggagacaaaacctcgaaggaggtgtgagagttagtcatgaggacattctgggcgcaggcagtacacaggccccaaggcaggcctgcagcacttgaatagaaacacaggaatctgacccaattcagttattcatgtgatcgtaccagactagcaggtcatttagaactttcctcagatgttaggatcctcagctttgctattgaaacatttccctgcaagggcccagttaaggggcagagtctcattgaccaagaatggcttgcattagctatgacttggttcctgaccccgaatatcaacaggtttcttgttgtgagtctctacttgttagtttcctcatctccaaaacccaggtaataaacctacagtgcttcatttcatagtatagatttataaaccgtctaattaataaaggtcaaagtttctgtaaaaaaaaatcagggcacttactatcaaaactgtagaatttagctcctaagatgatttagtaaatatttgcattatcttctcaaaggagcatcacagtgtactaaatagataagctgtgcaatatgtcataggtccttattactcccacttttaggtgagcaaactaaggtacagtttataattgcctgagctttcgtggctgatgtgtatgatttgagatttgaattccagacaggtatgcaaagctaagcctatgccagttgccaattaggtgaagaacgtgacagtcccctcctcacctcccctcacacgattgactctgtttcctcctttagaaagtaactgaactcgagatgaaggtcatctgagcagtggcatagcgaatccagcctgcttggagttgaacacacatgtctgccacttgtcccccttatgaccaggggcaaattaaccgtactatgcctcctctgtaaaatgaggatagtagcagcatccatctcacggagtggttagtgaggattaagtgagataatatatgtgaagtgtttatctacaataataagttgtctacatcatctagtttcttgccatttgtgtatctgctaaataaatatgtaatcctactgtcagagtctaccttcgagattaacatgggttgtatccacctattagtggtgctgttttgggcattttataactatgacatcatcaggctcttcctgggaaggactgagaatggaaaataggagactcctcaacagtctagtgctggtgttgcagcctctggccacgttctcttttgtgtggccagaggcactttacaccctggcagaggcatttgccacagtggactgggaaagtggtgtcaa

SEQ ID NO: 43505 - DNA, 1021 bp, Homo sapiens
gggtaaactgaagagagagggcactgatttgtagtatttgccaatttccatagtgtaaatactctcacgcagccaatttcaagctaccaacttcacaccactaaacatggagttgggcagcaatgtgcacagttggttctcctgatccagtgagggagtgcccacacactgctgctagaactatcttgcattgctgtctgcaggaagtaaatctttagcaggttagccggctcttgtttccatggtacacagaagatgatgagtcaggatctaagtccttgcagcactcctggcgagagcatttactgctataacctctgccccttcctcccccactcttattctctcttccaaaagaaaactacaaatgtagatcataaagctagatattgagtaagtataaataatgaactggattgtgctttttatcctcttgtggatatcaagtataaaaactggacagggaaggagagaatgaggatgggaaatcttgattactttttaattgcatcaaatcctgtgtggtaaagtgggttcctaaaaggggaaaaagacagaacagttttttgccattctgctacgacaagtaaggtcttgctttcctggcatttctgtgtaggaagaagagggtgtttggcattgcatgtggtgaaaggggagagagggtggagggaaagaatgggatggatcatggcattggcagggataaaactcactgtagacacagttaagttgagtgcagtgacagaggtttgctttcacattcaagctgcttcattaatttcattggggccttttccaaggaaagggaggattcataaaagggaaatcaaagaagcctggaaaagaaacatttccccttctgaagactgtattataatccttttttctgaaaaagtacagtaatgaatgttatatttattagtgctgtaatttctcctcttcacttcttaaagggaaaaaaatactctgtttgtcataaaaactctgataatagtagtagagtgaccactggttgagt

SEQ ID NO: 43506 - DNA, 1014 bp, Homo sapiens
caaggagtgtcatgattgttcaccagttgtacacaccaaagtgtcttggaggaaacagagtagacatgctgagataatgaacagttcaaaacaattcccttcaaactaaagactacactgtttatgtcagctaaagactatttcctttctgtgttgcatgggagaaaaaatgagaaatattctgggacacaaatttataaaaggagttgtagaaatttcattacctcagtgctgactagagcatcctctcctttaaaaataattgaattcctggtttttgtttttttcccttctcttaaaaaccacacagcttgcttcctgaagacaaaggaaataataaacaatagcaactcccaatttgactctgattatttgccaaaagtcttcttagttcatgtggttctatttcattagagaggaccgattagcataagaagaatgcttctaaattaagctacccaaatatgcacttagttagtactctgggagctaatttattgtattatttaaaatataaattggctagcaaatctatttattgaggtgtaacagctaggcaacaatgcgtaactttctcttggctgttgagtggtttttaatcatctattgaaatttaacagagagccatttcattaaatggaaagcggataaatactgagaagtctgtattttagagtattatccacacatggagaatgatatttgaggaacaaagagggaattgggatttgctttttaaacagtaactttttgttgttttaatttgaagtgtaaccaaagactcacaaaatcacttgtggggatgttaaagcaagaaataaacaaataaggcggaagatggagtagggtagagaaatagagggatggaaaaaattgtgttaagatagtgctacgttgtcaattagactaatgcagtatttttgccttgtacagttttggggttggcagtaaaaactatgtaccttgttttattttaacaaatggcatcatgaaaatatcatgctatttggcatg

SEQ ID NO: 43507 - DNA, 1044 bp, Homo sapiens
cctgtaatcccagctactcgggagtcagaggcatgagaatcgcttgaacttgggaggcagaggttgcggtgagctgagatcgcgccactgcactccagattgggcaacagagtgagaccctgtctcaaaaaaaaaaaaaaaaaagattaaaaattttaatcggaataataaccatactgagaaattgctttaagatttttttttttagaataaatgtcattaagctgaatgtcctggagaaagaaaacacttctgtttttttcatcgttattttattgaaaatatctttattgacacaaattatttttcatataaatattgaaaaaatgttgagtcattgagcagttttcatttttaccgaatcttactgggtgtagcttctataatcatgagttttgcatgatctccaacaggctgattttcctgattgcaatttgagcccttactatttttattttatgttttcactgtcaatatcaattccattttcttccaaaactacaagatggattatctcggctaggttgtatttaatggctggaatgaattttaggtctcattttccagggaagggaaactgaaacccagaggttaagtgacttccctgaagtatcctacccatttcatgtctgagctgaggttagagtcttggcttacagcccagagattctctacttcacaagcatatccactactggaataatggaatcacagcagtatgctggtacagttaaaattggagcctatatgcatgcctaccataattaaagcagggccgagaaataatgtatttcacatctagtgttagctctgaatccacacccaaggtgaccacctcctatagacagagagaagattggggttttttgtttcattttgttttgttttttgagagggagtcctgctgtgttgcccaggctggaatgcagtggcatgatcttggcttactgcaacctccacctcccaggtgcaagtgattctcctgtctcagcctcccaagtagctgggattacagacacacaccatcatgcccagctaatttta

SEQ ID NO: 43508 - DNA, 1026 bp, Homo sapiens
tggtgcgatcgcagctcactgcaagctccgcctcccaggttcactccattctcctgcctcagcctcccaagtagctgggactacaggcgcccaccaccatgcccggctaattttttttttttgtatttattttagtagagacggggtttcaccgtgttagccaggatggtctccatctcctgaccttgtgatccgcccacctcggcctcccaaagtgctgggattataggtgtgagccaccacgcctggccacttttcttatacccattgtgcagatgaagaaactgagctctagatgggctaactcaattaagataatactgccagttagtggcaggggtcagattcaaacccagccatagagtttatgcacataactataaacatatatccttaatgtcaaagagtcacactttaggtttgccacttgcttgtggaattacaaatatagaataaagcacctgttcaatgtgttcttatggaggttagtgaccttagacagtagtgaggcaatgtggaagagcacttagaagcacacagtttgggctcaggtcgatctgaacttgaatttcagtcacctgttgggggatcatggtacactgacttacctccttacacctctgcctccttgtgcctaaaatgggataaataacacctgccttctgagaatgctgtaaaatgcttagcacagttcctggaacataataagaaaaacaacaagagagtcttattattactcaaaaacttccttttaaaagccatagtctttaccacacttttctagcatttaagtgtgggggaattccatgtgattttgaattccaggcttcagaattagaagttcctttaaaagagtaatacatgaatttatggctctaactttcaagaaaagactgagatgcagtggccaatgcatgcaaaattagtagtcaagggtgtgttattatttcgagagcttgaatatatatagagttcaggtttatcctggctggatttcttcctacagtcggcctttttctgaaagag

SEQ ID NO: 43509 - DNA, 1033 bp, Homo sapiens
tcaacgcattatccatggacagataacaagtctgcccccagtcagggacatttcttaaatgttatactcctcagctgaattaaagttttcttctgcagctgagcttttgggaaacccatgggaattattgtttgttgagctggataatagtgaaattaattcttttctgcttagggggaaggcactggtgggacatgctaattgcttcagtccaaaagaactcctggccacattagagtttgtaatagaagaatgataagtaaagcagccagaagaggaagtttggagggctgatttgcaggagtttcattgatttagcatctgtagggaaaattcccttaaaaaagaattttttttttggattagtgaacaggagaacattcaaaactaagacagatagaggccaactgggaatgctgtgcagcctggaatagcttaggctgctgttcaatcatttccccaaacaggaaaccacagaatgttagagattaaggtcactagatcattgggaaaaaagcataactttgtctgcaaagtattatgatatattgtaaatggaccagaatataagcataaatctttcgtctaaaaatgcaacaacaaaaatccatccttctcacaaaagcacaatttgctttcctgttgtgctgagataccaaagcctccttctctggtatttctgtaattttcctaataagtaagagctgtaagcagggaataaagagaaaagttttgtgttctctgtcagtaacatgtgtgctttttttttttaaccacaacaaaaaatggttaaagtttagaacagtaagtggacctcacatgatttattttcagtcttagcctttcatgctagcaacaatgaaaataaactaaaatgcacacttatatacatttctgtctctaatctctcaggctgtattaaaagcacagagttcttttttcacctctgattatcatcatggcactgcctgacttaaattttaagtgaaaatctgtgcttatagagtgtggaatctttctaggtgtctgtaaa

SEQ ID NO: 43510 - DNA, 1102 bp, Homo sapiens
tttttctgtctctattttataaaaatttttttccccataggttattggggtacagttagtatttggttacatgagtaagttctttagtggtgatttgtgagattttggtgcacccatcacccaagcagtacacaacacaccctgtttgtagtattttatcccttaccaccctcccatcttcccccaaagtccactgtatcattcttatgcctttgcgtcctcatagcttagttcccacacatcagtgagaacatatgatgtctgattttccgttcctgagttacttcgcttgatagtctccaatctcatccaggtcactgcaaatgccgttaattcattcctttttatggttgagtagtattcatatatatatattcatatatatatttggaatatatatatgtggaatatatatatatatttatatttatatataccacagtttctttatccactcgttggttgatgggcatttgggttggttttggttccacggattttgcagttgcgagttgtgctgctataaacctgtgtgcaagtatctttttcatataatgacttcttttcctctggacagatacccagtagtgggattgctgatcaaatggtagttctacttttagttctttaggaaaccacactgttttccatagtggctatactagtttacattcccaccaacagtgtagaagtgttccctgatcactgcatccacgctaacatctactgttttttgattttttgattatggccatccttgcaggagtgaggtggtatcgcatggtggttttaatttgcatttccataatcattagtgatgttgagcgttttttcatatatttgttggccatttgtatatcttcttttgagaattgtctattcatgtccttagcccactttttgatgggattgtttgttttttacttactgatttgtttgttgtagattctggatattagtcctttgtcagatgtatagattgtgaagattttctcccactctgtgggttgtctgtttactctgcagactgttccttttgccgtgcaaaagctcttttgtttaattaagtcccagctattaatctttgtttttattgcatttg

SEQ ID NO: 43511 - DNA, 1043 bp, Homo sapiens
actcttaattttctcacactcttaggaaagctgaatagtgctgctgagtttgtagagccatcttcaaaaaataaatgcacaaattcagaaatggttttctgcttttcaatgtaaatgcaccagacctaaatatcttcacatttgtgtgctatgaatgagaggagcctgatgctcaaggggtctggagcagctgttcagaaccttgatttggtgtgaagcagtctggaaataataatagtacctactgcatagggttgttttgagcatttaattagataaccctcctcagatattagcatagtgactggctgtggtgagtacccaacacatgatgactattattaccattcatgctgaaaagctgggctaatatattatgactcccaagcatacagcctaatgcctggagacaagagctgaagtgttaatagaagctccgctaactcattgctgggatatggcatttccccctctactctgtgtctattattttgaaatcatttttaaaagcaatagttactttgtctaaaaaaaaatggagcttagcagttgacattagaagttgtgcttgttttttatatggacagcagcaaaatgtgtcaggacccaccccaggctccctgcctcaccgtgtggacgatggtgtggccacaccagagaaagtggcgtgggcctgccctcagtgcaaaggaaaggggagaagctgctttgtcttcttcctcctcctcttcatttctgcccagaacaccaactggaattaattttctctaaaaagagacaaatgtgtctgtaaatcaccctcctcaaggcatgaaaaaaacatacttcaaaaagagaaataagctgtgtttaattcccataattaactttctttataagtgttatcctttctgagccagtagctattagtgagattgcccttgttcttgaggcacggacacatttagcatcctctcaattgtacatgagcccaggtagaagttaaagcaaaacagccctcacgggaaggcaggtaggtgacaggatcagggggaccgcccatt

SEQ ID NO: 43512 - DNA, 1047 bp, Homo sapiens
ttgaacaactgactctcaatatttctgaaaatttaaccatcagctctcttgcgctggcttgagcacatcaggtgggacccagagaagttactgtcttaccaaggtcctcggatgagtcatggcaggacctgggttattacagagttgtttctaaaaaccagactactctagacagatttacttatcaacgtttctttttattcatttgtttatttatttactccatcctttaacaatccataaaagggatttaagactattacaggctgttattatctattgagacagtaagagtcagaatatttgaatatatctggaataaaggtgggagagtaggccgggggcggtggctcacgcctgtaatcccagcactttgggaggccgaggcgggtggatcacctgagatcaggaacctgaggtcagcctggccaacgtggtgaaaccccgcctctactaaaaatacaaaaattagctaggtgtagtggtgggtgcctgtaatcccagctacatggggggctgaggcaagagaatcgcttgaaccgaggaggcggaggttgtagtgagctgagatcgcaccactgcactccagtctgggtgacagagcgagactctgtctcaaaaaaaaaaaaaaaaaaaaaagacgggagagtggaaagcagatgagatttagagccataagtaaattctggctttgagtcttggccttgtcatcttgatcaagtcagttactccttggtaaaagttttctaatctgaagatgaaggaactggaccacatgaacatttaatatcttgtaggtctaaaatatggttccttatttagattcatcaattcaataatatttgcttagtaccaactatatgcactctcattatgaactgtactccaggcagaatgaaattcagatatgataataaatattattataatagcatctcacatttatgcagagccttctgatttgccgaagagaaaatttactttgagtctctgggattctgtggctttaggagatcaggacatatcttaacagaatgttagagaaag

SEQ ID NO: 43513 - DNA, 1044 bp, Homo sapiens
gaagtagattggccacaatttggaaccgggtggcccccagaagggtcactgaaccccacaactgtccaggctctgtggcgggtcgttgctgaaactcctgacaccctaatcagtttccctacattgatcaatggctagagttggtccggagccctcctccatggctccgctcatgtgccattcatgatcccacctccaaggtcctttgagccagaccgcacttctgcccaaaccctcagctccctcggctcctcctgtaatgcctccttctgaagaagaggacagctgtaggtccactgtcctacaaccctcctgcttccccagaatcttcccttgtctcctcgactacatcccctgtggcctctccgcctatagccacccgattgcagcctcggccggaggcagtggcccccctcctcctgttgagagatgcccaaatccctctggagagtgagcgcactgctccatttttagtttatgtccccttctctacttctgacctgtataattggaaggctcataatccccccttctctgaaaagccccaggtcttgacttcactgatggagtccgtgctctggactcactggcccaccaggaatgactgtcagcaactccttttaacgcttttcacctctgaagagagggaccgtatccgaagagaggccagaaagtattttctcacatcagccggtagaccagaggaggaagcccaggacctccttgaggaggcttttccctctacccggcctgattgggatccaaattcctcaggtgggaagacagctttggatgattttcaccagtatctccttgcgggtatcaagggagccactggaaaacccatgaatctgtccaagacaactgaagttgtccaggggcctgatgagtcaccaggagcgtttctagaatgcctcccagaggcccatcggacttacaccccttttgaccccgcggctcccgagaatagctgtgctattgatttggcatttatgactcaggcagcccctgatattaaaagaaaattacaaaagctggaaggat

SEQ ID NO: 43514 - DNA, 1031 bp, Homo sapiens
atattatttgtctcaaattatgactcacctctggataaagatggaagcgttttactgtattaattacaagaggatattcagtaagcctgtcattcataatcatccacagtccttccaaaaatgaagatgcttcaatattgttcttgaagtaggaataataaagtcccttttttttttaaaggcacatattgtcaatgtaattaaaactttaaaatatttatttttatcaattctttagtacattttttttctgaaaaaaaaaaggtcaataataagacttcctaattactccttgctattttgcattcttggactttaaaaagcacgtattttcaggtgatcaccgtactattctttcaaattgtctataggttttcaaactaaagagttggaggtatggtccaacaatttaaagagtttatctaatattgtcttaaagtgtgtagacagtacatgtttaattttatcaaatctgggttttatcccccacatttgagatgcttgaaggttgacctctgattaattctgtcataaacagggatgccttcatgcctctgtacaactttgcatatagaaaattactttttttcccatgctcttaggaaataaaatataatgaccataagcatcatgggcaaggaatccaatgcttctagcttacttcatagctccatctaatcctctgtacaaagtgaaagctcaatgtcgattgactattgttgcttacaaatgctatgtactaaaaagcagattattttagtgtcttacacttcagcatataaaataaagtcttcattaggatagtagaaatgctgttgagttaaaattcatggattaatctcaaggatctagaactagaaataccatttgacccagccatcccattactgggtatatacccaaaggattataaatcatgctgctataaagacacatgtacacgtatgtttattgcgtcactagtcacagtagcaaagacttggaaccaacccatatgtccatcaatgatagactggattgagaaaatgtgg

SEQ ID NO: 43515 - DNA, 1068 bp, Homo sapiens
taatagcaattccacttttaggtatatatcctagacaaaatattgcacatatacagaagaaaaccatacgaaagtgtacattttagattacattgcttgtaattgaaaaattggaaataatgtattaaggtggggaaatatataaactttagaattcataaaatggttaaaattaaagaaatatatatatacagaaagttcaaaaatacaattttgaagaaaaaattctacagtgatacatacagtatgagatcatttatgtggacttaaagcacataataaaacaatctgaaaacagagattggatggatacacacaccaaattttaataaaggtataagttggactagaagcagaacaaaggtgattttaactgtatttctaatattttaattattttaaaatagctgatgcaaaaatgacaaagattagcatttatttattctagatggttgatcacacatatttgaatattattttctaagtctgtagttttaagcatttcaaaatctaaagaataatttttaaaagctataaaaatatgaataaaggactagaaatcagtaacttttaattaatatgctggattctgggacaactttaaactcaacagtagtatttaccatggtgtcaaatttagcatttatcttgagttcacaaacttgagttcactaattttgtctctgtttttcaaatttctagcgtttacagactactataacaaccatactcttttaggctaagtgttggaagatagtaatagatttctggctgaaaaagaagtcttactttactaacgtaactccaagatcactattcaagcccatcattctcaccgtcccttcacgtggtcatcgtgcccacctacaagttctcgaaagccaaaagcccatccctatttagaaccgttttggctcccatgactctcttttccatttggcttgtctattaccctggccattatttacacactaaggttcattctttgagttcatgcgagaacagtttctggggtctttaaattttaagagaagaacttatgatattctgctcacctataaggataca

SEQ ID NO: 43516 - DNA, 1026 bp, Homo sapiens
atccattgactactgagtatgtagcacaaggaaatttgcatagtttcattcattcaacaaatatgatattgaatcagctccatattccaggaagtaggcacctgggatacagctaggaaatacataatgggcacgggaaaacagtagaaaacaaggtcattcgctgagagtgaaagcgggagaggaggtttgggataactggagagagaagatatgaaacaggagtcaaggggttagcaaaagtaaggctcaagaactaaatcaggatctgtggcctatttttgtaccagtaatgtgaaaaggacagtgttttcccccaacttttccccagcagtttaagctaagagagtttaagacttataggggagataaggaagagcggggtgggtgggtttcatgcctttctctaagtggctgctgttctcccaggctttaccatggaggatgctttctgagcactcttgctaatcttttgtcagcaccttatgagctctgtgtaaaaatgtctgtaagcaattgcaaattcccttgctaacccacactaggcatttaccgactgactggtgaacaatttgagctgagttctttaccattgtgtctagtggcatgacccgtataattaaatgcttgtttctgttctccttgcacatggtttttctttttaatttattttgggttatttgattgtcctgtgacctcagctccctgaccacttcaggaaaagttgtcaatttgaagactgtctggcttttgttgttgttgctgctgacattgctggaaggccatgagcaatgttctttttggctttctacatccaagggaaagctgacccaacatgattaaatccaactctccattttctccgtgtttatacttgggaatctgattatagctggagaaacacaattctgttggctggttttgttctcagttcaagaccatcaacctcaaatgaagcccttggtgctgcccaagaaactcacattatatccctagtctattcattctcctagacaagaggtcagt

SEQ ID NO: 43517 - DNA, 1032 bp, Homo sapiens
cagtcgtttatgctagtgatctaggagcagagtgagaagaagattgagagtcttaatactcaaagtgatactttcatttaatctccgtatttagtatcaatacaggacctctgccttcagctattcctgttgtctgcaagtctagaaacttttccctctcctaataacaaacttgtagtagagtgccagggttggggttgcttagctgctgcaagtcagggaggacaactaggagatctcacagcttcttacgcagactggcgatgaatctttctcttttaggcctgccttcacccctgcttccagggatatcttgtgcttgccaattcttgtgcctgctgtaaatcagtttgcttctctgctttcctagttctgcagtgaaaattattactcattaattttctttccagagtctaaaggtactgctttttatttcatcttcttgatttttttataggcgtattccctttaaaaattacatttttatcattttagtaggatgtttggacggagcggaaactaatgaatgtgtacaactagttatctttacttggaagttttctttttttaattgcagaagaaataagaattcactcctataaaaatttagatgatgcagctgggcgtggtggctcacgcctgtaatcccagcactttggaaggctgaggcgggtggatcacctcagctcgggagtttgagaccagccggactaacatggtgaaaccctgtctctacaaaaattagccgggcgtagtgatgcatgcctgtaatttccagcgactcgggaggctgaggcaggagaattgcttgaacccaggaggcataggttgcagtgagctgaaatcacaccatggcactccagcctgggcaacaagagcgaaactatgtctcaaaaaaaaaaaaaaaaattcagatgatgcaaaaaaagtgaaagtcactttcagtcctctggtatgaacatgttcaaccagtcctctaaggaatctaatggttttcaagctttttttttcttttttttttttttttttgag

SEQ ID NO: 43518 - DNA, 1022 bp, Homo sapiens
attgccagaaacaaagatgtgcttttcttcaaggcatttgatctttattgccaaattgctcattagaaatggaaacagcttctagcaaggtataatctttaggactatgtaaaattttttaaccaataaaagcttgtgaggtttttgatatttataagtgcagattggtagatatatttcgagtaatatcacctgtcagagtcattatttcattcagggctcttttttttagcaacaaaaagatttagtgtgtcagaaaattataggtatattcagtcatttgaatttcataagttctgaccatgtggaatatcctaatttttgcttgaattgtgattagtgtgtaatagttctttaatttacctatttatatatgagctgaggaaaaaaaaagaacaaagaagccatatatacataatgggttatttattatgtgtaatatgtttcagagagccagtgctcagttgaacaataaatttttctatttttgttggtttttaatttttttctactgttgcctctattctgttctttctcattttgtaaagttaattttgttctttctcctagcttttagttcttttattttttatttatcattttttaatgataaaagcgtttaaggctgtgtttacttctcgttacatgtagtcacttcccatagctttggatacttaccattttcattgtcattgagtacacattttttatcttttaaaagtcagttctatcgaggagtaatcatgttaactgcattttgatattttcttttacttgaaagttattttaaagtgtggctttattgtggttatccttactactaccctatcgttacttctagtgttaatttagaaatattgcaccgtggctcggcactgtggctcacgcccgtaatcccagcactttgcgaggccgaggtgggtggatcatctgaggtcaggagttcgaggccagcctggccaacatggtgaaaccccatctctactaaaaatacaaaaatcagccaggcatggtggcaggtg

SEQ ID NO: 43519 - DNA, 1035 bp, Homo sapiens
tactgaaaagttaaatatgtctggattgtagggtgcatagaggaatgatgagaacccgaagctagaaaaatagaaagtggagccagttgaaggattttatagtgctgtaggtttgttttatccaatgaagtttgaaagcagggggagtatcatgattaggccattgggcacaattaacattcgtagtttacatggatggcaaccttctctagtggtgcagacttcaggctgtatgcagcaaccctgatcaggattcagttcttaaggaggagagtgtgatagcaggaggataagttaggattcttttagaatataactgatagaagatgcctacgttgaaaagatggcattggtgagggagaagaaaagttagatttgattgagatttctaaggtagaactgatagaattgagaacctgggtacatagtgatgtctttaccagtattaaagatgaaaagaacaagttttaggaaatgataatgagttccttttaggcctgttaaatttgagtggctatcggatttccatctgcatagaagtatcctttaagtggctggaaacatgagtctctaattcgggatattacaaaaaactgagaaatcaatttgcaggatataaatgattccagaaagtggataagattactaagggatgaatatagattgatgaaggacaaggatggaatccagaggagcaagtattttaagagacagggagaggaagaggccagcagttagaattcaaccagagggaaaggaagttttttaaaacctttttttttaattataaaaataatacctgttcactagagaaaaactaacatacagaaaagcagtggctcacgcctgtaatcccagcactttgggaggccaaggcgggtggatcatgaggtcaggagatctagaccatcctggctaacacggtgaaaccccatctctactaaaaatacaaaaaagtggccaggcgtggtgatgggcgcctgtagtcccagctactccagaggctgaggcaggagaatggcatgaacctgggag

SEQ ID NO: 43520 - DNA, 1050 bp, Homo sapiens
caccggccggtgggctggagccccggcgggccgctcctggtgatcggctccttaccagctcacctctcaccgcgcatgtttggaggtacggacccctctccacgcgcccgcgctcggtcctcccgcggctgcacgtgggccgtggccgccggctatttttacccttctccttttctccttcggccggggcgccgggggctgcttcccggcccagcccgcgccggtctccatcctgggaagaaacccggcacgtaacacctgcggtgtcgctgccgcgtagacacgtggttttgtttttaaacatcgtgagcacccacacctcagcgggtactcagtagagatagtctattttccagtgagttgactggagcaaatgttgttttacagcaaacccacgaaatagcccttgtggttgtggcttttagtaccaggaagtcaggaggagacggttgctaaatgtagttctatctggtactcgagtggggcacaatttttaaaagccaaaagtcaaagggtctcaaatgaactctgagttaccatctttggactgacttttaatataaagctgtaatccttaaatctgtgtcagtagtcccacctactatgtcactttaattggatgaatgcgttaatgaaaagtttgttttcaaacctcactaaactgctacttaagatcacagttaatgtgagtcctgcttaatttggaaagcatttaaaaaatggaaaagtttcttagggaagcaaaaattttgcaactctgcctacaaggtacagtaattggctaggttcttttgaagagcagtgttgactagagttaaggaaaagtcagttgtgaaaaatggacatttttaatagcaaaatgatgtgctttactgtagaaacaggaggaagggtgcattttcctggggaaaatgaattcttcttcagttatattttatgctgctctactttattgcaaaacgctaatattaaatgaatcaagaccacctccccttcccgctttatgaaaataaatagaagtatagaagataagcattcccatttcatcgc

SEQ ID NO: 43521 - DNA, 1118 bp, Homo sapiens
tcttgaactcctgagctcaagcaatcctgccactcccaaagtgctaggattataggcatgaaccactgcacctggccaccccatatggttttttaagcaaacatgtgagaagtgtgttctgggatacagtgcagttaatcagtttgcttattgttctgcagacttaacatgtttacacatgttggcatgcttcataactcggccttgcccagtctttggttactctagtaacaatcctgtggtatgaaatgactgaagtatggttctggtttccttcctgcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacaggtgagtgggtgtggatgatggagagttctgaggacagggaaggccacagagatggggtggcctgcacgtacagtgtcagacctggaagaaagacgtgccgttgcaggtcctctctgtgtgggactgtcatgctttggcatgcctctcatttctgggaacctccaagaagagaacctggagtctcctgaacctggagtgaagcagtctcttaacatttcgtattttctgtttgctttctgggaagaacctgcttttgactaccaggaattccatgacttaaaccattactctattaattggccaagagaatggtgactcttcttgtgtaataggtcaacaagtcccttcactggacagtagctccttgtcacccccaaccctgtagatctttgtgcttggcatgttcctctaaaataggagtttagatctgtgtgaggaccggtatacgccactctgggatttctttgtgagtgaagttcatttatctcacagtgagacagtgtttctagaagagcagaggactagatgatccacccagaagaatttagtgcccataaatttgctgctctgtggcccgtgcagcatcttgcttctaacacagccctggggaagtaagtgttaggggtgggagt

SEQ ID NO: 43522 - DNA, 1001 bp, Homo sapiens
tttcttcgattaacagcagcatgccatatatacttttctctactttgcattttttttcatttttatttttttattttcttcaatcagctttctcaggttgaatctctactttgtatttttcaactcaaaacatattctggagatcactccctacggtacatgcaggtcataattcctcatttagagctgcatggtgtttcattctatggatgtatcatagttaaccagccccatattactgctggacatttggattgttttcagtctattgctattacaaacagcactgaagtggataacagccttatgcatctgtcatagtgtctggtctcagtttatatatttttatcataataaaacattatccattaattcttatttcaaatcttttaaaaatactatttttgtcagtatttctttgggatagatgcctagaaatgaaattgctgggtcacaaggtaaataaaaatgtaattttattaaatattatcaaatttccttccataggtggtgtaccgttttgcattcccatcagcactgtatgacaatgcccatttcttcatattcccagaatgtgttgtcaaactttcacgatggctattttatgttaattatactttctgccattttactaaattcttttattggttgtgtcagcttttatcattgcttttcttggggttttcaggtatatttttatatcacttgcacatagagattgtttagttgttgttctgtctttaattgttttcttgtttgattgctttggcttatagctcgggttttatgttaagtagtagtggagatagtgggtgtccttggctctgcacctgacctgagtggggctgtctctagtgcttccctattaagtaagctgctggttttgggattgagatttatatagttttatgtgccactgcacctggcttatgataaaaagtatacatcagtcaggtacagtgacacatgcctgtagtcccagctaccctggaggctgaggt

SEQ ID NO: 43523 - DNA, 1028 bp, Homo sapiens
agtgaaggtgtcaaaaattcatttaggaaatagaggaattggccagacaagtacacaaaggattcccagatagtaatgagggccactctcatggtgttttcagagtcaggatatgagattcgcaccaagagaagtgtaattggcatctacagctatgattacctttaacttatgtaatctaagtcagcctggtgagttttgtagctgcttcctaaagtttgttttcttcagtcttccggaagtgtcccacctcctctttgctaattcagtttatatggatgatagcacattttgtccttagaataagaggacttcacaaacaagaacttctgagatcactggaagccttaatatgaaaatcttcatttctgggtttctttgggactctgtgtcactgtcccgtccaatggagtttctactagctacatgtggctatttaaatgaaaattaatttacgttttgaataaaatggaaaactgtgctccttcatcagtctaactacacttcaatagctgcctgaggctagtggtcaccatattgaatggtggacatacaacatttccatcattgtagaaaattcttttggaattttctacagaaaattttcttttcagaaaagtcatctctgaagctagtcagtgcacacatggtgattcaggaaaaattaatggactgttagcctgggctagtttgctcctaggtctgatgcacactttgctggttcatctagctttttaattcttaaaacagactttgaaattctgctccctgctggcattcccagtcattcacaaaatttagtggaaaagccagcctcccttggcccacatacccctgggcttctgttgcctatatcctcatcatgatcatgcgacccagattatttgctgactaagcaggtgccttggccaaacaataggtgcttgcccaaaaccccatgggttttatttatattctatagataaatctcataaatgcaaaattggtggatttctaccatttttaaggatcaaataaagtaaggttct

SEQ ID NO: 43524 - DNA, 1071 bp, Homo sapiens
acggatcacgatgtcaggagtttgaaaccagcctggccaacatggtgaaaccccatctctactaaaaatacaaaaattagctgggcacggtggtatgcgcctgtaatcccagctactcaggaggctgaggtaggagaattgcttgaacccaggaggtggaggttgcagtaagccaagatcgcgccactgtactccagcctgggcgacagagcaagtctccatctcaaaaaaaaaaaaaaaagaaagaaagaaagaatcgtgtaaacaaatattttaaaatgcatgttttatgtaatatataaatgatgtaacttgtcagttttttttcattttagtgtgaatgtctggtatgttacccaatattttgacagataataggaagagaattgagttcctttgaatcactttccgaagggtttcgtctcaggttcatgagagctctggcttccagactggccagtttttcttttcccatgtggacaactgtaggaggccaactcactatttgtgtgaaacatagtaatgaaacattgtgtgctctctgagcaactctgaattgggcaggtgtaaaaaaggtaaaagaaagtatcagagaacaatgccaaataaaaaaattcatcctagctataactcatataagaatttgccacttttgaaatttcagatgtattaggatatagatgcagaactaaaatttttctttaaaattaaattcctaaattgctattctctcctgggtttactttaaaaatcatttctgggattatatcagtaaaaatacttataggaaagttggaaattagaggaaaagatgaaaaaacaaagaatatttcattgctgggctcccactgttaatattttgaatacatttcctgggcaagtatttgggcatagtctttttctatctatattttaaataagataatttatcttgcccctcaaatcatttcttcatgcaattaaaaactcttcacaaacatatatttaatgggtttatagtattctacccgatagatgtagcagacattttcagccagttctctgatgctggacaagtaagtttcagttttt

SEQ ID NO: 43525 - DNA, 1065 bp, Homo sapiens
gggaattagtgtgagtcaaggctcatccgggtatggagtagagagtgattcttggagctggctagattttagggtgctgcagggtcctgggagttgttaagtgggaagtttggagagctgtaattatttttcctaacttatcaaaagatgatacaaaacctagttaaaactctacggttttgtatgattttctccaggctcaactaaagttgactctgtggctgctgatgtctttttgatgcacaacctggaggtcgtttgatacctacaagctcttaaaagagatgtgtgcacattgtaaacatcatccaagagcagtgcacataacaaataccaggttcttagatcaagtttcattggaagaactgatttagcgacacgaggaagcacccaggcatgaggaaatgggaaattcttgaaaggtgactcattttagaattttttttttttaaacagcctttctttcccttttcacttccgtgctgccagccatcttgtcttttgggaaggagatacatgaggaggcaaatgcttcagggataatggaatagaggaggatgagctaaggtcggggggcagaggtggaggcagtcttaaggagcctgctgtcaaccccctttttacagcaggaaggctgaggccagcggggcgaatggacgccaagatcatatatctggctgtcaactggcagtgagaacccaaatccaggtctcataactcccccgggttccacatgctaccttttagagcctgggggagaacagcaagtctgtcattattaggaaggcaaacacttcgagcaatgggaagccaaactgtaatatgaattacaaagtctataggtgtttaaagtcaatgacaacaccttaatttcctaattcaagacttttaacttcttaagctgtatctacctcatgttcacattttccagtggtgaaactgtttctatagttaagaaccaaaaacattattttagtaaagtctttgaggcaagaagtacattttttgattaaaaattgagttgcttgtgtttgtggagaaccattaggccagtttattttgaaa

SEQ ID NO: 43526 - DNA, 1029 bp, Homo sapiens
tggaatattatttagcagtttgctactaagttctaatacctgatgaggggactgttatcatgcagcctccatgtaaatggtcagaagctgctaactgtaaacttcatgaagaaataccatcaaattggctgggcgtggtggctcacgcctgtaatcccagcactttgggaggccgaggcaggcagatcgcgaggtcaggagtttgagaccatcctggccaacatggtgaaaccccgtctctactaaaaatacaaaagttatctgggcgtggtgggcacctgtaatcccagctactcaggaggctgaggcaggagaatcgcttgaacccaggaggcggaggctgcagtgagccaagattgcgccgctgcactccagcctgggcaacagagcgagactccgctctgaagaaaaagaaataccatcaaatgatcagtttgtaagcacgtttgccatctctagaaccatagcctatgggataaattgcttagccctaagaagaactgtgctaaaattgtagtcagtgatgagtagtagaatgtttcctgcttcttttttcatttctagccttcccaaattttctacagttggcattttgttactttgatcattgggcaaaattacaggaaaaaatggcattacccagatttagtaaccatggtactcatgaagcgtagtacagtgacttctttttctcacctacaagatatccttgaatagaatattttccttattgcactgaaagggagctaggtagggatcaggcattactcagcccttaagcctccctgtatgtagttcggcaggttggttttcctaggctagactctcttcaactcatgagccaggacattctatttccctcgtccccagttgatagggttccgctatggccccacccaattctcatcttaaattgtagctaccataatccccacatgttgtggaagggacctggtgggaggtaatcgaatcatgagggcaggtttttcccatgctgttctccttgtgatagtaaataagtctcacgag

SEQ ID NO: 43527 - DNA, 1017 bp, Homo sapiens
cggaggagtttccggttggctctgcgccccgcccctctcccaaaatccacgctggttgaatgctgaaatccaccgggctctaggaccacaagggatgatccgccgcttggcagctgcccggctctaccgggctgtaaattccatcgttgcagcgtcattggcttgagagctgcctgaaggacagcaccaatagccaatgggaggctgctattcccaggcggccgcgttataagagccagtcaggccggcatttgggcttaactctttaaaggtaggttcgtgacccttgagaaaagagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccacgtaagtaattatgccccgcaggtaaaatagtaattaagaatccactcacttatgccagctctccagcaggaaaggtggcctgtacctggttttgcctcttttacaaaaccgaaatatcttatttccttctttgggaaaggaaattgtttaaagccagttttatatagcgagcgaggcctttgaaggtcttgttggaaacatgtggtctggaaaaggctgttaattttttttattatacaaattagaactagaatctttgaaatattgcagaaatatatctgggtgtataattggccaataagtagaaaaagcccaaaagaattctcatatctcaaactccatttcttaaagaaaatgacttgattccattt

SEQ ID NO: 43528 - DNA, 1083 bp, Homo sapiens
cctctttgagacctccctgtttgatgctgtttctgcctctctcctcaccctgctgctgtgccctgccaccccctccctccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacact

SEQ ID NO: 43529 - DNA, 1498 bp, Homo sapiens
tttggaattttttagtatgaaacctagagaaattagcctggtatagattatgaaagtaccgctaaacacagttgccatttattcccccatgtccaattcagagcaagggtaacctctggcgttgtaaccgaaactgctctctgtaaactttaaattttttttgaagaatggtattttttttcttaaaaggtcatataaattttatatagatatgtttgtcttaatattaaaatatttaaaatcatatattgagaaagttgatattccatgaggatgcttcatttggctttgaaaactccatacacattcatgctcagtgtgagaggaatgatggtattctattttatataattgtttattctagagttatctgaaagctaatacttcatactttgagaaggcaaataaagctgtggtatggtacgttaaattatattcctaactgaaagggtttttttgtctgtttgttttaaccatttccagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggtttaacctgttgtctctactaaagtacttcatttcattatgttgttaaatcatcacacatgctgggtctgctcttggccatgcagcatctgtagtggagtggtattgtacagactctggagccaaatagccaaggatcaattgtctgtgccaccatttctcactgtgagactttgggttcgtttattctctgtgtctcagtttcctcacatataaagtgaggataatcaaaacatctacatcttaggattattttgaggattaaatgagtatatgtgtgtgtgtgtgtgtgtgtgtgtgtgtgtgtgtgtataaaataagcttaggatagccgggcgcggtggctcacgcctgtaatcccagcactttgggaggccgaggcgggcggatcacgaggtcaggagat

SEQ ID NO: 43530 - DNA, 1065 bp, Homo sapiens
agctgagttactttggtcaagctcttggacttctgagcctgtttcctaatttcagaagtggtgatatgatgtgttaggccctggtgggttgcaaggaagaggcatacacacaccacctttggtggtgaaggctgaatgttaactttgatggaaagtcatccaagcagccatattgtctctggccctagtactttcaaaaccccacagaacattaatttagcagtatttaggataggatttgagctctgaagacctatagtgtggttatttgttcatatggctgttttccatactagaccatgagctcatgagggcagggtctacagtctcatctttctatccctaggcattcagttcagtgcctgatacatagtaatagaggcacaaatgtttcaaaagttgaggaattttcaactcttcctgaaagaacaggaagatataaaggcttctcagagaaggtattatttaaggttttttttttttttttttttaagatgacatctcgctctgtcacccagtctggagtgcaggggcatgatctcagctcactgcaacctctgcagttcaagcaattctcctgcctcagcctcccgggtggctgagattacaggcatctgccaccatgcccaactattttttgtatttttagtagagatggggtttcaccatgttgggcaggctagtcttgaactctgacctcaggtgatccacctgctttggcctcccaaagtgctgggattacaggcatgagccacaatgccaggcctatttaagctgattctttaaagatgagtagaaatgttttccaggtgaataaaaccttgagacattattccaagcagagaccagcaggtgcaaagacacagggatatagagatgttgaagtttaccaaacactgctagatttagaaaacaaaaaggaaacaatcaaaatcaaaaattaaaattaaaaatcaccaaaaaaaaaaaaaactatgaatgggcttggtgagaggtcacgtcacaattgagtcaactatgaccgtagacactcagtaatttatggaagttttagggaaaaaccat

SEQ ID NO: 43531 - DNA, 1048 bp, Homo sapiens
cagcctcccaaagtgctgggattacaggtgtgagccactgcacctggcctaatattttaaattggaaatgacccagatgtttaatgagtacctattatttaacttaatataattttagattctaaattatataacaagtttaatcacaagcatttattccattacatttacctaattaatttttttaatagtttactcagattacttttgaaaactgagagttatcattgaaagttatttcccagttaatcatttttatagactgcgaatttcaggttttcctaagtaagaaacttaaggttagataaatggtttctttttttttttttttgccaataacttaggatttagctgttttcattaactaaacaatattaaatgccttatttatgaaattttacatagagataattttcctttgggctgcattcattgttttataaccctcatgccaaattttggcatctagcagagataaatatgaaaccactgttccaataaatttaaacaatagtgtatgttgacaattctgaagccattctaattctaattttatttcatgactactttcaaaaccagcttatttattaaagatatacttaagtcacatgaacttgaaaagacatttggcttaaaatctctattttctctgatacagtatttgatttaaagcccctttttttctttaagccaattaattagagcacttttacatgtttctagtagtgaaacatcatatacatgacacataaatacatagatgtattatacatgcagatagaagtagagcttatcatttcacaagacctctttttttcctccagttctagacttctaatttcttgatcttattaccctaggcagttgtcagctaagataaccctaaatttgcatattaaaggaactcttagatgaaaaaaatcagatagtgaaatttacatctcaaggtacagagagaaagagtctggtgctagtgtttccagaatttattccttctggtgggttcttggtctctctgacttcaagaaagaagcctcggaccttgcag

SEQ ID NO: 43532 - DNA, 1024 bp, Homo sapiens
gctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcagggtgagagttctgtaatccccagtaggtagggactgtgccccaagtcagcatgaagtagttatggaagaaagaccatgggtccctctgcctcccagaaagatttatggggatcacatctctcaggggaaaatgaggcaggagaatagggtctggagacagggaacctaaagctgatttgtgctgagtttctaggattgaatgaaaaggaaaaccccacctctccacacccaagtaacaaaaggatcagaggctactccctttgcactgcattgcagataaaaaatggaaagtacctcagattggtcccctcccacaaccaatcagactggccatgggctactccttcgtttacatagggtgtaaccaagtaaccaatgggaaacctctagcgggtatgtaaaccccagaaaattctgtaaccagtgctcttgagctgcttgctggagcctactcccactttgtgaagtgtactttcatttcaataaatttgtgctttcattgcttcattccttcgttgctttgtgtgttttgtccaattctttgttcaaaacaccaagaacctggatgactcatagtcaagatcctctaccagtaacacttgaactttctggtttgtcctgaacatccctctttcttaaacaaccagtcgttttattctaggccaaaattttaccatacaagaatatttctc

SEQ ID NO: 43533 - DNA, 1034 bp, Homo sapiens
accactctctactgttacctgaaggccaaggagtgaacctgggatagctctcctgcccagaaggcggaaggactcttttgtatctttttgagttatagtccctgatccctacctgtgatgcaattggcagcagaagctcgtccagggtgaactcacacacatttcaggcgacttaaaccctctttcttaagctaaattctcccataaagttggcctgtaaggacaaaagataatatctcttagatattttgacctcccttctcctactgaatctattgactggctgaggacctttgggacccacaagctttagaacacattctacatcttggacctccacttaagggagcttggtggtcattgctttggcatcagtttgcttgccctgaaccccgtagaaattctatatatcttttatatacccaatataaacccaatcttttatataacctctgcaccatttcttcatggggaatatcccactagccttggtaccgttaactctgcagtgttcgggaacctccttagtcttgcaaggaatgcaggaagatatggcctatctaaattggtaggaagctagaagctgagaccttcatccagggacaagagaaaagctcatattaggccattgcctctggagggaaaacatacaaagcaacactggtgcccacctaaggtcagagatgtctgacacttttagactggacctcaaagggggatgcctaggggatccaactccagacctcagcctctccaaaggggatgccctaggcaaaggttctcaggtctagtactaaggcctccttagaattgtctctctcttgcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcaggatgacgttgcatgtatccaggctttggtg

SEQ ID NO: 43534 - DNA, 1032 bp, Homo sapiens
ttttgtgtcaaatgttggtctttgtcatggtacaggtatgaaatgagtgcccaataaatgtttaggggaggattgaggttgtggtattttgaatctctagaattttcttctggaattatggcctgggaaatacttttaacttttactgtgtcctggatggattttctaattttcttatttttttctatttctccttctgtgtgtgtgtgtgtgtgtgtgtggttttttttctgtactctatggaagactttctcaacctgtatttcaatgttttgactgaatttttaattgcttttatcatattcttaatttctaagacttcttttttattcccttctctcaatgaaggtaaatgtgatagtttctgttgtttttgttgttgtggacaacatatagttaggtcttgctttttttttttttttttgtcttgcttttttatccatgctgacagtctctgttttcaaattagcatatttaagtcactcacttttaaggtgattactgagatagttggattaatgtctaccatatttgtaactcttttctataagtctcccttctgtgtttcatttttatcttccatcttttttgtcttctctggttttaatttagcattttacaaaattttattttattttttatcttagtatattaattatacttaaaaaaatttctttttgattgccctagaatttgcaatatacatatacaacagatccaaatccacttttaagtaacactctactgcttcatgattataatagagaattcccaatcatccctcctgtcccttataagattgctgttactgatttcactttttcataagctatgatccttaaatgtatgattactattattacttttaacaaacttttatttgataattaagaaaaaagattttatctcgtcttcatttatttcttctttaatattcttcctttccttatgtagatctgagtttgacttgcataattttctttctttctgaagaaattattttaacatttctggcaaggtaggtctactggt

SEQ ID NO: 43535 - DNA, 1057 bp, Homo sapiens
aatcaatcatctaggctttaagccccacatgcattagctatctgtcctatctgtctccttccccttgtccccaaccccctgacaggctctggtgtgtgatgttcccctccctgtgtccatgtgttctcattgttcaactcccacttatgagtaagaacatgtggtgtttggttttctgttcctgtgttagtttgctgaggatgatggcttccagtttcatccatatccctgcaaaggacatgaactcattcttttttatggctgcataatattccatggtgaccagtgtgatcatcccattcttctatatattttttttatgcctcattggctatttcttctccatatcctttactggctcttcattttctagttgacatctccattttagaggatcttagggcttcatcctgggcctcttctctacccatattttaagtgatttaatctgtcccaggtctttgtcttttgtctcaattcaagatactagaatgaagatatgtgtggctttcttgaatgaattctttttggggttttctaaacttcctgaatctgtacatttttgtctttcaccaaatttgggaagtttggggcatcttttttattattttcctctggccaatttttaaatcttcttctgggactccaactaccttatgatagaccttttgaaattttccacagatctctgaggatctttaagtttttttcaacatttttcccctctgttcttcccattagatgatttctatgatatctattttcaaattcaccaaatctttccatagtcatattctttttgtggttaagtccatcaggaaattttaaatttcaggtatagtattcttcaattctaaaattcctattatgtttctttttatatttataagatataaatatattttatatttaccagctgaaatttcctgtcttttcattcattgtgagcatgttttcctttatttccataagcacggttgtaatagctgctttcaactttttatctggtaattatgatatttgggttaagattgacttgttgaggatggatcacatt

SEQ ID NO: 43536 - DNA, 1031 bp, Homo sapiens
cagcttgactttatgtgtatacttatgtaaccacctaaataagatgaaatagttgattttaattaacatctgcttagccttgaaatctgtcgcagcttccaagtggataaaacatcttttggtccccaagaaaaactgatgtttattttcaaaacattttggtttgtgatattgatataaaggtagttgcactttcccaacccttccagcttccttggtggaaggtacttcccatgcttgcccctggaaaggcagccacatcatcacacacatgtcctcagcacagaccgctcctcacaggctcttctcttttttcctgtgtttgccaagaggggttttccccctcctcacactctttcccttagtccctgtagcctcatcaagagaaacagactcccaggggcagagcaggaggagctggtttctgtatttctcagattccttctggctttagcaaccctgcaggctgtattcttcttcagttctcctctctcatcactcttttccccttcctagagcttcactccccctgacctgctcctcccctgcatctcaggccatgccacccctggccccatccccaaggccggaggacagaaaatctgctctcatcttcactgcctcatcctcacttcagcagctcaaatgacacttcctcaaggaagctttctctcactgtcccagcgaaaagattgccatgatggcactttactggacttctcaacacactcatctttcttttttttttttttgagatagggtcttgctttgtcacccaggcttcagtgcagtggcaccatcatagctcactgcagccttgatctcctgggctcaagcaatcttcccacctcagagtagctgggactacaggcgcttgccaccatgtccagctaatttatttttagtagagaaggggtctcgctatatcacccaagctggtctcaaactcctgggctcaagcagtcctcgtgcctcagcatccctaagtgttgggattataggtgtgagccactgcacccagccccatcact

SEQ ID NO: 43537 - DNA, 1068 bp, Homo sapiens
tagtattctctgatggtagtttgtatctctgtggggtcagtggtgatatcccctttatcattttttactgtgtctatttgattcttctctcccttcttctttgttactctagctagtggtctatctattttgttagttttaaaaaaaaatcagctcctggattcattgattttttttttgaagggtttttcatgtctccatctccttcagttctgctctgatcttagttacttcttgtcttctgccagcttttggatttgttttctcttgcttctctagttcttttaattgtgatgttagggtgtcaatttgagagctttctagctttctgatgtgggtatttagtgctataaatttccctcttaatactgctttagctgtgtcccagagattctggtacattgtctctttgttttcattggtttcaaagaacttcttgatttctgccttaatttcattatttacccaggagtcattcaggagcaggctgttcagtttccatgtagttgtgtggttttgaatgaatttattaatccctgagttctaatttaattgcactgtggtctgagagacttttatgatttcagttcttttgcatttgctgaggacaacttgtaagttttaaattgcttggcgttctgagtagtgtgatgaaatctcaggttgtccttctctgtcccactcaggacattccatctctttgtccagtgcatccttgagatctacactgttgacctggttggtagtcatcaatttggtttcctcctgacacacaaccatcaacatcattatggctcaatgatccaggatcacctgaagcagatggtccttcttttgacatatcatcagaaggtcaatagtagcctgacgctagtcacaatgcctgtgtcattcacctaatcatgtaggcattttatcatctcacatcatcacaggaagggtgaatgcagtacaaataagatattttgagggagagatcatattggcatcacttttattatagcatattgttataattgttcttttttttttttgagacagtctcactctgtagctcaggctggagtg

SEQ ID NO: 43538 - DNA, 1024 bp, Homo sapiens
tgatgaagccatagaacaatttcctatttccattaatgccagaagcatggtaaatatgcctactgcctctctcattacttaacattgttgcagaaatgtcagctaatacaattgactgaaaaataattcaaaggaaaatgtaaaaatatcattgtttgtagttgatatcattttgaatacttgagaaatccaaataaactactagaaacaatgaaatcatattcattgatgcatatttaatataatttttctatatgcaaacagaaaatatgaagattcttgatacaacagcagcaaaaataatatgctttagaataaactcaagaaaatatgcaggatctatataaagaaaaccgtacttgctaatgcatgtaaaagaagatttaaagaaatggaaggaacatgtattgctttgggatctaaagattcaatcttgaacagatataactgtaaataacatacgttattgaataaagcaattttaataaaaattttagtttttgaaacaagctgattctgaaattcacattgaaattgatatatatggatcaaaaataaaacttctagaagaaaatatggattattttatttttagtgcctttttaaatgacagataaatccaaagacctaaaggaaatgaaagatacatttgctaacataaatatttagaaaataaccataatacaaaaaataccacaaaggtcaaaaatgaactgagaaaaatatttacaatatgtttacttgataaggagctatgttctttatatatgtgtgtgtttgtgtgtgtgtgtatatatatatatatatatatatatacacacacacacatatactttaagttctggggtacatgtgcagcaagtggaggtttgttacataggtatacatgtgccatggtggtttgctgcacccatcaacctgtcatctacattaggtatttctcctaatgctatccctcccctagccccccacccccaacaggccccagtgtgtgatgttcccctccctgtgtccatgtgttctc

SEQ ID NO: 43539 - DNA, 1034 bp, Homo sapiens
tatgttgtcgggtacattgatatatgtaaattatggaagatcatttatatacacatggtaataatttttttattgttcttttccatttagtttgcccttaaactcctgattaatatttgatttgttcatggttgaaactagttgtaacaatttcataactaaaacaaatgttgttcaaacattgtgatataatcaacagaccttgttttgatagaccactcacaaaaatttaatttgggtcatattatctgattgaagttgttcccaacttatgcattatcagtaaaagaaataatttatgaaacggaaacatgggactgatatattatccaggagctgtctgttaaaatgaagtagaagggcctaacatggtggcttatgcctgtaatcccaacacttttgagaggccaaggtggagttcacttgaggccagaagtttgaaaccagcctgggcaacagagccagatctcatctctactaaaataaaataaaattatcctagcacggtgacgcatgcctgtagtactagctatttaggaagctgatgtgggaggatcgcattagcccgggaggttgagactgcactgagctatgatcatgccactgcactccagcctgggcaacatagcaagaccatgtctctacaaaaaagaaaaaaagttcatttactgagtgtcaactatccaggcatgtggaatacaccagcattcatattactacattctaacagagtgggggaaggagggaagacagaagataaataataaacatagtaaatgggtaaattttgtagggtgttagaaggtgataaggattttaggccaggcatggtggcctggggaggctgagacaagaggacatttgagcccaggagtttaagaccagcctgggtgagacccccatctctataaaaaattacaaaaagagattttagaagaaagaaaaggtaagggtaaggcagatcaggagcaccaagatcagggggtaggagatggaaaaatcaaatgaggtggtcagggcaggtcttcttgaaa

SEQ ID NO: 43540 - DNA, 1047 bp, Homo sapiens
aatctctttatggacacttagggttgcttccgtatcttggctattgtgaataatgctgaaatgaacatgggagtgcagacatctctgatgtactgatttcagttcctttgtatatatactctgaagtgggattgcgagttctatttatagtgtttttgaggaaacttacatggctttctagaatgactgtatgaatttacgttcccaccaacagtgtgcaagagttcccttttctccacatcctctccaacacttatcatttgtctgttttgataatagccattctaacaggtgtacattgatatctcattgtggttttaatttgaatttcccctatgatttgagaagctgagcattttttttttcatacatctgttggccatttgtatctttccttttgagaaatgacttcagattctttgcccattttaaaaattgagttgttttgttgctattgagttatttgagtaccttatatattttgaatattggggccttatcagaggtatggtttgcagatattttctcccaatcctcgggttgactctatactgttaattatttcctttgttgtgcagaagcattttagtttgacacaatcctatttggctatttttgctttccttgcctgtgcttttgcagtcttatccaagaaatcattgcccagatcaatattgtggatctttttgcagagagaggattacaagtttcctgattctcccattaatctctccaaacacgaaactcttagttaagggagtagcatttcaaagaagacatcactataatttatcgtttataaatgaaaggtgcagagaccttttcttaccaatttgtggacctcttcgtttttctttcattctttcttcctttctttccagtgttggtaaggttttggcctgctgtactccaggtactttttgatgcttgagatgtataagtaaaacaaagactcctatccttgtggacaatcatgtgaatgtgggattatcttctgccttaaagcaggagaataactggcttatttgggcagtagcaaggaggagc

SEQ ID NO: 43541 - DNA, 1067 bp, Homo sapiens
agtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactg

SEQ ID NO: 43542 - DNA, 1022 bp, Homo sapiens
catattgagcaattaaggagaagtatttaaacaaaacaagtgatggttgatatatttatgtatgacaaactgttttactctttatttccccatcatgttccctttttaaattttaagaggaatataagagtttttttcttcatttcatctcctgttttggaataacactgtatttcactaagtttcttcagagggagaacctttagatcaaaggttaaatttggagagcactgttcgtgatatttgttaagtacttaataaatatgcactgaatgagtatgcatgacactggttgaatgccaacacctgggtataattctggaaaccagaactcagttcatgctttatgtagtctccttcctttttaatcttccataggttgagtaccctttatccaaaatgattgggaccagaaatccagttcagccagtttcagattttttcagattttaggatatttgcattatatgttagatttacatcatccctaatctaaaaatctagactctgaagtgctcccgtgagtatttcaagtgtcatgtcagcactcaaaacatttcagtttttggagcattttggattttgaatttttgaattagggatactcaactttttgtgtgacagggtcttgctctgttgtccaggctgcagcacagtggtgagatcacagctcactgcagcctcgatctgggctcaagtcatcccccagccttagcctcctgagtagctgggtctgtagacatgcatcaccacacttggctaattatttgatttttttgtagagacaagatcttatgttgcccaggctagtctcaaactcttgagctcaggcactcctctcacctaggcctcccaaagtgctaggattacaggtgcgagttacaacacctggccaacctttactccttattacactaactttatcgttagtgttctactctacccacaactctggggaaactgaggctggggtagcttgctggtgcactagtaattccaaacttgaacgggagaaatgctta

SEQ ID NO: 43543 - DNA, 1028 bp, Homo sapiens
acaaatggtcttttccagacattctcaactgtcgtggttgttttgataacttgaaagcaaactgtttctagcacccatctcttgtccttcctaaggagaaaactatctcattgaaataaagaaaggcttgttttatgactggtgcctttctggactctcatttagttttttacactgacatcagcctcctcaagattggtcgtcttttaagcactagtttgtttcattatttgtaccatcaaaatatgtgagaaaaggaaaaaaaaaggaaaaattatcttaatattttagaacactgaattcagatttcaagtgtcaaatgtttgcaaaaaagtcccaatattctctgaaaacattggatttctcttatgtaaaataccatttagacagaatgaaaaaagagaactgtatttggagtgctgagaccttgaaattggaatcttcggacctggtgaaggtgtggaatccaggagttgggaaagtgctgcaaaagcttcaccagtgggtgggttaataaaaataatttcgaatatctgtgtagtgctgtgtgtcaggtactgaaccaagtatgaaatgtaatcctagaacaattcattgagaagagagttgtacttttaactacattttatagatgagcaaactgaggcatagagaataaataacttaaaaagggccacacagctattaagttgcagaactggggctttaacccaagtagtttgggtttgtactcaattatttttcaacggttgacctccatggagaacgccttggatcttttccaacaaaaatttttaatcttctctattgacatttgtagcattgggagatgcagcactccctaagttagtaatgtacaatttgaatgtgcttcctacaggtgaatgatttatagccgcactgcccctcctggagggagacctatcattccttcattcctactatataatttattttatttttagttggcaaataattgtatgtatttgtgggctacaatgtgatgtttcaatctatgtacacattga

SEQ ID NO: 43544 - DNA, 1050 bp, Homo sapiens
tgcaatggcgcgatctcagctcactgcaacctctgcctcctgggttcaagcaattctcctgtctcagcctcctgagtagctgggctaccggtgtgcaccaccgcacccagctaatttttgtattttttgtagaaagagggttttgccatgttgcccaggctggtctcaaactcctgggctcaagcaatccacccacctcagcctcccaaagtgctgggattacaggcatgagtcaccatgcccggcccctagaattttcattttatgttttttaatttgctaggatatcacattctaagttaaaagtttcctttagattttgaaggcattgcttcattttcttgattttctagaatagctattgggaagtccaaagtaattccaatttttgatcttttcataaggccttttatcattgctttgttttttatttttcttctgtggaagtttatagcatcttctcattcctggtgttctaaaatttcacggtggtgagccctttcaatctggaatgcaggtctctcaattttaagaattttaaaaattcttttctcacctctgtgtctgcagttctattcttcagataggcactatcctagcttacaccagtttagccctattcagggtagcagggactacacaaaagtgttctttttagggatcagcgattattaattagggtcattttagagagtggctgccacagtattcttgttttttagtgaaagatgaaaagttgattggtagccctgagtgcctgagtagggcttgttgatcccccactgcagggtgattttctaggtagttggttggggaacatctgagttcagttatctattgatttttcttctttgggtggcttgtattttcccagagaaggctcccacgtggaagggaaagccatgctgtgagtgttctgggagctgagtggagggagtctgggaaatctgtcattggttttccattcattcgtatgatcctctatgtctgttgcggcaacttccttaagacccacctgatgtctccgtggccagagaacctctgttatac

SEQ ID NO: 43545 - DNA, 1045 bp, Homo sapiens
catctcctggcttcaagcgattctcctgcctcagcctcccgagtagctgggactacaggtgtgcaccaccatacccagctaatttttgtatttttagtagagatggggtttccccatgttggccaggctgatcttgaactcctgacctcaagtcatccacccacctcagcctcccaaagtgctgggattacaggtgtgagccaccatgcctggctgaatattattttaaactttggaaatatcttaacatgctacataaactaatgaattgtttagccccagggaaaaaagcatcagcgcccccccccccttaaactggtgggaactcttgtaaaatggactatttaggaaatgccattgcaaataataatagaattcagaatgtgcagttctatcacattccttttccatctaggcaatatagttacatatttttcaggaatttggaacttagtttggccatatgttgtttgttcagctcctgtggcaaaaataattatttgttggattattggatattttcatagactttaccacctcccttccaaactctcttaggcctctgtgcataaggcataatattttttaatttttatttaattgtttatttgttattttttgagacagagtctcgctctgttgcccaggctggagtgcagtggtgcaatcttggctcactgcaagctctgcctcccgggttcacaccattctcctgcttcagcctcctgagtagctggaactacaggcgtctgccactgtgtccggctaatttttttggatttttagtagagacgtgttttcaccgtgttagccaggatggtctcgatctcctgacctcgtgatccgcccgtctcggcctcccaaagtgctgggattacagacataaaccaccgcacccagccttttttaattttttattttgtagagatgaggtcttgctatgttgccgaggctgatggcaaactcctagcctcaagtgatcctcttgcctcagcttctcaaagtgttgggatgacaggcgtgagcggccaaggcatagtattaa

SEQ ID NO: 43546 - DNA, 1028 bp, Homo sapiens
aatttggggtcctctcgagtcatgtgggccaatgtgtgcaaatacttataagatgaaactcagcaggtattgcacataaaaccagctggtgtctccgagggagggtgcctccttggggagtcctcagacccggatgatttgttacccataatttagagacctgaatcattcatgactctgagcagtgttttgggcctaaatgtgccgcttgtgagtgtatcacttcggtgtgtcaccagtaagtcaggtctcctctcttatgtgtctcagaaacgctgaatcccctgaaggtcacagaggactcacaaatgcaagatgaccagcctttatgcacactcactggcagggtgagagggtacagatgttctcacagaggaaaccctgtaaggccactgaatgttatggacaaagtcctggcacctcgccaagtctctgattatttagagttccctaatgggccagagggagtgagtgcctttaatcttcggagggaagtattcattctcataaattaggaaaagggactccaagagaggttggtccagggtgaaacaagcacagtttccataatgaaaggtcacaatgcaacaagaccttggccccaaaccaaagtaaattggcgacttaagacccatgtgttggcagataaaaatcctgatcccctgaccttaggaaagtcagagataggagttcatgttggtaccaagtgccgctttcagagagaaacactgggcagtggtggagggagggacctattctgccaactatgccagatatgttgacccaaaggaaaaaactgaagctaaattaatataagtatagagtttattttgggccaagtttgaggactgcaacccaggagtgtatattccgggcaacttaaatagatactcccagcttgcagtcctcaaatttggctcaaatgaactctactgacattaattttgccttcgtttttctttttggggggttgacatagtgtgatgttcactcagtcaacagtttgtttctgtcacaggcactttttg

SEQ ID NO: 43547 - DNA, 1050 bp, Homo sapiens
gtctcactctgtcacccaggctggagtgcagtggtgccatcttggctcactgcaacctccacctcctgggttcaggcgattctccttcctcagcctcccgagtatctgggactacaggtgcgtgccaccaaacctggctaatttttatattttagtgaggcggggttgcaccatattggccagtctggtctcgaactcctgaccttgagtgatctgtcctccttggcctcccaaagtgctgggattacaggtgtgagcccctgcgcccggcctttgttttaccatttaaaatagtatctaaaaaatcatttacttctccgagcccttcttagctatggtgaatgtgatggacttaagtgctttgagatctctagtatcaaagatgtatttacaaatatgatgaaataatagtgacatcaattaagagctccaaaatatgaaaatccaacaaatagaatttttaaagcctgttcaaaagatttatatttttcatagggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtaagtatacaaatctgtaatttttttcgaagaaaatattaggatgaaacttgataggcaattgttgccatagtcacctgagaaagtagttattttagagacttttttttttgagacaagcctctgttaccgaggctagagtgtagtgatgcaatcacatctcactgcagcctcgaccttcccggctcaagcaatgctcccacctcagcccctcaggtagctggaactacaggcgcacaccactacacctggctgatttttaaattttttttagagatgaattctccctgtgttgcccaagctggtctcaaactcctgggctcaagtgattctccaggcctctcaaagtgcttg

SEQ ID NO: 43548 - DNA, 1002 bp, Homo sapiens
tgcacaggagccaccaatgcctttagctactggttctctttcatccattgtgatttaaagtaaaccagtattggctgggcatggtggcttacacctgtaatcccagcactttgggaggctgaagcggggagatcacttgagcccaggagtttgagaccagcctgggaaacacagcaagaccttatctctataaaaataaaataaaccaatcttacatttgttagtgtagcagaaaccagccttcttcgaagtggtcttggtgtgattctcctatccgttatcaaaaacttgaagctgtgatttgcctgaggtaagacatcttgggtacactgaaatcaaatatttaatttttttggtgaaaaaatagtctatgatatatatcctgtgttgctttcaccataatggattggttattgaatcaaacatatgctgattgctgtgcatctgccagttaaggctgaggtaagaacagaaattagttgtcaagagataaacttactagctgaggtatttgtaagggagttacagaagtgatattccaaaacagcagtggtccctaaaactcagcagaaaagcagagtaaatactactcatcatcatatccctagcatttagcaagagtgtgtggcacaaagtagacacatggtaaatattggttaggcgagtgaatgggttaatgtatgaaaaaaaaaaataggaaccagtgcctatctgcctttccatctattgaaaaatcactataaaatacatagataacctttaagccattgaaactcatccagttgagttaaaaggattactacatcaaggttagttgcattgcaggtcatcctacttaaatatggctttttaaaattaaatatattgtaggtggtagatctttcatccatggagaaaattttaatgttagcatttgtcttttctctacactttcttttttttttcaagctctgcctcccgggtttacgccattctcctgcctcagcctcccaactagctggg

SEQ ID NO: 43549 - DNA, 1089 bp, Homo sapiens
ttgtcacatgttcctaattttggtaagataggaaactctagtgttccataatttttattctgtaattctttgtgtgtggcttatttagtaatgatatacagtatctttttcctttaacaagttatagaatctatggcttgaacagaagacaatcttgtaagggaatggggtggtctttgaaagtttagtagttggtaagtccttggttcaaatctcagctctgccacattttaatggtttatccttggacaagatactaaacttttctaagcttcaatttccagttatctagaatggggatgattcacctaaatactcttatgccttgtttacttcagggtattatattaagaatgtattttgactttgtcaggcaatgttgctataaggcctaataataataattaataaagaatatgttcttagtgtttgtattttatttcacttgatgttttaaagtaattatattttggagaattctaacagtatactattctaagtgccttcctggattaagattgaaaaagagatgatatacataaagttgtaaacagtgcttaccacgtagtagttattcaatacatattgtcctatcttctcccttctgttaataaagctaattttgttcaacttacttttagacatgatactctcttaaagtagatttaattatgtaatgcattaaaaaattatctctaaacaatattccatttgagccctcagatttggagatagcagaatgtttggtgatgtcatacatctttcttaaagtttaaaaagatgggatatggggagatatccagcattatgccaaattttgagcaacaatttgtaacctgagcacttagcactgtagaaaacagggcctgatcccctgaatgcctgccataatcattggagatgattaaagtgacccgggggtcttggaggcattgcatatataattatttaattttgagctactgaaatttaatttggctaaaactatgcaagaaacataagttactatagataataaagctttcatatatgttttacccacttttgaatcccctctagtacacttatagcaagcatagatcgatcatg

SEQ ID NO: 43550 - DNA, 1030 bp, Homo sapiens
gtgcatgccaccatgcctggcttatttttgtattttttgtagagatggggttttgccatgttgcccacctggtctcaaactcctggcttaagcgatcctcctacctctacctcccaaagtgctgggattacagacatgtgccaccatgcccagcccattaaactcaacattatcaaaggctatattcaagatgatcttgaattcccaaatttgtaaacgtggaaatgtttgtaccaggcatgtatgactttgtcctttcaaatcatgtttgtcaggtttcctgtagattatccatatgccacaagttaaccacattttcaactttaatgcaaagttgttctcttatctagtgagctacttgtatattagctagaaacagctccttcctgaaacagttttagctttacaattttttttctctttccttttgttgtgaattcatttacctaacagatggagtcccctttgaactggatacttaattttaaatttattcacaaatttttttctgactaaaagccattacttctttctttctttctttcagtcatttatttatttattttaagaaatgggatcacagtctgtgagccaggctggagtgcagtggtacaatcatagctcattgcaacctcgacctcctgggctcaaaccgtcttcccccctcagcctcccaagtagctgggattacagacatgtgccaccatgcctgactaattttatttttagagacagggtcttgtggctgggcacggtggctcacgcctgtaatcccagcactttgggaggccaaggtgggcagatcttgaggtcaggagttctggagcagcctggccaacatggtgaaaccctgtctctactaaaaatacaaaaattagccaggcgtggtggcacaaacctgtaatcccagctactcaggaggctgtggcaggagaattacttgaacccgggaggcagaggttgccgtgagccaaaattacaccattgcactccagctctgggcaacagagcaagactctgtctcgaaaaa

SEQ ID NO: 43551 - DNA, 1195 bp, Homo sapiens
tgggatcccgcgcttccgagactcgcagtctacgcgagctgcctgtttttttcctgcttggacgcgcatgagggccccgtccatggaccgcgcggccgtggcgagggtgggcgcggtagcgagcgccagcgtgtgcgccctggtggcgggggtggtgctggctcagtacatattcaccttgaagaggaagacggggcggaagaccaagatcatcgagatggtgagtgtggaggctcggcgcgcccagagcacgcgaggggccggctgggccgtccgctggcctcggcagcctgtgctgggccgctgttcggtcgcgacggggagctgccggcgtcgcctgtcaggctgggatctcgctagctcgggacgcgcagcttgggggacccggccgccccgcgtgcggccactccgcgggcttggtgaccagggttgggtccccggctgcggcccttggctgcccgtggtctttgttaggtttccgtttgaaggaacaaggcagaaaatagatgaatcggacacaggctactttgtgctgcaaaacccgtttctctagagataagctgcatgtcctgggcaggtggctccttctctccctgccttgctcccgccctccccccggatccgcgtcaaaccgttgccgctaatctagttgcaattcccgcagaggactagttttatgttggggctgccgtgagttagattatgaaaatgtgcaatatctaaaattttacaagaatggcaatccaggagaaattcaggatagtttattttgtatttgaatgtattccttcttgtctcaaaactcccacgaaatatctttgttttcatcttaactcccaaagctcttgtatacattttcgaatttaattttttattgaagagggtgtctcaagaattccctttgagatacattataagtaattgtttcaaaaatgaggatatttagtttcgttttgtattttaattagaacccactcaggaagacaattcttgcacaaacttgcacgcttatgtatttcctgaaatgcataatcctgggtatacgcctgaccgtgtgctatacatgtgaacatctagggtcagatgatttatgatagaaaaaaatttaaaatctacactaaataatatcattttagggtgtaatacttggaatttctgagcacctgcaatatgttccaactgacgaaagacacga

SEQ ID NO: 43552 - DNA, 1048 bp, Homo sapiens
aagctccttttccttgtcggcctcacccggctcagcccctcggtccatcctctgctggtttcttgagctcagcagctcagagagcagtaaactctgaggagatctgacagctatccagtcccgctccctggtacaggcatccctcctgcagctccctggccaaggtgccagggtgtgtgtgcacgagggagacttagagtggcaggccacggccaagaaaacttgctgtttcataactctcagcgaagaaatattctttaaaaacatgagtctattgtaaatttaatattcatagaaacttgaaaaaaatccaaaagtttgaaaacacattaattgtaaatgcagttattgagtggtaaaaatgtacatcagagatatagcatgtgtgtgactgtaaaacatgacagggccttcagggtataataaactattctagcataacaggccatttctattattccaggaagcctggtttactttaattctatattttgaggtagtgaaactttttttttttaatctcagaatcttatttggagctccccagtcattgctatataaggacagatttttctgcttcaccagtaacttttctctaagaacagctacattgtttttggtatagttcttctggtacatttgtttcctgttttttcaatcaggtgtaacttgtctttttttctagttttgaggggtaactaagatgatgttggcaccggaagcccaggaaaaagccaggcaagggtggctccaaggggagcaggagagaatcccagcgctcttgccatgctgtttatacctgttcccttttttaggaagatgagactaagccagaagattgcataccagatgtaccaggcaatgaacacgccagggaatttctggctcatgcaccaactaaaggactttggatgccactggggaaagaagtcaaagttatgcagtgtgagtgtgggagagtttccctaatccatgcaacttacatgcctcaatttacaaagagtgtttacttcttttatttaacttgttctcatcacagccctcttac

SEQ ID NO: 43553 - DNA, 2481 bp, Homo sapiens
gaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttg

SEQ ID NO: 43554 - DNA, 1023 bp, Homo sapiens
tttaccagcctcagctgcttctgcctgtggccagagtccgggagacatatctgattcttcacgtcagtgcagaagtgacacccagtgccattgactactcctccccctcacccctggtcatatgcagacacttatgcatgagggctgagcacacactttctgaggcagggtcagtgttcccttttccttacttcatcccctctctggcgatgaggtcgctttttgaagagaacttaaatgatctttttcacgaactctacatttaatgggggctgcccagagttcctgtggcccctctgatctgttcctgatctcctccccctcttttgaatttttaccgttgtctctacccagttcttcattgtttctgagcttttgtgagaagagcctggacgtccttttgtagacataagtagtcagcagaaaatgccttttcttccacataaggaaccagctagtcagaggacaataccttcatcttccaattttctgttctctgttatcttctttggtcattggaggttcagagtggtttctctgatatctgagagatttttttaagctgctttatttctagatatgttccagaagccctgagggcctggatgattagtctgtatgtcaaagccctttttaattttgcttgatgtccccctttacatctggagtgaatagtcatcattaacacagttaatcttcctaccttctcttcccgtgatccaaccaagttgcctatgaagtattcttaggctctgtagcagaatggaatagtgttttgtattagttttccactcttccactgccctctacctgttttaaggaaaagttgaatttcttaaattttatgccagttttgcttccattattttgcatgatattttcttattctttattttaaaaaaatcaagcatttgctgcttatacaggctggatttttggccaaaaaacacatcttaaataggctgtgaatctaccatctcaaagttttccagctacttttttttttttttttttttttttgag

SEQ ID NO: 43555 - DNA, 1064 bp, Homo sapiens
aataatttggattgttgagaaagtatctttatgtgttaagatttttgtttaattgagtgcattctataatttatcttatatggttgtagttaatagtaatgtaaccgtttaactcagcgaagtgccaggcatgatactaggtagtgtaaagatgaattatacacagactcagccttgaggccattgcattctagcagaggaaactggtatgtgtgtaactagctatttaggtgctgtaatcgtggtattatagctaggatagctggataagcaatacaaaatgccacatttgaagtcttttgattttgaaggacaaattacagatttttaaggcaggaagaaaggcacagaatcattaaagcacttggggttttaggggattgttgcccagtgcatctagaatgaagggtgtgtggtgggattgactggaaataggccagtgtgggctacatgttgtgtgtaatgggaagtcatggggcttttcaagcaaggggatgtgatgcttagaggtgtatgtttcgaaattgacttcaccccctaggatggattgtacttgtggggcagggaaaccaatactgatgacttcagcttccggaaagaaactttaaaactcaaaacgaacccttgtaacagtgagaaatggctagtaatgttaggaagggattggaaatagaacttgtcaagcttgatttgaaaactttatccagatagatttaaggagtgtccttaacttctttttatgtcattttgtcacttgagggttagtaatgccaaaagtctttagcgtgctttaggtacagatgaacctcaatttaggagtaggttgaatttttaagttttcacttactcaacatgataatgtgtatcattttggacttagaatacatttcttcggccgggtgcggtggctcatgcctgttatcccggcactttgggaggctgaggcggggggatcacaaggccaggagatcgataccatcctggttagcacggtgaaaccccgtctctactaaaaaatacaaaaaattagccgggtgtggtggcaggtgcctgcagtcccagct

SEQ ID NO: 43556 - DNA, 1069 bp, Homo sapiens
accatattaattatgacattaagtgtaaatggacttgtggtaggtaggctgaataatgagccccccatgatggccatgtcctaattcccagaaattgtgaattacgttactcacatggaaaaaggaaatttacaaatgtgattaaattaatgctcatgagatgtggatattatccttattatccaggtaggacaaatgtaatcacaaagtctttataaggaggaggcaaaagagtaagagatcaaaaaggcgatgtgatggtagaagcagaagttggagtgatataaggccacaagccaaggaaggaggccagcttctagggctggaaaaggcaaggaagtggattttcttctagagcctcctgaaggattggagccctgccaataccgtgattttagacttatgagctccagaatttgaaagagaataaatatatgttgctttaagcaactgtttgtggtaatttgttatagcagcaataggaaacgaatatagctctaaacaccacaaatgaaaaccaagaattgtcagattgcatagcaaagcaagaccctactataggctactttcaagaaatttacttaaatataaagaaacgaagaggttaaaagttaacagataggaaaaggacatgtgatgctactactagtcagtgaaagctggggtggctgtaataacatcaaagtacatttgaatgctaagaatattatcaaggttaaacaaggaattttaaatgaagaagggatctatatttcaagaggatgtagcaactctgaacatttatgcacttagataagagagcttcaaaaatatgaaacacaactgatagaactttaggaaaaaatagacaaatctacagtatagttagaaattttaatagccatgtctaaataatttgtagaacaaataaaaagaaatttggcaagaatgtggaagacttgaatgacgccatcaaccaatatgacctaattgacatttatagtacacaccaccctagaacagcaaaatagacattcaagcacacgcagactatttatcaaaaaagaccattttctaggccacaaagcaa

SEQ ID NO: 43557 - DNA, 1035 bp, Homo sapiens
aaaaaattattttggttattctagtagttgtcagggtaatcatttttaaaagtggatttttggcctattgttagaggcaaatgtttaaattatttaaaagttttaggtcttctgtctaggagccagggcttggagtcagacaccttagaagtgtacctgatgctctctctgttctactgtggtgaactggcatggaaaccactgtggtgactgagcatcccatatgcttgaaattctaagcaacatccaatgcataagtgatagtttgtcaggattttgtaagaattcccactacggtcaaatcacctattgtaccatattttggtgaccatccccatttctcaagattctgtgaaggtgcttttcctacctcttctgataccgtggatgtccattgtctaagtgttctacttgatacactaaatttcaattcatttatttgtcagagcttctttagatgaaattaagcattgaaagatgtgttttcactacattcagtctctgtcagaatatattctctgaaaactgtgtgaattatgagaagaaaactgtatatcctaagctgctctctgctacccagtacaactttagactatcttatacagtaatgagcagtatatgcaaaattaaattgctgtaagttttattacattcaaaatataagtaggaatgtggaaactgccatccccaaaatagttgatgctgttttgagtcatgtatatcagtgttccatccagtgagtattgagatttcaatttgctagtaagatttttttagtctattctattatcatttattttaaaatcttttaaactattgtttaaatttaaagggctcggacaaaaatagtttattctacatatagtcgaaaatctgccaaagaagtaggagagaaattgttggagttacatgtgaattattatgttttagaagaggcatggtgtgttgtgagaactaagtgagtattaaccctatgctatctgatatggtacatttttgagcaacaaatgtttcactttattacagtagtcctga

SEQ ID NO: 43558 - DNA, 1029 bp, Homo sapiens
gtcctgtttggcttgaagaatctataagaaattctggggttctatcagtgttatctaacatacaaaagaactagataaattgctagaatattgggcctaaggtacttctacaaacacctcacttagtttttattatgagtgtatagccttaaaatatcataatgcctgttttcctgagaagaatctatatatatcatgctaatagggcttccctgtctactaaccatgtccacaaaaggcagccaaggatgaaaggatttagttctaagatgtttcacagttgtgatttgtttattttaatccttagtagtaaattagtactagaaggatcaggtatatcttccttaattcttcccaggggagagaaagtcccattttcacctgggccctgtaatgccaatatatccgttgctttagaaacaatcggagatgataattctgtatacatgtgtgctgatatcaaagggtaattcacgttggtttgagtaacaaggtgagaatttattgttgaccctatagtactcttcatataagaactagaaataaatggtttctttcgtttcagctctttggctggctttttcgcagagttcgttttgataatgttatctttggcattctaacagtgatgtcaatacaaggttatgcaaacctccgtaatcaatggagcataataggagaatttaataatttgcctcaggaagaacttttacagtggatcaaatacaataccacatcaggtgtgtaggtatttggttatatgctagttttatacaaacatacagacacatttgtgtatactatatataattattgtcatttctgatatatgtatgtatgacagatttacagataggcattcatactctcacagactttgagcagactattgcaatgtcaatcaattaaacccttccaaaaggcaattttgcaccccctttaagcccctcccagataattatcaaagaatttaaatcagcaccaggaaattaatgatttttcacaagttatgtcctttaactctcagac

SEQ ID NO: 43559 - DNA, 1062 bp, Homo sapiens
ccttgaacacagtgaggtaaagctttcattttaatctctggtagacttgtgtattaaattctagtttgagggtaattgacaaaggtataaccttgctgctgatgcaccatcagtagtgagttgttcagcatttgtgataaatttctgccgatccttctcactctttcatctgctgttacttttgaatagtaataaggatttaaaagctagaaggctgatttatgactatagtacagaattaaattaaattgcattcatttaacaataacaagcatttggtttctagcctgctgagctaatcagctacagtccattagggcaggcacccttcgccctgtgactggtggccatctgccaccatgtagatttgctggtcagtaagtgacaagctcagaagtgttgaaggatacaaaagatactaaagtcatgttcctgcccttcagtatgtgtaattttacaaaggagacaaataagacaacattttatatggtgtaaaattattttgtggcatacaaaggaaaagatcagtgtgggctggaaatatttcctatttgatagaactttaagtgggtcttgaggtaaaggtcaaatttacaggagtgggtaactgaatttgaacttaatagagatagtttatgacacatgttgagtatcccttatccaaaatgcttaggactagaggcgtttcagatttcagattttattgaattttggaatatttacaatgtagttactagttgagcatccctaacctgaaaatccaaaatccaaaatgcttcaatgagcatttgttttagcataacctttgaacatcatattggtactcaaaagtttcagattttggagcattgtagatttcagatttttggatcagggatgcattagtaactttgtcactttacagtgaggcccactgtgttggtcctccacctcctcacaccacctcctgctctccctagctcctctgcctgctccattttcttgccaactgcacttattgccttacagtagactatgtaatggatttatttatttgttatttctatgtattgtctttcatta

SEQ ID NO: 43560 - DNA, 1032 bp, Homo sapiens
tatcttccaagatattgaaacaagttcttttgcatgtgaaaataaccacctaattctttcctacgttcatgtaaaattttgttaatatgacttatgcttcagacttaaaggacatcagcttgaatgtatgttatagttgttgttttattagcggttgctcagctcacttgactttcttcttaatgacctcaaaagatggtcactctctaatattgtagtaaattaagcctttgagtaaataacatcagctgtttaggctgctggggttcaacattatcaggtgtttgtatataaagattaaaatatatggcagctggtaaattaattagggtccgtgttatgccagattatcctccccattaacttttgctttgaatatattcaccagtacctctcagtgaatgataaaatgttttcatttcaacaagcctaactcatgggattcaataagtctgttcaagggatatttaaaaataggttacacttttaaacaagtgataatggactcactagagcttaacatttctctttgatgtcagatatagttttataatagaactgcaagtaatattctagtcaatttctccaccgactttagcattcagtcactgagaaaaatcctgtttggaccacattattctgaattaggattatacagacaggcagaataaattggaaaaaatataatctaagaggataaaatatttttacctgttttagatatacttttaaaggcacttatatttaccatcttctatgtgccagacactattttagggaattcaaatgcattttctcatttaatccttatagtaatacttcttattgttattctctgttttatttttattttccatagcactattatcaacatctaacatactacatgtttttcttattctctcccccacttttcaccccaactcccagtcttccctttaccctcatcactcattagacagggaattttttttttttttttttttttttgctatctctgcaattccttgttcatagtagtgactcaatact

SEQ ID NO: 43561 - DNA, 1023 bp, Homo sapiens
ggctggagtgcagtggcataatcccagctcactgcaacctccgcctcctgggttgaagtgagtctcctgccatgggctcctgagtagctgggattacaggtgtacaccacgatgcccagggaatttttgtatttataatagagacggggtttcaccatgttggccaggctggtctcgaactcctgatctcaggtaatccacctgcctcagcctcccaaagtgctgggattacaggcgtgagccaccgcgcccggccagcatcagttttctttgtgcatcttttccacaatcctctcactgcagatgttttcagtctttccctctgcttggtatacttttctctacttatagcttcttagtaaccgctgcctgttatgatccttcatcctcccatttctgcctcatgtcttggttctatgcatttttccagtttcagccctgttgttgactgctggattcctatctgtgtttccaagttaaaattctcaaaagaaggaacctgactgtctcaacacaaagtttcttgctagacaatatcatgtgtcaaaagtcagcatattgacgggttgcctgggcttagtgtcaacgcagttccatcacctgctgcctgagagtgaggtgggatcagttgccaggctcatttggtcctgccccttcagcagaggctttagcatcagttgtctttagaagaggctgtgggtaccaaggctggccttctgcttcgtggcttggtggggaggaacagagcaagagtagttagagatccctgaataggatcaggagtgcccagtactaataaagccaatatttgtacaacactctaacatttgctaagcactataaagtcatgatctcattttgtgcatacctgggaaacacttattctactatagtgtgattgcctctttccttgggtctctcttacaagcagaccacagggaccctgaaggcaggaactatgtcctgttattgtgatatccttagcaccaactctacagataatattctagaaatatttattaa

SEQ ID NO: 43562 - DNA, 1016 bp, Homo sapiens
tatgatggggcctgagaatctgcatttctgacaagctcccagatgatgctaatgcttctgatgtttggactacactttgaatagcaaggatctacgtaactaatttttttttactcagtctcactatagatctactcaatttagtgtttaggggaatgtggttgagtgaaggtatacttgaaagagtacagagcccagcaatctgtttttaaaagtttttaaacgttccacaagtgtttctaatcaacttggtaacaactgtgctagagtaaaaccatgatgtattacagggatatgctaatcttgctgcatgttgtccagaatctttgttgtattgagagttttataaagcagttttcttaagaagcttgccatagtcaccctatatttagcaattacagcaggccccttgggttaggcacttccagaggaaatgcagccacaggtaaagcagcttagagagtaggatcttggagaacatggtttggaccagggttgtgtgtgaaagcagactgttttactggggtattattgtttgttatttttgaggtaaaggaagcttgagtaacagatagtgataatttctgtgttgcgtatcaagccatggggctgcagtgtgtggcactggtctggatccatgatgatggagctagaaatgagaatatggctaggacctcagaattgtaatgtaggtggtgtaaccaaggagtagctattgactgctgtgctcaacaggacggcataaacactcaggtactttttacttagaactttaaacttaattcagttattaatacagaaaaacaaagctgaatatatagcaaatagaagagaactaatttgtctcagatttcttaaatgtgaagccttttctttcaaaataaatgtttagatgaggctggttgtagactttcataaagtacctgtgaaactatttttgttttcagaaagtgattactattaatataaaccaagatttacttgtaaaaagcagtgttctcagggtttatattatg

SEQ ID NO: 43563 - DNA, 1058 bp, Homo sapiens
ggagttctgcagataattctccagaggacatcagctgaatgtcctttaattcagtgtacttctgacactatctacctggggatagattccacaggttgagggctcaatcccacaagactgccccccttcatatgtggtcccaagcacaggttgtggtctgtgtttttgaccaactggttataaattggggttcccgtgaccccctcctggggttcaattaatttgttagtgcagctcacagaactcaaggaaacatgttacttacatttgctcacttacaaaggatattattacaaaggatacaaatggaagagagatgcataggacgagttcttggagaaagggctcagagcttccatgccctttctgggcccatccactcttgaggaacttcgactcattctactgtgctggagctctcagaactcagtccttttgggttttatggaagcttcgttaggtaggcgtgattgattaaatcattggtcattggtttgtcaactcaaccttaagccactctccctctctggaggttgggggtgggggtgggactgaaagttgcaaccttctaatcactttgttggttcccctgttaaattgtagggtcccccagccaccagttgtcttattagcacactaaagatactcatctttctgaagattccaaggattttaggagctgttcggcaggaaacagcatgaaaaccaaatacattttatacattttacgataccacagtgctcctctctctctctctctctctctctctctctctctctctctctctctctctctctctctctatatatatatatatatatatatataggttgtaagacttatgattttaaaacctgtgcactgtatttgattgtttatatataggagtttgtacatgtgcatttgaggaatggcacactccaaaatgcttccaggagaaactggaatatgtgtaatggttaagtatcttggaaggatagctatacctttggtgtgtaaggatgcctgaaccacagatcttagtatgataatttctattatggctaattttaatata

SEQ ID NO: 43564 - DNA, 1053 bp, Homo sapiens
atcccaccttggtctctcaaggtgctgggattacaggcatgagccactgtattaaagagccctggggcctcttttataaaggcactaatcacagtcatgaagggtctaccctaatgacctaatcactttccaaaggccctacctcctaataccctcaccttgggggttaggatttcaaaataagaatgtgggtggggcataaatattcagattatagcaatgcagaaaattaaaacctgcatttcccatgatgtattacaatcaggagtctacctttggctataggacttcaagtaagggaaccacatatcccggaatgcaatgtatcacatctcttttttcttcttacccattctttttctttggagttatatattatattgggagatgtatttttcttattaacataagtgatgatataatggagaagagagaggtttgacatgaaatttattgcctctaaaagtgttacccatgtgcaggtgtgtgaatgcctgattcttcaagtggtgtaaacattgattctctgaactctagggggagcggataaactaccttttttctcccttttaaaataaaataactttttacttctgatcatagcactaacatattacatattgtgaggaattttaaaacttctgaaaaaatacaaataataaacatcagtgtaacccatcaatcatctgattcccagacatgaacttcagcctttcagtatattcctccaagcttccctgtgccttttaaagctactgtttcctttttccaaaattgggattagactcaaaatatctggcctgcagttaagaagttgtataaggaagcagaaatcattgtaacaaaatattcactgatgaagtgattgactcattgccattcaacgtgatttctttcttcaagcttgaacttatttcaccaattcagctactgtcgctatctctatgctgtaggatattataatgcagatggggggaggttacttcttaggatcagtgaaggatgctgcagatcactgataagtctgtctgtgttggaccagttgaaaaactg

SEQ ID NO: 43565 - DNA, 1033 bp, Homo sapiens
atatgaataatggtgctattctattttgtgtggcattgtaagtgacattcaggtgaggagagaacaattactcattttgcttttatttcctctttgctctagattccaggtctctgaaaatcaatttgttttgatgcctataagatatgcaaaggtttatttaaaatattctcttcttcaactgtatgcttctggtgaagaaaaatcttttaaaaatttaaaaatatattctcattctataaagtgggaaagattcagaaatgattgatttgtgaatagagataataacaatttagtaaaaatatgggtttttttgttcaatgtttttaaaaaggcaaaaatgtatttggttgcttgtttcacatcagttttagcaagaagtgttatcctacctgacagtgtgtcttgtggaactcaagagtagattccgttatactattttctaacaaggtaatggaggagttggccaagtacattttaagatgtacacaaagggaaggtccaaagtcagattcatgcggactaggaggctgagacctggacaatagggataggtgtgtgtacattaagatgttctggttctaggaattttaaaactgatttatgaaaatttgtaatgttacattgctttctacttatgtcgctattcttagagttggaaggaagcaaagaatatatttgatatctgtgggcaaatctgggctggatttttagggaagtggctctctgttccatgagttaacctcaagaatgcaaaatataccaactgttttcctgctaacaatcatccctacctaaaaatctattatagaaaaatattagttgaatttttaagatttaaaaacaatttcatgtatttctttgttaaatgcaaatactccagagaagggatatcaatgcctacctggcaaatgggaaaaggtaattagatagtgaatagaaaggccaggagattccaaagtagaaggcacttaaccatttgtttttccagttagaaaagtagtttatattcagtataaaaacttagaaaagt

SEQ ID NO: 43566 - DNA, 1094 bp, Homo sapiens
atttcttaacctaaatagcaagaaagattttttcacagatcagagatggaaactcccccatcagattatatgtccttggaagaagatatgaacttgatgactcattgaaaggctttgttgatttgcctttgaaaacttgattaacatgtacattctcaggttcttaccttaacaaagtcttttcaacaaaacaggttgaatatctgcttttccccttgtaggtggtgaaagaatagtctgcggtatttaggcatttataaatatcttatcctcatagcagttaccctcttattttcccactcacccttttatacatccagaatactcccagccctgataacacagaaattcagccgagaatacaagaggggtataaggtgtggggtgggtgtgtggaggcaaggagggtcagataagttacaggtgacaacttaattctttgcctggctgtgtcattcattgaaggcacagtcagtgtctgagatgtatttattttctaggttctgcataggtagaatataatattttgaaatattttggtttgtttctttttattacaattctataatattttgaaatattttggtctgtttctttttattgcaatctggtcctagtctgcagttcacgttacagaaaactggattgttggcaaaagtacttttgctcctttctgtctctcccctgctctccacactgctgtcagtgtcttcctacgatgcaaatttgatcatctcacctcttcaaaaaaaacttcagggctcctcataatttaggataaagttcaaaatctttgtcatggcctgcaaggccttataccaaggtcaactgtattctcccacagcatcccacgtaaatatcggtcacagcatttatccactgttaccatccttcagtttcttgtttgtctttatccacagaccaacctccttgagagaagtgtgtttttctttgtttttcttatttcagctattcccagaattgagcgcagttcctggcactgaataaacaagtttcccagtgcctgtccatcccaggaaccctgcagtcttgtcaaatcaagctctatttcactttctttagtttctatatgc

SEQ ID NO: 43567 - DNA, 1042 bp, Homo sapiens
aggatctgagatcgaaaaggcaactttaattggcattagaatttttaaaaatgtgatttgatgtagatgctactttcatcttaaaacacaattaaaatgtcaaaagttacttaaaagtaccatacctcctaaatatggagcaaggtttctcaacctccgcaccattaactttgttgttgttgttgtttttgagacggagtctcgctctgtcgcccagggtggagtgcagtggcgctgtctctgctcactgcaatctccacctcccaggttcaagcgattctcctgcctcagcctccgagtagctgggattacagacgcatgctaccacgcccgccggatttttgtatttttaatagagacagggtttcaccatgttggccaggctggtctggaactcctgacctcaggtgatcctcacacctccgcctcccaaagtgctgggattataggcatgaaccactgtgcccagcctagcactgttaactttggacaagatagttcttccttgtgggatgctgttctctgccccgcccccataattgtgacaactaaaaatcacaattgggcaggggtgaggggtagggcaacatctccttctccatgagaatcaatgccttgaagaaaaatatagattctgtcacagtgcacattatttcattgagaaatcacatagattaaaattattttcccaaaccataacaatcattgtagagatacaaataaattaatattagtattagaaagtagatactatgatcaattagtcatgcagagtgatctcttgatatgtcaacatgttgagttagaagtttgagaagagatactttagaaagtagtagacccactcctcttgtctcatttcccttcctataatttagtggcagtacatttatgaatccaaccctgtatgtttgcaaaccctgaggtagacaatttggcagtgaatttctatagtacaataaagttcaaatagccatttgagaccatgcaagcctctaatttacaattcctttaaaaataactgggtcatttttcagactac

SEQ ID NO: 43568 - DNA, 1070 bp, Homo sapiens
tgctggtttctttgctcttctgtcttgtataacttagtccagtgattcctgacttggctgtgtatcagattcactttggggagcttctgtgaaatgcaaattcctgcaggggaatccagaaatcagcaagcttaatagactctgcagttgattcctaggcagcccgatggccccctcccaagtttggacctacccttccctgggaattcagatcatggctaagtggatattactctggggtggcaagagccactcacagtgcctaagagagattaagcattagaagacctggattctagttctggctccactaccaagcagctctagacaagtgtctcctgtatggtcctcatgttcctaggcggggaaatgctgggattgtccaggtggcccccagctctaaagctactgtggtactccttgttatgtaaccaatatgctgactgtaaccactacattagttatacttgaactttgttgtcacctgttcttgagtgacatatgtataacctgaactgactattccattttgtacaagagaattatggaaatgcccacaggccttgttataaagggctcctggggaataggcaacctcaaagcacggaccaaaggacttacctctcccatgcaggtgtgacgactctcagcttttggacagagaattaagcaaaatgggcttttctgtttgtttgtttgtttgtttgtttgtttgagacagggtcacccgggctggagtgcagtaacgcagtcacagctcactgcaacctctgcttcccaggttcaagtgatcctcccatatcagcctcccaagtagctggaaccacagacacatgccactacacacaatttttacacagacacactactctacactataccaatttttttttggtagagacagggtttcaccatgttacccaggctggtctggaactcctggactcgagcaagctgactgctctggcctcccaaagtgctgggattacagacatgagccaccgtacctggctgtgaaatatgcttttctcattctgcatgtttttctcctttgaaatatcaaccatcag

SEQ ID NO: 43569 - DNA, 1034 bp, Homo sapiens
aagtggtgactatttgtcacagtgcccttcctacctctgaattcagtgtgatgtgacctcgggagaggaggtgtgagcacgacgtccagactcggacatgtctgtttcacgtctgccgggaagtaatttttatgctgggagctggcttcatggcgtgggattctaattctggggatggcattttgtatgtgtaggaagactgtcaaaacctttccaatgggaagggacaagaaccaatttgagaatcacatggttacataagaactggccctgtgcgggcatctctgcatacttcctgcacttgttcattctgaagacgagagaaagaggagcaggaagaatcttccatgaactctgcaaacctacaaactttccaatgagaagtggtgcacactcccgagatggtgcttgggacaacatggttaaaagggtaaggggtatttattaaccctttgctttcttgttattcctgtccctcctctttaaatgtttacattaccaaactggctagactgctgagaatctatcatttttaggttgcctgctagggtttctactggtcttatcccagtaaatagctgcagaaaatagctgcagtggccacacccagcagcagtagtgtctaggggactctttgggacctgagccagaaagttcccatatgcagtatctcattctgtctccacaagacacaagacacaaggattattatgtctattttagagacgaataaaaagaggcttacagcttcagaagatttgaaacctgcccacaatagctgcagtgtttcagcagcacaaggagacatatgcagacttaatttttgttttcaagttgtttagtcgcaggttcagacactcatgggagcaaggcagtgaaatagatgaaagtagcagatcttagtgaagctttatttctagcctcccatgccaaggacaccccccactcccttggagtccttgagaaagccaccaaatgcttgtctcactgtggcctttccacactcaggatggtattcccactaatgaagacca

SEQ ID NO: 43570 - DNA, 1034 bp, Homo sapiens
tgcagagagggaagtagagttgccttttggagtgagggaaaggttatagaagaattttaaattcaaagggctttgcaatatacagtcagtcctcattattcatggattccgtatttgcaaatttgcctttttgctaaaatttatttgtaatgcccaaatcaatattcaacatgcttttttagatcattcttggaaaatgcacagtggcaaaaaatctgagttgcccaactcagatgttccagctgaagtcgaacaagacaccaagccaccaccctgccttcctgtttcagctctcatgcttcaaacaggtgtccctttcccagtctgtctaggccacgtttttctcatttttgtgcttcctgctttctgatggtaatttcagtttcaaatggcccttaaatgtagtgctgaagtgctgtttttatgttccgaagtgtaagaaggctgtgacatgccacgcagaaaaaatacgaaaatatatgggtttgttaagctttgttgtggcagtagttacagcactgttggctgagcattcattgttaacaaatcaacaacatatactaaatagggtgtctttaaacagaaacacacataaaagaaggttatatattcactggttggcaaaagcgttatggtcagaggctcgcagaaacaatttaatattgttcctaggagcaatggttcagtagttgttaacttatttgcagcaactttctaggacataactactgcaaataagaagagtctactatacttggaagtccccagggagcttttgggcagcagtaaactatggagaggagaatcccagagggtcccgtctgtgataagtggggaagagaaagtctgctcttaaatggtaatgagaggtgaagccggctgggcttctgggttgggtggggacttggagaattgtgtgtctagctaaaggattgtaaacgcaccaatcagtactctgtgtctagctaaaggtttgtaaatgcaccaatcagctgtctgtgtctagctaatcaggtaggggacttggagaactt

SEQ ID NO: 43571 - DNA, 1102 bp, Homo sapiens
agtttgggaacctctgctttaagacagcagctcttgatagacagtcctcctccttacctgtgaggttagtgtagtgttctctgcctttggagatggcctttgctatgtgtgtgttttaatatatatatttttaaattatctgcttattttggaataattttagatttacagaaaattacaaagattgtatatgcttacatttataccctatttccagtttccccttatgttaatatcttaatcttggtacattagtcaaaactaagaaattgacattggtacatcacattaacataactaccaactttatttggatttcaccggattttccactaatgtccttattctgttcgaggatccaatccagggatacgaattgtcacgtttcctcagtctccttccgttttggacaatttctcagtctttccttgtttttcatggcctgatagctttgacaagtaattttatgttgatacaattttaaacacacaaaaattgccaggatagtacaaagaactctgtacctactttttctgaaccatttgatggagccctggaagcaccatcccccttcacccctgaacactcagtgtgtatgtccctaagattgtagccattctcttacataataatcacagtacatttataaaaccagaaataaattgaatactggtataatgctatcgtcaaattcacagttcgtaatccatattcaaattccatcagttgtcccaataagatcctctatagctattttctctctggtgtaatatcctgtccaggatcatgtactatgtttattgtcaggtctctttgatctccattgatctttagaaatttctcagtctttatcttttgtgaccttgacatttttgtagagtacaggacagctattttaggaaaagtcttcagtttggggttctctcacatatcctgctgatcagattcgagttttgtatttttggcagaaatgtagagaaatgatgtgtcctttttggctcatcatatcaagaggtacatggtgttgcattgcctaattcttgataattattctggttttacagatgacaagtgtaaacagttggttaaattataggcctcc

SEQ ID NO: 43572 - DNA, 1057 bp, Homo sapiens
cccgcctcagtctcaaagtgttgggattacaggcgtgagccaccgcacctggcctcagatgtctttactcaggtgctgccttctcggtgaacctttctctgagtttcctgtttaaaattgtattcctgcccctcccacactggtagaggcacaggcttcagtttccttcgctgcttgatttttcttcatatcctttgttgctatatcccagatttgctgctgtatatcctcagcatggggaatagacctggcactgagcagaggctcaataattatttgttgaatgagtgactaaaccactgctttgtagatttgctcttgctagttaccactgattagcttctcagcaggcttccctaatcatctttggccaaaggagtagcggttttgttttggttcatttcctttacttgtcagctgcgctgaagttagttatttatataactgctggtgttgttgaggcttccattattaactctgctatctctattgtctcagtaatgtccagctactgctgagatctgggatagtaactcacaaggcctactctggtctggtaaaggaccaaatgcacatgtttaagatcttcgttacagatatcaatttctcaaaaaagacaagagaacccaatagaaaagggacaaatgtttggactgttcacaaaaagggagcgtgtgtcttttcctctttatgttcagcctcactcacaataagagaaatataattttaaaatacattaagattttatttttcaacctgtcaggtttgcaaaaattcattctgttggtgaggctgggtgtaaatagacaacctcatacaagtccaatggagagaaatttggaaatggctatcaatattaactgcacctatgttttgacccagcagtttcagttctgtgaatctattgtaaggatgtacttgcatatgtgcaaaatcagttatatataagtttatggatcacagtttggtttatgatagctaaacttaagaaatcacccaaatggcccacagcaggggactggttcatcaaataggacacatccacacaatgaactac

SEQ ID NO: 43573 - DNA, 1071 bp, Homo sapiens
agttcttttttttttttttgagacggagtcttgctctttcgcccaggccggactgcagtggctctatctcggctcactgcaagctccgcctcccgggttcacgccactctcctgcctcagtctcccgagtggctgggactacaggcgcccaccaccgcgcccggctaattttttgtatttttagtagagacggggtttcaccttgttagccaggatggtcttgatctcctgacctcgtgatccgcccacctcggcctcccaaagtgctgggattacaggcgtgagccactgcgcctggcctgacaaataaacaaactggaaacttctaatttttcttcaatctaattattttgctcattcctgtttataaatgttgtgccttttctaatggtttgcactttttattgcatctataacacctcattaatcttgtttgagtccaggtaattacatgtgcatagtatcatcttaatcgtgtcatttgttttcagtctgtgttactaaaagaggtaataatctgtattatcaaaataggtatgactaaaatagaattcaatagactctctaagcaacatattctataccataagtaaaatatagaagccatcaaaacctgtatgtttcggccgggcacagtggctcacgcctgtaatcccagcattctgggaggccgaggtgggtggatcacgaggtcaggagatcgagaccatcctggctaacacggtgaaaccccgtctctactaaaaatacaaaaaattagccgggcgcggtggcgggcgcttgtagtcccagctactcaggaggctgaggcaggagaatggcatgaaccggggatgcggagcttgcagtgagccgagatcgcgccactgcactccagcctgggcaacagagccaaactccatctcaaacaacaacaacaacaacaacaaaaagccctgtatatttcaaactttacctaaaacgtgtatccttttaaatgttgcctaaaataatctatgattagactcttttcccgtaacatagttacgacattaaaaggaaatgtgctagaaatattatacccaataatag

SEQ ID NO: 43574 - DNA, 1064 bp, Homo sapiens
cccttagtctgcagcacccggaatggatgtggaatcactgaaggaggtgggttggaaagaagacaagttggatcctgacagtttaaacccaggtgttttgcaaatccttccaaaatatcacttggcttttcctctccatacctcctcccttgcccagttggaaaaaataacaacaacaacaacaacaacaacaacaacaacaacctgcagtacgtgtgcccacatcctcctctggatgaaatagagttgcacagagaaaaggaaagttgatttcctagttattctcccacacatggagttctgggtggcaccatcccacactatttgcatcactgagctacacactctgccaagactgcctcttaaatttaaacacattttgatgaaaatagagaaaggctgaggaagaaaggttaacacttccccataagaggtgcgtaagcactatacatcgtatgtttttcttctggctcttggattaggacagaatgttaattaaaaagtaaaaagctgatcttctgagcagcaattaatttcaggattgctcttctttcatctgttgggtctttgcatttctgaagacgtggtggaaaatatttcctaggggtctttctaatacacattttcatttgattgttttgatctttaggctacatgttgacttaaaaaggaaccaatattacaaaaagaaatgtcattccaaggttctggattctgattatcgctctggtgacacagatgagattggctccaggcatatacacattggttagctggttctgcccaatccctgtctggagttgaatgttccatttagtcaagactgccaagcagcaacataactggattcattagcttgagttctgaaagctcctcttaaaagttgtttttgtattcatactactttaatatttagggacaggctgcaccattttctaggttgcaaaagtgatcactcagttttttttttattaggtgctattttagattcaaaaatattttattttttatgaactgttttgtgcctttgacctagttctcttttcactgggatatgtatccta

SEQ ID NO: 43575 - DNA, 1030 bp, Homo sapiens
gccttctgccaacctgagcctgggcctgcttaggagaaggcagtttgaggtgtaacagcaggcaccttacatatcattcaaagatgacatagccagccatagaaaaatgcttattgtaccataaatgtgtcttccttaagcaatctctttaacaaactatttgcaatccccattgaagctgtccacggcggctgctccaaaaactagtatgtgcttatctcctcatctctgagagagaacaatacatggtatttacgtttgcattaaaagataagtccccttttcctatccacttctcccctatgcgttgcggataaatcactaattaaaactttaaatactgatctgtattattattggatatactgacacaaacttaaaggccaaattaaccaaaaattcattaactttgggatctctgtagaagactttaatttttgaagaaagtgatggagctagttctaacagacgttgccatggcaacagtgctgcctgcagttgagttgctctgggacccggctgctgagggttcatgataggactgcaggcaataccaggagagcagattgaaaaagatgattgagctgaaggttgtgagggggacaccactaaattcctttattagaaaaaaagcgcataaatgtgtcaaatgaaatttgcggtatcaagtgccagctttgaaaggaacgctactagggaccgggggtaccatgagagagcttgcccctacagtcacactgaaggaaaattatgacctgaattgttttaaatatagttcacgtgaagagatttaccagtcaccagcctgtgccatagtccaatcatcttctatttggggccataatgaggatctggataccctacctacctcttgggcttttccttaaaatggattctgaagaaaatgctgtattttcattaaaatgccaaggaacttcagacaagtcaagagctcaagttggatctagaattagagatgggcaagaaaaggcaatggtgccctgcagccagaattcccgctgtatttatt

SEQ ID NO: 43576 - DNA, 1050 bp, Homo sapiens
ttaaatttataatgtaatttaattaagtttcctattggatggttaaataagagaattatataattttccattaaaaaaagctaatgtgtgtcaaccttacccttatttaggagatttgggttttccccccaagtttcccaaatatcagataggtaaggaaataagattgatttatcttttctaaccccaaaatgtatgcatcaaaatgagtgatattcttcaaaatagtcatttctaccatggtaagctatccttgtaattgacttaaaaattacataagaaaatgagtcacattatttactttgcttcttgtttttgaacaaaaataagattacccagtgcactcttccatcttattctaagacttaaaagttattgattcatagatgctttcaaaaatcaaattcatcttcagagaatcaagatttgctacttggaagatattaaaggaatgccccaggctagaaggcaagtccataaggaagagctttataagagtttgcatatagttacgtaggccactgcttcaagggatagcctcctttgaaggtaacacatttttgctaaaagtaatgagccttgtcaccttataggcacatggtgttcaccatacctaattgaagggtttccactctactctgcctaggctaactcattgcatactttgagtgactgggtgtgtatctccatgctttctgctagtatactagttgtaagtggtaggtgcagggaaaatgaaagcaattagaaatagccaaagaggttaactgccccaacccacctctcaccagtcctgaagggtgtgtagaagaatagcatagagtgacaggttgtagttgactcataaagtctgtcagagaaatggtgggagctgttggaagaagcactaaccgagactgagaagcagggatgagattggatgaggtgagcaaagaacccgtggtgcaaattagagggaggaagttgctaaccctgcactcacatgaccctgagagtaaggggccttcttaaattttgtgccctgtctcacctgcctcaccctactcctgg

SEQ ID NO: 43577 - DNA, 1094 bp, Homo sapiens
gctcaaaaaaaaaaaaaactcatagttaccttgatttttcctgttgtttttctaatctttatttcacttatttccactctaatctttatctttcctttcttttgccaatttggggtttcatttgttcttttcttagttccttgagatgtagagttaggttgtttatttgagatctttccttttaatgtatgcgtttatcactaaaactttccacttagtacagctttttctgctacttgttttagttttcatttgtgctgagatactttttaatatccattttgatatctttttggacccattggtcgttcaaaattgtgttgtttaatttccacacatttgtgagtttttcagttttctttctgctattgatttctagtttattttattgtggttggaaaagatacctggtataatttcagtcttcttaaatttgttaagacttgttttgtgacccttcatactttctatactgaaaaatcttccatgtgcaacttaagaaatatgtgtattctgctgttgttggattgaatattctgtatatgtctgttaggtccatttgatagttgctcaggtctactgtttctttgttgatattgtgtctataattgaaattgtaattgaaattgtggttctatctataattgaaagaggggtattaaggttttgtattattattatattgccgtctgtttctttcttcagtttgtcattttgctttacatatatagatgctttatatttataattgctgtatcttcctgagggactgacctttttatcattacatgtccttccatttctcttgtgacagttttggaatttagatttattttgtctgataaggacagccatccctaatcttttctggttaccatttgcatggaatatctttttgcatctctttattttcagccaagtgtgttctataatctaaagtaaatctcttgtagacaataaatagttggatctttttttatttaaattcatttagccactctatgtcttttgactgggaatttaattaacttacatttaaagtaattattagtaggaaaggatttactgttaccattttgttcattgttttctgt

SEQ ID NO: 43578 - DNA, 1052 bp, Homo sapiens
atccattgacattaagagcaggaaacccctacaagagagtcaaaggttaaggtcaacattttgggaaatgggaatgggagtgtggaggagggacgtcatcctcatctaatccaacagtctggctcgtagcagttgctgtgttccaagagtgtactatggtcctatctgctgcaagcaaggattcttgcaaatcataataaatattaagaaatgtatacctatggttcactttacataaaccttatgagggggattccaagaaataatacattatgaatgtagaataagtctttaaattggcaattttgaaacttgattctgtctagtagtgttaaccttgctaggagatccaaatgttaggttatttgaatactactcacttgtatttcctgatgttttccagtgtttgaacatttgctgtaagctatagttgtttataaatactttaacagaagaaatgcgaagaaaagaagctatgaatattgttttggaatgcttcattgggaaattagaaatggataaaaaatctgaattagcaaagcaatataaattataaatttcaataacaaaaccaaaatcagggcaagtaaacaaaatattttcattgcaatgaaaaaaatcctttcgttggattaaaaaagattaaacttaaatgaagcagcaactgccctaatatccaacttcaagatgctgtttggtgcagtcttaattaaccaatgtcaatgtgaaatgaaagaaattttttctacatttggaatgtttgtcatgaaaaaaaaaactgaggctattaagtaggacaattggtgtttggtatatttaacatttccattttaagaattaataacttttaaatattaaatatggtatttaaaaatttttttttggtggggatacggagtcttactctgttgctcaggttggagtgcagtggcatgatctcggctcactgcaatctccacctcccaggttcaagcgattctcctgcctcagcctcctgagtagctgggattacaggtgtgtgccaccatgcctggctaatttttgtatttttt

SEQ ID NO: 43579 - DNA, 1547 bp, Homo sapiens
gggaggtgtttagagctaaaaatagcaatgttagccaggtattgcttttctcattttaatgggtcacggcttatcttttgttccttttagtatttgcataagcttttcaagagagaccaccataaggggcagcgttaccatgaaaaacagatcagtctttatgctgaatatgatcgaccaaacttacttccctttctccgagacagtacccattgcccacttgaaaaggtaaggcacagactccccgacttgtacactttggatgaagaggttgtcattgatggtaagttgtttgtctttcttctctttctatctctgttcatctgtccctttccagggggaagactgttgctctcaaagaagtaggtttttggctgggacattctgtcaagaaaaggagatctcattggattagactttggtgaagagctgaagcatttctgtgacaggtttaattggaagaacagcttaatccagggtctaggacttaatcaaccatcaggcaaaaatgatatattagaagtctcagtccatctcccaggatcagagtgacacctcagagtcaagagcctgggagggagacacagactgtcctaagccagaagcagttgctccagtcaggaatcaggtttgataaactgaggtcatagcttaggtcctgcatcctatcttctttaagtgtctaccctatgtttttctttgtttctcctacatcctacattccactataattatctgcttactagtctctgtctcctggaaattcttcaaagacaaggaatttgtcttactcattttggtaaatctagtacccaccacacattagacatttactaaatgtgtgttgcatcatgagtgagagaatgaatgaataaattatatacatgcaagatcctagttcgggctaaataaggactagtaagttttatgagactgctgtttcaaaataaactgaagtacttaactatatatgtgctaacaactgggcagcctaaaagccaacagtattatgtcctacagttctcaataccatctaccactaacatctacaaatgtctgactaaatttggatggccagatacttttgaaagtcagctgtgtggaccaacaaaataaaaaacatatttgacccattagagatatgtgcaaagaagctggatgataacacagtttatgtacacttacaacttccgtgtatgcttccttagcccatgattattaaatgcattggagtactgtgaaccaatttagctcaatggatttttaaagtccacaattattgaaaaaaatcttgcctgcctgttaacttataaaacgacattagcattttatatttggggccctaagacattttctgaggacttaatttggaaattcattatcttactctaaaagtaaaaacagatactaccctcttctctcaacataggactttataacctggcaatagagtgagaatcttattctttgaacagtgctccttcatttgtttctcacttttcaagagaacattgtatatttcagagaggatgtggcagtctcctgaa

SEQ ID NO: 43580 - DNA, 1031 bp, Homo sapiens
ctttagaacactctgaccctcgctagatgttgttattctagttgtttggcattcaggaatccttttcataatgtagttattctgtgaaagcaattcaaagttgatagagaacttttaaagttgtgtgtgtgcgcatataaagtaatttcttgctaaaacaattcatataatttatagaaacaaaccacgtatatactttgactcatttatccctcctaacctgttttccagaattttaaaattaagtgaacttccatcttgaccgacttattactattttatttcttggtgttcacgtatccagcatgtggggtttcccctggtttgaggtgatgctcatgtccaggacatgtggaatgttattttattgtgtgacaaatttgaataacctaataataaatttacgccccctaatgagtggacccagccacagctcacattggtgcttgcaaagtgatgcaagctgtgtgtgtgtgtgtgtgtgtgtgtgtgtgtgtgtgtaaaagaaatctaattacaagtgctcatgacagaaataatgaggtttataaaacagtgttcttattcaaaaaattgaaattttagataaacctaaaagtagaaccctaaaggctccaaaaggattaatgcatttttcaattatattgtactgtatttagagatattgtgtgctatattaatctccaccaacttaaacttaatttagataggagctagagctacgtctttttctcaaagatgctttagccctttttaaaatactgagtcaagtctttagggactacagatttacgaagaattacgtagctccaaggaagttcaggtagagaggctctgcttgtctggcagaggatgagatgcttatgtaaaaattaattacattttcctcatatctagtctcccctcatgcacccccttccattgttctccagagctcgttttgcatatgttcctgtggaaaaaagatgaatgagctgaaactaattgctattctagaatgtgatccagatgtaaggaatcagagtcttctg

SEQ ID NO: 43581 - DNA, 1081 bp, Homo sapiens
aattatgagtgttctgtgaaaatgatggagaagagtacaaacttcctttacaaatgctgaagtatgttataattttcctatttttaaagtaatgtaatttaagcatttaaaaaaatttattgtttttatgattctgttacagttattgcacatgattgaactcttattttttcatgaaacttttaaaaatcctttatcgtcaaagttaccctgttgatttcatatctggaacactttttattgagatggaaagaagcatgacttaaccttagagattgtagatgttttctcctgaatgttttaggatgtatgtctggtcagtactgttaaggaggttgtaaataatttgtttttattttcataagctcttataaatagttcatgttttaccttcccttattctcagcttaattatttaattttgaattaaattgtcacattatcagtcaaatagctgtgttccctaacaacacttttgatcacatattatgtggagagacattttgtgttgctaaacagagcactgaaggtcagattacaaaaaacaaactgtacttctctggaatattgacttgtcaatttttttctccctaaaaagacatgaagtaatattggaggtaaagatgcttcatgacttctttgtatggggtttctagtcatatgcctgtagctttgcctattaatttacgacccagcagagttaaacagttaagctttgtttaatattaacgacaaacatataagcatgttaaaaattggatgatttctgtggcatttcatttcatgagtactttctagacttttacttattatgataggtactgaggttttctataactttgctcattcaatcataacaggtcccttgttcctgtgtcctctaattagtaataatggccacagatagattttataaatatttcttgggtagcacatttattcaagggtacacaaagccagttgaacagagagaagcctaacatgaaatatgatagatgtttatttcagtttatggtggggtcatcatgcttttatcatacaagatgactggttattttgtctttattttgtgttcgaagtt

SEQ ID NO: 43582 - DNA, 1048 bp, Homo sapiens
ttaatattgcagtggaaacaaagataatagtactcagctcttttttaggacgtgattattatctcagatggaaagaaaaatcaaacttttagagacagtttcaaaatataagcctcgtgtaaaaaaaaatatataagattatatatttattacatatacaatgtgttcacttatctctttccaattctctctgtgtttagatgaagttttcatgctctttttaatgacttttgaaaataggtgtaatctcatccagtaggttataaagcataagactttttttagatttactgaataatattgtatttttcaagtaatattttacctgctgaaagacagatggaaaaaattgaccacctagctctaatgaataattttgatgtttctttttttaaatctttcaacttagtgcacaacatcctaatcaatcaataaagtattcctatatttgttttaaacatttaaaaatttttcagtatttgtggaccttttgaatgctctcttcaagttataaatatgctttaaaaattcccagttactcatcttgtcaaccgtgtgactcctcctgtctgccctgtaaatgttacacttctcattgggtttattggatggtttctggaggattttatccagtcgtgcctccctgtttactttaatggctgtgtaacttggaccttttttttgaatatcatgtgatggccgtttctccttgtatatactgctgatgatgataattcaagttaatataaatccattccttcccaaattcagtccttttccattgagtctgtgtttgtgatacacaatatacccattccccagagtgtattagctcaaagccactgttcttgattagaacatgttacacccctcctcattctgtttaatctccacttcttgtcatttttttcatgtcaataccaatcggggctcttctcttcccctgtggtaccattgccttaacttttgcctgagccatagcaaatgccttctgatagatctgtgggcagccctagcccagagttatctgcataaaaaataagtctgg

SEQ ID NO: 43583 - DNA, 1027 bp, Homo sapiens
aacaagtcttttaaaagtgtgataatagtttgtgatttagaataatttatttaaaaaagccattataatttattttacttatgttaaaggctttagaaacatgtaactgtgtccgcaatttaatgacttgtaacatacaaactttgatttatttggatccattaaattttatcatgtaaatatgtatttactaagtactaaaaagtaccattttcttgataaactataatgatctgtttgcatatggttaaatggagattttcaaaatgtgtatcagcttggtgtggtttgcagaaatctccagagaatttcctttttctacatgttgtgtggtatgtacttgtaaagattatttatgcttcatgtttttgacattagcgtgttttgtttgttttgaaatagatttatttagttgaggtattttaggatgtatttttctaatttcattaagaaatatatctgatgttaaaaactaaaggcatttagaaggttacattaagaaaggaggacttgtgaaatgatcactttcattttgaaagtgttcgcaaatttttaggaggagctgctctttttgtaactgagttatagaggtttatatctttgaaaaatgagataactacattggctcagtagctacttcaatcctttcagctgcaattttaaactagcagcagaaactaggcagaacaattttgaaaagcccaacatttagcaaatggttataaccttgcaataatcatgttatagatatcaagatccctcctctgttgagaacaggtggcagatcacatagggggaaaagagaataaagacatatgtcagataactgagaggttatgactttctgcctttaagaaataatttaatcttcaaaaaattggagcaaagactagccaaatgaaggtgtaatgtggaataaagacattcttaacccttaagaacagtgatctctagactgacagccaaataaatcgttggaattatatgccaccttctacaaacaatgggttaaagtggcacagagact

SEQ ID NO: 43584 - DNA, 1046 bp, Homo sapiens
agctacttttctaaaataacagtttgagagagtgcattaagaatcattatagatctttacatattccttactgagtaaagcagatttcctaatctaattttgtatttattatgtgccctaaagtcagtgggccattaagatgggtaaattaaaaacagtatacccggtgtaaaagagatatacccatttaatctgttaacaaaaagcaacatgaagtctcttgacatacaagaatgcattttatatatctaagcctaatgttgcccaaagagtcttttgaaacagtaattggaacactagtgcttttcaaaaagcactgtcaaattttacagtactttcagaaattctgagattgtcatgattatcagagagagatgaaggaggagttggtttgtgcagaaatggagaagaattatccacaccgctgaaacattttttgtgttcatgtatttgtaaagaaagataatcttcattttgttttcttaaaggtgagaaattccttttgggctgtaatcagtttaaccgaactaatttgttgaaagatagtactcatttttattaaaaattggaaacgaatttttactaaatacttcatctaggaattttcagagctttaaatgttgaagaattgttatttaatgcaccaaagtggaatatgttagctactccatctggtggataagatgaacctcagattatctcatggtacccttcttgtcaaacacctttggtttcctattttggtaaaatttatagctgcctattttagtgtggaaccatgatatatttttggaaataatcttcccgtatttttattaacattggtagaattgaaagtaaatcttttagtacacataattacatgtaagctacccccttaccatgggttagtcagtattgtgaaaattgagaagctagtatagaatgatctggtaaagtggttggtgatgataaaaatataaagacattacacaaacacattccagatatctaaatctaatgcatctttaaataggttttgtgggtattttttcctttcttcagtg

SEQ ID NO: 43585 - DNA, 1094 bp, Homo sapiens
ttcttttctttaaagtggtactttgtaatccattggtgacctcttttatatggccttgttcaagctgaaacaagtaatatgcttccgtattaaatatattttcaaacaaaagcaaatgatcaaattaatttctggaattttattttttaagtcctacaagttactgcttgttagaggcaggtctgggccccctttggagcaaagatgtaatggaacaagtatcgtgtgagaagtctaccctgataatgatgatcattacaaaaatgaacagttatttagtatagaaaacagtgctgggcactttggtatgctctttaggtatcttaatctgccctgtgacttggccatgatgatcacttccagtttacagataaaaacacagacttcaagttttcggtaactttgcaaggctacccagttggtaaatgcatttggatcccgtagtttgactccgaggctccaacctctagttatactgcctttaacttccttttgactctctgtttttaggccaaactcttcttctatgtacctttatagaatttgacaggattaaaaaaaaaaatctttggaattttctctatgtataataatgagatttttgggtaatattacagatttcgatttgttcaacttgtaggaaaatataccagtttcagaattgctttctattccagagaatagagaatagttaatttatatataatattaattgtttaataaagttcctgttatacctcaaaatatataatgctgtttatttacaaaacaattataaaaatatttatgaaataatgttagctgtgagacctccttaaaaatactcatttctgtatttagaaatttagctataagagcattcatttgctttgtataatacaaaaatttggaaacaggctaaatatccagaaatgaattgattaataaaggtttagtcatataacccatataatggattgttattctgccactaacttgattaatggcattaatttttaagtaaagaaaatattcatatgtcctttttcatgttatctttataatttaaaaagctttttataaaaatgccattaagaacaggagtcgacaggcgt

SEQ ID NO: 43586 - DNA, 1001 bp, Homo sapiens
gggccaagtgtgtggtttcctcttatttccgggtctgtcaggtgactctcccgtggcgccatggcggaagcagaggagcaggtaaagggtgcaggtggtagttgagggcacagggatatagagactagggtgggctgtttggggagggtggagtggagtgggtggaggtgcggagctgctggaatagcgcaaggcaggtccgcggcagggcggggtgggatggcgaaagttggtttcggggagcagagaggatgccagccccgggagggcacctagggaaagcgctctgacacacccccgcgttcgggctgcctttcctcgggccccatccctgtggcctttgcccagggaaattttggcatgaaggcaggcccggctacctcagggactgactgcctgtgggaggaggaagagaggccgggtgactgaaatttaagttgctttccacttgaagtaggacaataagaactaggagagagtagacgatgagttttgttttgtatctattggagttaggtacagagctggagcactgttgcggtgcagcagggattaaatgcatccgttctggagcaaaaatgcctggggtccaagtgctggttccttttcttacccaatgtgctactttgagctacttatttaactttccagtgtgagatgggggtaataataaggccgtcctcagagggtggtttaagatggagagaggagtttatacacaaagttagagtacttagaactgttgggcttagtaaaaattaaatgggattatttgttgctggtagtatccagtcaacaactggcaacgtggcactgaagtttagggtagaaattggtgatgggaatatgaattattttcatatagcagtagtggtaatcacacattttatgaaatgacgaagtaaaataaaaaagacaaaaaagagaagcagaccaaaaaagaggctagaacttgggggagataacttaagtttccatttccagtgttatttcagttggat

SEQ ID NO: 43587 - DNA, 1013 bp, Homo sapiens
taaacactgtacacacatatataatataaatataaaatatataaatagaatacaaaatattgcaagatatatacatagatacatttatcttttttttaggtcttctttaccatctcagcaatattttgtagtttttagtgaagtacatctttttaggttgtatttcttagtatttgtttttgacagtaatgtaagcagtgtttactgagtttcattttctaaatctttgtctaatctatatatatacaattaatttttgtatgttgatcttttatttagttttgttactaaataagtttattgtttgtaggttctttttgattttctatgaatacaatcatgtcatctacacataaacacagctttatttcttcctttccaattacttcttctaatttttttttagaaacaggatctcactctgtcacccaggctgcggtgatgcaatgatagttcactgcagcctctgtcgaattcctgggctcaagcaatcatcacacctcggcctcccaaagtgctgagattatgggtgtaagccactgtgctcagcctacaatctttatatatatatatttttttattctccttaccttatggcccaaactttagtaaaatattgacaagaaacagtgatagtaaacatccttatcttgttctggacttaagggagagagtgttcagtatttcctcttcaggtatgttaactataggttttttatagataccttttatcagatcatctatgttccttgcatttctagtctgctgagagtttttatcacaagtgggcgtttaattttacagtttctgaatttgagattatcacatgatttttctcccttattcagtgaaagtggtaaattacattgatttatgaatgtttacccaaccttgcattcctgaaataaatcccatgtgatcctgatatatcatcctttagaaaaaaaaaaatttcaccgggcacggtggctcacacctgtaatcccagcactttgggaggccaaggcggggag

SEQ ID NO: 43588 - DNA, 1069 bp, Homo sapiens
aatcctcctacctcactctccagagtagctgggaccacagtcctgcaccatcatgcctgactaggttttagttggtggtggtttttaggtttttgctttttttttttttttcatagagacagggtttccctatgttgtccaggctggtgtcaaactcctgaactcaatcgatccatccgcctcagcaaaagtcactttttaagttgggaccaggatttattaagtaacttacctaaatattctcataatgtgtagatataaaggaattctcattgttgactgacattctacatattagggctagttttgtaattcaacagtgtctattgagaatggatgaccatgatgctttttttctgaaacataattaacatcactacatgagcccatggaatatgtgagcagactccatattatattatgaatcctgaatttaaaccaataacagattacatctcagacattggcattatgctgtaattttaaattcgtaaccagaaaatgagttggacaacaaattcaagactgtagggaaacaaagtaaaaacagtttgtatattgctagaattgtctatcaagagtcaagttttcatgtcttttttttttttttttttttgagacagagtctcactcttgtcacccaggctggagtgcagtggtgcgatctaggctcactgcaacctctgcctccagggttcaagtgattctcctgtcttagcctcccgagtagctgggattacaggcacccgccaccacagccggcttatttttgtacttttagtagagacggggtttctctatgttggccaggctggtctcgaactcttgacctcaagtgatccgcccacattggcctcccaaagtgctgggattacaggcatgagccaccacaacctgctgttttcatgccttttaatcttccctgaaaattttctgtatactgccatgagtaaagtgtttgtcactttcagctatatggcattaattcaaaacaaaaacaactttagggtctcagtgtatgacttgagttcataaagttaagtaactaattgaacaaggcaaattaaaa

SEQ ID NO: 43589 - DNA, 1051 bp, Homo sapiens
gagcagaacaaggtcatggcaaagtctgggtgagagggaggctcccaggtgcagggcattgagaagggaacccacaaggggaggggccgagggtggggagccgcggctggggcacactgagggtgaggagagcatcccatccatgtgaaaatacccaggagcttggggattttgagctcctatgagtgggcgtctcatacccagagttcattgctgatgccttgactgatttcttaaaacagaaaagatttacttgtaggtgaaaggaaggagaaagacagaaaagaaatgtaatagagtgtcccagacaggactcagtgccatcagggataggggtcaggcacctcttgcccagagatgcttaaggagctatggttctttgatgctctaccattctaggagtagttcaggcagcaagagaaacatcttcctgccgctaagaattgctcagacttcagctgttgtgggcacttacattacttaagttcagtttttgtcactcaaggaaagtcttgttgacagaggtgacagaggctcagagttaggacccatgtagcagagatcagctttactgggaaaaactgctttgaggctctgtagggagcggaatgagaaacggcagtcacacactgccccctggtgttcaagagcatttactgtaccttggctgcttccaaagagacaggcggagctcaggcttagtcaccttacaaatgtccttcctaggtgttttgggtcttacacatgttcttttcacctgtcagtaacgaggaccagctttagtgtttaccaatctatttgcgcactttttggccatacaaccccgtgcaggaaaaataatcacagggaaagagaagtgggctctcctccctgcacccttccctgctcccacagcagcccacctgggagctggcatatgtgatggttgaaaagcatactgctttttacgtgtcattcctcaataaagtgattttcaaaaacacacaaaaaaagcgtggactttgcagacagatcatattcaaatcctggtgccctgtgacccagagggtgg

SEQ ID NO: 43590 - DNA, 1034 bp, Homo sapiens
ttctttctttctttctttctttctttccttctttctttctttctttctttctttctttctttctttctttctttcttctttctttctttctttctttctttcttctttctttctttctttcttggtatagcacaagctaagtgattgaagttttacctctctcaactgcttttactgacaccttggttgaggttctacaaaagcaagaaaatgtggaaggagggaggagaggttacaaagagcttggctaaccagccctgaacagcctagaggggctcttgttggaggaggtaatgtgtgctgatggcgcatatcttacatttatgtttcagctgagcaaaatgaacctcaagactaaaaccacccgggatcataataattgctaacatcctgtgaaccaattgctattatccaggtctttttatacttgtgtgctctctgggcttcacacttaattcctcacaacaatccctgaaataaatggtccctgttttatagataaggaaactgaggtttagagtggctaagtaatgtgcccaaagaataaagtggtggagatgggattggaaccgaggaagtatgtctgcagagttggcgattggggcaggattccatggctgataccatgccagtcacactgcagctagcattctctgctttccattgcctcctgttgcccatcagcctggtggtccatccgtcattctggccaaaagtggccagcttccattcaccagaacatagtttttcttctcattcaaccaactgatgatcttgaagatctcgatatgcatgagctctcattattggctccctttccttgaccctccctggtgacatttctttcctttccacttgaccccaacagacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactg

SEQ ID NO: 43591 - DNA, 1109 bp, Homo sapiens
gttttgtacaaaattttagggagtctagaatagatagatacatagagatagaaagtagatcagtggttgccaaaagcagaggggagagggaatagtgatgactgctaatggatacaaggtttttttgttggggtggtgaagatattctggaattaggtaatggtgatgattacacaatgtctagaatgtactaatgccactgaattgtgcaatttaaagggattatttttatggcatgtgaattatatttcaatttaaaattttaaggggttttgacttaacagaatgtatttcatatatttcatagatttaagtgtaattttgactagaaatttagggggcattcattcctatagatgttaggccaatgctgtctcctattatcatggagaagtttggacagagggtatgttaggatcagaatgcacacatataaagacaattaccaagcttttttgtctttttatggacctaaaatatttgtacatgtctgtttgctttaattgtggtgtagttgagcttgtgttcttctccaaggtaaaaagtgcaatgttgtgtgagagttgagtgtttgttataagattaaaagataaggatatcttgggtagtaatgtcattgaccacacttgagcaatttacttaaattactaacttttatcataaatacataattaaaattctacccacagacatatttacaaacaaattatacttctctcttctatatgcaagactttggccctgtgtgtgactgatggacattttcagacgcatcaaaactaagtttgtccaggaaatccagatttgtgcaatttcacaatcctagatgaatcaagtgatttgccttcatttatttcctctcttatttgcaacttcatttattcattgaacaaatacttaaagctatttatgtgccaagccctttgctgttctaagtgtggccaagaaaataatggactgtaatgggaagggagtaattgctggcacttctctgttcctctggctgtcctgctcatttagggctgctagactgaccgtagctctgacaggacttcttactccagatcagacagctcatttttcccccaaagataccgctaaacaagttt

SEQ ID NO: 43592 - DNA, 1032 bp, Homo sapiens
attatcgaatcctgttcagtgtattaattaactcaagctgcatttatgagctcacctggtagactaacataaaaagattttgaaactatcaaacatttccagtttgacattctgagaagagaatgtttcagttttattttctgccttttaaaaatataatcaccgcaacaaatggtggcatcttaatggttcaagagagagaaatgtagcaaaggcatgaattggaaatacaactgggggtggagcaagtgtgctcagccttccaccagtgactcaccagtgaacccagtgaactaccagccagaaaggctgttccattttcttagatgtttatatatggaacacactgctttctaagcccttattctattttctatgaaggccataacaccacctgtgtgtgcacatgggtgtttgtgtgtatgtgagagagatcatatgtatttgaaaactatgaacatatattttgcttttacatgtagcttgtgttgtgatgaacttggcgtcgtaccttgtagaaatcttttaaattgataaagcagttctgtgggatttgagaaacattagatactgacagaaagactggcgtgaaaagtacatgcgcaggggagctgtctggaaactggtgagggttgagcctgaagcttcgcgtttcccccctccactgtttttagcaatgcttaaaggtaatatttttattacaacagtggaattcaccttcttgatgttaagaaactggctgatgtaaagagtggacagacttttgaggcagccaggtgtgtatctatggattagtgattccctcgggcagggtttgaatggggatgtgcagatcttgcacacacacatttgagccttgtggtagcattctgaagaagtcacttagaagggaggacacttatcgatccagagaactgtgtttctgagtgggaattggtggagaggagactgaaggaaagcagaagtgtacttcccagcctcatgagctgcgtgaacggcggctttatttggagagctgcgagccatggactg

SEQ ID NO: 43593 - DNA, 1034 bp, Homo sapiens
gcattccctccctcgtcatgacaaccaaaactgtttccagacattgtcagatgtccctgggagacagtattgcccccagttctgccctaaatatttcctcttgtcgcgtagtgtggagaaagaaaaacacacgtaagaaaaacaaaaaaaaattgtgattaaagaaaaagtttctcctgtttaaatgttctttagaatgttcagattagaaataagagatgatctcattaaaatgtctctagtaagaagctacttaaatatacctatgtgtgggggggtgggtgtgtgtgtgtgcgtgtgtaaactggcagagcttaatttaaaaaccacatttgctaaggttaggcacacagtagttctcagtaaggcccataaccagccaagcccgttttcttggtggagaaactccatcactattttttttttcaggcctagggaagtcacacagactccaacttctgagatcatagcaagcagagttggagatcaggctcctgctttgacataaaacagagctccgggaacagaaagcagttttctaatgcgaggactttttttttaagatttggggatatttaggcttctctgggattagccaaatactaccatggaggcatttttattttttctagaacaattaatgttgcaagagaagagaactgtaaatgggatatcctcaggagacaatgtgtaagccaaggccttaaacttaaaccaactccacccgaccccacccagttaccagtaaaaccagcattaatcagtgagtgggggatgggaagaacaccagataatgtgttggagatctgtctttcattcctacatctgccagaaactgtttctgaatttaagtaagtcaccctgcagtaaatcctccgtgtctcatctgtaaagtggagataataatatccattctaggttcttcactgggttttttaatttgttttttgtttatgaggatagaatgagatcctataatggaagtactttgtaaactcaaaagctttattcaaacataaggaaaaatccatagc

SEQ ID NO: 43594 - DNA, 1065 bp, Homo sapiens
gatatggccaaagtatgtgaagagctttcagaacccctacccctgctccccgaggacaaggaggatcgtagacctaggaaactgcggtgggaatgctgagtcttatcttttgtaaggatatctcctacatctttttatttctttatttttatttattattattattattattattattatttatttttgagacggagtcttgctctgtcacccaggctggagtgcagtggcgcgatcttggctcaccgcaacctccgcctctccagttcaagtgattctcctgcctcagactctcgagcagctgggattacaggtgcatgccatcacgcctggctaatttttgtatttttagtagaaacgaggtttcgccatgttggtcaggcttgtctcgaactcctgacctcaggtgacccacccgcctcaacctcccaaagtgctgggattacaggcgtgagccaccgcgcccggcctcctacatcttttttaaaatgcacttcccttatccgtctgtgaatgcttttgagttgcttttgtataaaatcaagggcatgttttctgaatggtctctatttttaattaagtactgattttttaagcccccaaatgtcgtgtctcccagaattagaagtataaatgaccttcagggaccctctttcaactctgccagatagtctaggctcctagaaccctggaaaggtgtttggagatacatgcaaagtcggtgtgccatggtaattatatgtgaagtgggttattttggtttttgtttatttaatgaatagaataacgtagttacacttagtaatactcattcacccaaaggaaggggggctgttaaatcattgtgttttttgatgaatggcttgtacactgaaaaataaattggacaaactggcatagagctcagtgaacatgaaatcagctattagaagaaagcttgtgaacaaattctgaggcagatatgcatcttttgattaatgccctatcaatcatccacacagctaccttagctaagtcttgccataatcattcatgcttgcttttggaaacactggcagtaactat

SEQ ID NO: 43595 - DNA, 1050 bp, Homo sapiens
acaaaaaaacaaaaaaaaaaaaaacaaatcaacaatagtaataatttctatttgtaggaaattgtggaatgaatacatgaactatttaggaaggttcttattcagggcccctaaaaatagaatttaccttctgtttttaattctgatatctttaatcagcaaagtctgtcctgtgccattgaagtgctgcagaaagaaatggatgtagacactagcttcgtttgtgtaatactgctttacagacatgttgtcaaattgtagttttcagaggaaaacatagttttctttgaggtgactcttttgagtgtggtaggcaggataacggccccaaagatgtccacatcctaatccccaggacctgtgaataggttaccttccatgccagaacgacttttgcaggtgtgattaagctaaggatcttgagatgagaagatgatcctcgattatccgggtggcagtgatgtaatcacagggtcccctgtgagagggaagcaggagaggcaagttagggtcagaggaggaggaggaggaggcctgagtgatgtggacccctgagccaaggaatgtgggcagcctccaggtaatggaacaggcagggagcctagaccgtctggaataatgcagccccgccggcctattgcagacttctgacttccagaactgtaaggtaataaacagtgtctgtttttttaagccactcagtttgggctgtttgttgcagcagcaacagggaactaatagacactgaagaatggattcagtcactcattgactcagtactgcgtgtctgctctgccaggcacactgcccggcccagctggaccttgcctcctagacagagagacagaaagagttttagagagtactgcgtgctgccatgagaatagaattgtcacgcagtagaaaacgatggggcaaggaggtgcagaggggcctcgttttgatggggcatgagtctaagaaggcccctctgaggaggtgacatttaagctggaacgtgaatgtaaaaaaggaagtggccattgtgagctctggaagccaagggttcca

SEQ ID NO: 43596 - DNA, 1029 bp, Homo sapiens
agatcgagaccatcctggccaacacagtgaaacccccgtctctgctaaaaataaaaaaaaattatccgggcgtggtggtgtgtgtctgtagtcccagctactcgggaggctaaggcagaagaatcgcttgaactcgggagacagagttgcagtgagccgagatcgtgccactgcactccagcctggcaacagagcaagaccacatctcaaaaaaaaaaaaaaaaaaaggaaatcgttgggattgctattttgtgctaacatgctctaaatcaggctggtaatgaaactattctaaatgaaggaactcgttttagttgtgcctgaaagaaaaatttgagtaggtaccacatttatcattcaagttggtttttaagttttatacgtggatggcactaacttagtaaatttcagtttgtggattttttttcattatttctatagtattgacaatgaagtcattcatatttatctatcccatttaattaaatgatctctaagcatgttggattgttatcttgtatcaagaaccatctttattgaataaaatattcccaaagaattttctggagaccaagagcctggacatttttttttaaataaagaaagattacctgctacttcagttgttctgggtaccgcaaaattgccattttcctataaactggtatactcattctatgaggtgttagaaactcttcattttacttaaaactaatcatgttttgtttgcctcctacgtggtgagattatgttctcattcgttcattaaactttagtttgatgactctgtaatgtaaatatgaccttcaaaaaggcagaatggacctgtgggccacattcatctctgtgtcttgaagctcacatctctaatatctaccaaatttgaatgcaaattggcatttaattttgaactcttcaggaagaaaccattgtattaagttggcatgcatttaagtttgagttactcacctccggatttggactccaggttaagactccatcagtggaatcttcttgaaggttaaaaat

SEQ ID NO: 43597 - DNA, 1044 bp, Homo sapiens
accttaaagacgagactccccacacaggctgtggccttggggaggaggaagagcagatggaaagtaaccaccataaccatctgcacctctcagggtcacgtggtgtttctagggcagaggttatctgaaagcttaccttgcatagagggaaaaaaaagtataggattgtgcagatttatgacagtgtctactgttttactcttgaacattttagatatttgttttctttagtgtatggaaaggaagaaaaacatatatgtgtatatatatgtgtatatatacatatatgtgtatatatgtatatatacatatatatgtatacatatatgtgtgtgtatatatatatgtatacatatatgtgtatatgtatataggtatacatatatatatttgaggcaaggtctcactctcttgcccaggctggagtgcagtggtgcactcatggcccactgcagcctcaacctcccaggctcaagtgatcctcctgcctcagcctcccgagtagctgggactgggactgtaggagtgtgccaccatgccagtctaatttttttatttttatttttctagagatgaggtctccccatgttgctcagattgatcttgaactcctaggcttgagtgatccttctgcttcagcctcccaaagtgctgatattaaaggcaggagccactgcactgggacaaaagcaaattttttcttacaaattttgatttattaaaatggtatttattgaataattaattaattggttaaaaatgcattaaaaagaacaactaccctctgttctctatcagaccactgcttgaatatgaagaaggatgtctacttgttatatttaaaaaaacaaaaaataagcttatgtaaaaaaccaacatatttcagtcttccagtagttggagcagtcatgcagagatgcaggagatatgtgtacatttccagtatcccaagcaatgtgcgagcaaattgtaataatctggcatgtaaaccttgtttaatgctctcataatgggtaatgcaagtgattaaatactgtgatttta

SEQ ID NO: 43598 - DNA, 1048 bp, Homo sapiens
atagactgggtttgaattcagctcagatacttactgtcagattactgaatctgtctaagccagtttcaccattcaataccattttatatcaaggattcagcaaaggagcatatatatagcacttaacacagtgtctgtcacagcataggtatttgacgaatggcaggattgcctactacatatctatccccatatttaaatcatctattctaagtagtacatccctttttccatcttttaacatctctgaagttgggatgtattttacaatctatagtgttttacaattgcttattggtgaagtggcagtcatgaggaagttccaggtatcttttaataaaataattttgcttatatttcccttttttgtacatgtgctggaatgatacatgtttaaaaaatctatgtctgaataattctaaaagagctcttttaataagtaaagtaaaaaccaaaagtgatagggaaccattatctttttttagtggtatctaacacaattttgcacctttagatcagtaacatcttagagttgaggatatgtagtatgtcatatgtatttgtgtgtgtacgtatgtatttggtcaaaaaattgattcattgtcaagattttttcccctgagagcccagccacattttcctaaatgttacaataatggacctagttgcaagaatgtaaagttaaaaatgtaaagagaatgttttcaaaatgctatagctgcctaaaccttgcaaaatgaaaaacgagcacttcttcagcttggaacagtttataaaggaggcaagcatgtgttgtgtgatggttatgctggtgtatttgtgcagatgcatagcacaggctctgagagggtaagacttcatgattaatggtgtttattcttgacagaagcctcctttatttatctgcaatacagtttagcgattttatcaggcacctgaatgaaaaatattcagtcataccaatattgcagtgtaaattgaggagagtcactttttattatatctttctgccttatcatctgcacagtaattttctagcagaggtttg

SEQ ID NO: 43599 - DNA, 1031 bp, Homo sapiens
accacaccctgtctagtgaattggttttgacttgttcctgtattcagcaactacttactgaatcctgaggtgttaggactgaagcagcacagaacagaattcgtggttctaattgtcctgtctaaactttaagagtcagcatcgttgaagagctaagaacagctgagtatcaacccagcaatgatttgaagggcgggcagtgcaagggagatagtgaccttgagggaaatactgtgactccttcctgaaacttcctttaaaccccaagacccttcttgggcactggcctctcctcatctcctgcttgacttttgcgcccttcctctctgtttccttagtaggataatgcagaatgaaagtcaatttttggtatcttttttctgcattgaagaagggagttggactttagcactcagtcctgagtttatttggggagtgtggccctttcctgattttcacttcctgaggacctctggctttggataaagaaacagtgtttattctttggggacaaagatttttctgaaagctcccatacaggagtgttctctagctcttaagattccccattaatgtgtttgtttttccttttgtaaatttgttacattagcatttaattactcttcatgacagtattaaatttcatgagtgatttatagtgatttatagttataatagagacttgtatgatttattacagttggcatttgaggtttaccaaattcttaagagccataagcactgaaattgcttaatctgaccctgtccagaacaaccacagcatgtgtgaaaacccaaatttaagtataataggaacagctgcaccacccaccccatttttatttgatgttactgtctacgattgtggtaaccgtatatatgggggacagtggtggtgagtatatgtgtttcttatgtagaaaagagaagggaaccttttttttttttttttttgagacattgttttgctgttgttgcccaggctggagtgcaatagggcgatctcagctcactgcaaccgccgcctcccg

SEQ ID NO: 43600 - DNA, 1082 bp, Homo sapiens
acagtaagaagaagaccactgggatcccttcctgtctctgggacctgcaagtaggactgatacttgctttaaagacaaatatgagatatctgcctggatctgtataaagtaatgtttcaggggacttgatttgacctgagatatatctggtctgtgagataaagatacatgttgtggcaatgctctcctgctacatcaggaaaataagaaaaggcaacattgagacttttaagagtgactataatactctgagatatagctagctagaatagtctaaagatcatgaaaaattgctacaaggcttttagagaagtcagagggatgaatttttagatttttttactggttccccaacattaattgagctccacacacagtagaataaaagacatgaccttagcgttctagattttataatttggggagagaaaataagaaacaacacatgaaacaattaagttgcatatcaacaagtgtaaaatagcaagataaaaggcaggacctagatctggtgacggtgatttcagattccaagggggtttttacaatagagctttgactccatggcaaatttaaatacactatgaaattctcctaattaacatttcccttcttccttccaaatatcaaatttatggactctgagaaattcacataacacatatgccgatgctgcgttttctttctgcttgatccgttccagcttttattaagtttaatgcctgactttcattaatttatgaggagttgtgaactgcaatctgaaatgctcccctgaattttagagttttcttgcagggaaaatttcacgtgagctcatcctgacccttgctaatatttcagccaagcacatagtttattgtctaatgacctttcaaggcccttcagtgatgttggcacgtgctgtcatattctgagggtggtgcgcagctagtctttgtcagtgttgatttcattctgcctcatacctgatttatcaaacctgagagcccacagcatgcctaatttagcacatagttcctgtccccaaaatctaataaactcagaagtaataaattttctgggtttttgtgggtttgccc

SEQ ID NO: 43601 - DNA, 1054 bp, Homo sapiens
taacctcaagtgatctgcccgtctcggcctcccaaagtgctgggattacaggcgtgagccaccatgcccagccagcaggtcatattttttcttcaagacaacacaatttatttttacttgttctcaactgctgagctgctctgtaataggtaaccccaatcaccacaatatcttgatcacaaagtacaaataaaaaacataggaaataactgtggcttcgttcctaaagaattaacagtgttctgtatcaaggcacattttaatttccacttacagtgttcaaaatgaaaaaaaaaagcattgagttttattttattggaaaactcccaaatgctctcacatcagtcaagctagagaaattgtgcagcagggccaggctgaggttggagatagggcccagaaataaccaagtgaaattcagctgggaaatttagtagctaacaccaccaggggagcatgagaacaaagactggcattagtggatgagcctgcaatccagccaggactgaaagagtctcaggggagaggatgggaccccggaggagacttgtgccatgctccctagggagccgcaggcctaatcagtggacattgtgaggatcaaagggagcccactctaggaagcggggtgtttacgtcgtccactggggggacccagatctgcatcctgattgtgctcctgtcttgtgagtggagtaaaaggaggtgcctgtttcctaggtaatttagacaagagcagagaagtgcacgtgggggatgctgagaagcaaatgccagctcttcttctggtttgctttcgtggaataagcctgttttcaaatggggcaagatttcacatttcctttcccttcccctacccctgtgtctcctctttgtaagaaatttattccctcctcccccaggggtgaagggaaactaacatacaatggtagctttcctgtgacctcgctccctgctagagaatctgtgatccactccaacttggtgtctgtgatcccagcttggctcagtgaacctgaccaagtgggttgaccttttgatcaaatgtgcagtt

SEQ ID NO: 43602 - DNA, 1082 bp, Homo sapiens
caggacagctgaagagtacttcttttttggctgacagtagtgagcagataaccgttaactttctctctgtgccattcaacttgcagcttgttcttggttcgtttgttttaacggtttcccccattgaatcttcccgtcctctgaggggctgggagctctctacacctgggacccttgtcttccttcagcggtgcaagtgggacccatctcctggacctccaatgtcctattaactaatgatgggcacgggagagctcttagggggatctgaattcattcatcatcactctgttttgaggttacagcattcatagtggattattcgttacattctcccacaatattgtccaaatcagtgttaaaattatgtgataacttataaactgtataagttctctgtaaccaaatggcaaatacaattttgacctaccatcccaatgtactccctaaattggtcataaattacattattatatagataatatggatgggaagtcctaaagactgcacagattggctcaacacttgggaatttgggttcaaggtccagctttgtcacttgctagctgtgtgaccttgacaagtgtgctgatccctctaggaatcctttcctcactgtgggatagggtgataatatgactgcctgctccatggtgttcttgtggaaattgagacaatgcaaataaagtattaactaaaatctctggcacatgttaagtgcctcaaatgtattaaggtagttcttctctgctttctcttcctccttctcctcctctttttttccttctcttctacatcatcatcctcctcctcctcatcatcatcaatatgtgataagttgactctctaagtcatgtttgtgagggttgcacttgtatttgattcagtgtagactgttttttttttttttctttctttcttgccagacctggtcacctgcttgcctgagaccagtttcttctataacacagattaagaattgagcaaactgcaaacctgtaactgtggtgtcgttagagctgtgcactgtggccttctgaacataatcttttctcagtcaacctcagtagatcgactataac

SEQ ID NO: 43603 - DNA, 1100 bp, Homo sapiens
gactctactcaaatacagccaataaaactgttatgtgtgtgtcgaagggaacaattatagcatagtaaattcttgcttatcccaatggctaagaatggagtgtttggatcaattaaatatttctgctaaagtttttagtttttatagaatttgccagttttcaacgaaacactgaatatgaaaagaaaatgtatgtagctaaaccagtggtgattgaaattcaagacgctgcagagtcctgtaagtcacagggtcattgatgcgatcatttatgtactcagtaaacattcttacgtgaactaagtgctgggaaagtagaagccttgtcctcatggagcatacagcctggaaaggggaggtggatgttcagcacagacttttccagatgaaggagagtttatcattgtgatgggtgctaggataggtttgtgtagggtgttagaattcaggattctagagtgcagttcattcattagttcatcaggtcagcaaagacttcaatgagtatatactgcactgggtatacagcagtgagcaaaaataaacgtgtagaacagttgttcaaggctcacgcctgtactcccagcactttgggaggccgaggcgggtggatcacctgaggtcaggagttcgagaccagcctggccaacatgacaaaacctcatctctagtaaaaatacaaaaaattagctgggcatggtggtgggcgcctgtaatcccagctacttgggaggctgaggcaggagaatcgcttgaagctgggaggcagaggttgcagtgagctgagatcacgccattgcactccagcctgggcaacagagtgagactctgtctcaaaagaaacaaaaccgaaaaaacaaaaacaaacaaacaaaaaaacaagctttagtgaatctgacaattagtaacgcttgctaacattgaggttccgggtgccatcctccaaggcaaatgcattgcaggaatctgaatgcttagcaagcactgtagaaacactgatacaaatggttcttgtaccaagtgagaaacaatgatgccaattgtattggattattcttgtggcatactttaaagatgatatttaaatcaattttcaagga

SEQ ID NO: 43604 - DNA, 1044 bp, Homo sapiens
caaatgaaaaacccattggatagtctttatagcagatcagacactgcagaagaatcagtgaattttaagatgcagcaaaataagctgtcaatggaagcacagagagagagagggagggaaaaaagactgaacaaaacaaacaggaccccagggatctatgggacagcatcaagccatttaatacactgtaattcaaggaataagagaagagaggtaggggtaggaaaatattagaaaacatacccatggctgaaaaatttccaaatctgataaaaactataaacaaaaaaatttaagtagctcaatgaactccaagccagataaatacaaataaaaccaaggcactatactcaaattgctaaaaaccagtgagaaagaggaaaatctttaaaaaggcacatttataggtgaaccaaggtaagaatgatcacagacttcttgtcgtaaataatgcagggaagatgacaatggaatgacaaaaaaagcagtgtgccaagaatgtagggtgaggtagaaaaggactagaaggagatgaggtagaatagaagtcagggagaagagcacaggatgaggggaaaacaactcaaaaaattcagagtaaggcaatgatgggctaatatatactgtgaaatgcctcctcctccaggaagcactccctaacctcccaggcagagtaaaggagcacagtatatggataaaagcagaagctttggaatctcacactcctggactaaattctggctctgctatttgtaatacagcacaacctaaggttgatttttttttcttatatataaaattgtgttctaaaatttataaacagtgtaaataaagcatataagtaatatatataaagctggaagacttagcatagtgcctggcacatagtgaatgcttaatacattttgactattatactctagttcacacaacaactagtaagaactcctagtaaatcatcaacattgctgcaatcatttataggccaaatatcccttctcttaaatgtttgggaccagaagcatttgggatttcatattttga

SEQ ID NO: 43605 - DNA, 1025 bp, Homo sapiens
ctaagaaaggtgatattcctgtaagcatgacatatgttaacactccaatgctcctaaattagaaagaaaatgcaagaaaaatttagtaccatactcatttcttgaaactaatttgatcaatttttcattaataactcttaccacatatctgttgccatgcttataggatcataactaagaatttcaggagctagtatcagaaagagaagaaaacatttagttttgtggaaaaaaattcctaatttgctctaagagataaaaaactaagcattagaaactataaggcactatccaacgtttgggctaaaatgaaaggttaccataaattaatatgaattaatataaagcctaactagatgtttgtaattaacttgtttacttttcacacttctacccaccattgttgagtccctagtattttacaaaatatttaaatattttaaaaacaccaaacataaactgacaatctctgtgttattaagcattgtctctatcagatcatggcttttaaaactttctcactaccactgatatttctgcttctccattgccccaccctcacccgtggcactttctcctctcacctgggccttttcaactacttgtcccacccctctgatctatttttctgttgcagtcagagtgagctttttaaaacatctacccattaacaaaaagtcaacaaggttaaaaaaaaaaattgggcattctgacactacaggcatgggacaaaggcaactaagttgcatctatagaattgagaaaaataatatgctttgaggctgggtacccagcactttgcaaggccaaggcaggaggatcgcttgaaccaggagttcaagaccagcctgggcaacataatgagactctgtctctacaaaaaataaacaaaagctagccgagtgtcatggtgcatgcctgtagacccagctattggggaggctgaggtgggaggatcacttgagtctgggaggtcaaggctgcagtaagccgagatagtgccagtgcactccagcctgggtgat

SEQ ID NO: 43606 - DNA, 1043 bp, Homo sapiens
actgtacatactttaaaatagtggttaggtgctgtcattttcatgattttgacagttgagaaaccatgttagggagagagctttgtgtgacaccctaatcagaccgtgaagggacaggtctgagttgttcatagtgcagagcgaggcatggccacggtacacagcacacaggtgataggcaaatatttaatgcactgagccttttgtgtgtaaggataattagttactttaaggtattcggcatacacttttacatttccatattttaattggactttactggtcactgtggggcatagatacaactgaactgttcaatcctaatcaaataaaactattagtacattcttatacatctttttgggacaaagtacctcctacttacagagtatccaatgtaaattttttatggacaaagtaaatgtttataaatattttggcattttataacttttcctagcatagcttgagggctgataagaaactcagcagaaacaggctgtggttggcatgaagacactctctctctctctctctctctctgctctaggggattttactcactttgggacaaaagcaatatagtagcatcttttcactgaccaaggtaaccagagtgttgatcagatcacactgatacctacaagtggccaaaattaaatgacaagcatggggggaggtgccaggaagtggcaggggtatagagtgtgagagagaacagatgcatgtgagtgtggtgtgatgagggaagcagctcaagagctgacacctaaacccagaataatttcagaggtgaaaaattaccacctctcttactagtgacattgaagagaaaaaaaattagggtttttcactgatatgttactagtatttaggcaaaaacacaacagaaaccaaatcaagtcactataaagcagtaagaaaatatttaaaaaagacattatcaaactttagtgaatgttattctaagtctcgaaaatttagatgtctgtttagactaaaattttgccaaaaacaaatccaaagtgaaaaagtagcaattt

SEQ ID NO: 43607 - DNA, 2249 bp, Homo sapiens
tggctgggtgcagtggctcacaccggtaatcccagcactttgggaggctggggcgggtggattgcttgatgccaggagttcaagaccagcctgggcaacatggtgaaaccctgtctcaaaaaacaaatccaaaaaaccaaaatattgctactcattaacaatgcacctggttacccaagagctctgatggagatgtacaaggagatgaatactgttttcatgcctgctaacacagtatccattctgctgctgatagatcaagaagtacttttgactttcaaaacttgttatttaagaaatacattttgtggtttctctgatggttctgggcagtcagttcaaaaccttctggaaaggattcaccattctagatgccatcaagagcattcaattcacgggaggaggtcaaaatatcaacattaattggaatttggaagaaatagattccaatcctcatggaggacttggagggtttcaagacttcagaggaggaaggaactgtagatgggctgaaaatagcaagagaactagaagtggaggggcctagagatgtgaccgaattgctgtaacctcaggatcaaacttgtatggatgagaagttccttctcatggacgagcaaagaaggtgatttcttgaaatggaatctactcctggtgaagatgctatgaacattgttgaaatgacaaaagatttagaatattccataaacttagctgtggccagggtttgagaggattgactcctaattttgaagttctactgtgggtaaatgctgtcaaacagcattgcatgccacagaggaatctctcatgaaagagttaataaatgcagcaaacttcactgttgtcttactttaagaaactgccacagtcactgcaggcttcagcaacttatcttttcctaccctcctctcgcatttaaaagtacttttaaattaatgtatgtacattatttttaggcataacactgctgctcatttaaaaaaactacagtatgaaccatgttatatgcagtggaaaggcaaaaaattcatgtgacttacttgcttgtatttggtttattgcagtggtctggaactgaaagtgatgcgtatttctgagttatgcctgtatttaagaagctgagtgaaacccaaagaagtccatgataggacagacttctgaaaactaaagacagaaaaaagcttgaaagcatcaagaaagaagtgaaatcttagctagagggaaaagtaactcagatgacagtggatttctctctggaaaccatggaggccagaaggaagtgagacaagttcttttagtgccagaagaactatcaacttgtggctgggcacggtggctcacacctgtaatcccagcactttgggagaccaaggtgggcagatcacttgaagtcaggagtttgagaccagcctggccaacatggcaaaaccctgtctctactaaaaatacaaaaattagccaggcatggtggcacatgcctgtaatctcagctacttgggaggctgaggcacgagaattacttgaacccgggaggtggaggttgcagtgagccaagatcctgccactgcactccagcctgggcaacagagcaagactgcctcaaaacaaaactctgtcaactccaaattcctatttggtgaaatgatccttcaggattgatggggtaataaaaacattctcggttgatagaaaactaaaagaatttgttgaatgagtctaccctatagaccttgaaaagaccaaccctaaaggaagttcttgaaccagaaaggaaacatttaaaaaaaaaaagttttgggatgtcaggaataacgatggaaacagcaaaaatatgggtaaatacaatagactttcctccttgagttttctaaattggtagtggaagcaaaattgtctgacatagatctcaatgtacgtagcaggttatgtttaagacaattataaatggggtggggaggggacgggcaagagagttttctacatttcactctaactggtaaaatgtagatatcaacagatctttatatagcagtgaagcagttccatatctcaaatgtgttggtaggaagataaaatggcataaaatgatatacattgtgcaaatatcaatttcctgtagttacgtaaagatgtatctgtactgtcttttcaactccctgtaagtctgtaactattgcgaaatcaaaagctttaaaaagtataggatgaaagtattgaatatgctgctttaaaagggacagggtaca

SEQ ID NO: 43608 - DNA, 1049 bp, Homo sapiens
caaaggtggttcaatatcgggaaatcctggaattattttaacctaagacatggcttagatctaggacttaatattcaattggagagacacacaaaccattgattgcagaacatgtccttggtggtttgactgagtcaatatttataaaattatataaaagttatatttataagcatatattttataaattaagctactttctaggaccacattgttagaaaattcactattcaaaacaaagtagaagaaacaagaaagagtagacacacttctcgctattcctccactaagtgcagcctggacttccataaaacaaacatcagactactgtgaaagatgagaagaccaaatggctaggaacttcagtacccaaggaataacacagcatcgatttccctgggttttcttttgcctaatattgggcaaatatgaggcactggagaaaccagtaccccagaaacaccaataggagccaacggctaagcaaagcctggtgtctctagccaaaggatcaggacagggcaacttagaaagatggagaactctaagaagtaactgccctactctatgcaaacaccatggaaaaacccatggccccaatcccacagcctcatcagcaaaagccaagtggggagcctagaccttctttgcctgttgtaatgaggcctccccatcccctgctggagcagtgtcagagctagcccagcagagagcttgggacatctatccctgcaggatggtaatgaggcccacccccatagtgtcagtggaggccatgttgggagcttagacttttaccctgacccaggaggaacaactgcccccactcccatggtatcagtgggacccacgtgttctagcgggaagctgcacttagccacccctccccctgcctgtattcaaaggggctcagtagtgagcctgaaccatcaaccccaccacatgcccccgtcacccacttgggtggtgtcagagtagacctacgaaaacatgattcaaacaaggtccagcgtctcaaacccaaatgggcagaatagaacagaaagcca

SEQ ID NO: 43609 - DNA, 1032 bp, Homo sapiens
tgataagcagacatgatggagagcacaacatgcaagtggaaagcacaacatgaagaaaggccccagagcgggcagatgggagctgtgctccagaaatcagaagcccagtttggacagcgtgtagatgagcgcaggtaaagtaaaagagaggcctggaaaggtaggttggccacagtgtgtgaatgccactgttgacattttgcatacaatttgtggccatcaaagatttgggggtaagcacatgattctactgttaatgaaggtttcagagattgtgctgaatgtgtactgacaagacctgtatgactttcaagtaagtcacagattttactgtctttgttcaattttcctagaattagcctccacttgcctgcaaacattccctattcaccaacccaaggacatgataatacctgataaggttttattgctgagttttggtaaaatttgtatacaggaacagtgacactaaaattacatatacacaaaacagccagaacttaacaatagttccttctgtcctctggccaccagcaaggccagggaaatgctcaagaagcggcagttctgaagggttttcccaaagcaagcagctttggaagtggctttaggccacttgactctctggcgttttcagtttgtccatctgaaaaatatgaataaatatttaccaatcacttgccttacaggtgagacaatgtttatactgctcattgggatgcttgggcaaaagatgctgttttacacaggaggctcaatgatgggggcggtccagaaagaggtgggagggtgattgataggaaaacctccagtctccacccactagaagattctcacctccttagtaatgcgctcctggttcaggcatgttttttggcagagttcctgagttgaaagcactgtcaggaatgtgtacagaaaaactgcgcccatgttataatccagggcagaaaagtaggaaatgaaaatactaaaaacatgcctctaagacacgggttgggtgccgaagtgaaatctgactttgcaggagag

SEQ ID NO: 43610 - DNA, 1027 bp, Homo sapiens
ggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacaaatgctatttgtcatttttaaactgaatccgaaagaaactcctattataaatttaagataatgtaatgtatttgaaagtgctttgtataaaaaagcacatgataaaaggaatcagaattaataaaatgtttgttgatctttgctagttctcatttctttcctttctcttcctcttcctttcccctggaattttcagtcctcattacaaagcctgaagcttagtagcactgaagggattttttctaaattattgacctgagaatgatgaggaagaccactggtttttcactctaccttgaattcatgttgttaagtagcttgtggacattctctatcactttggaatattttgtttgctttgcttttatttatttctatttcagacaccaaccatctgcccagttgaagatttgcaaaataattgtttttattccaaacattttgaaagcttagaaaatttatatgtgtacatatacatataaagttaacttaggaaagttagtttgaagctaacagcatctggctgggtgtggtggcccatgcctgtaatcccagcaatttgggaggccaaggcaggcggatcacctgaggtcaggagtttgagaccagcctggccaacatggtgaaacctcgtctctactgaaaatacaaaaaattagccaggcgtggtggcgggcgcctgtaatcccagctacctgggaggctgaggtgggagaattgcttgaatccaggaggcagaggctgcagtgagccaagatttcatcactgcactccag

SEQ ID NO: 43611 - DNA, 1057 bp, Homo sapiens
tgaggaaatgcctagtgaatgacagtatgtcctattgtgctctaactttatttcagccttatttcttttctgaatattatttttcatttatcttcatttccttacctattttcttttcttctaaagtatgtatctttgttagctccatcatcctttttggaatgagcaagtataaaaataagtaaataaataagacccatcctaagtattttaagaaaccacccttttgcggcacacttgctaccttggtcttagctctgggctttggtgtcctctggcagtcctgctgcattgccttctctcccccatctgcccacccctgtcccagagagatttttctgtagcccctcatctgcagagtccgacagctcagggtcgagggtctttcttagcagtaatcacccactatgctctcacccctccatttctggacatgcttcctgtggcttctctcctgcgctttacacttcagcagttcttgtttctgctcactctgcctttgtttgtcatttcctggatttgaagctgttctgctcttttcacctttctcttctcaaggtaaacttcctctgtgaaacctccgctgatgccctgcagcaaggttgaccacttcctgagtgttacttcctctcttggtgcatatgtctggttgcactaaccaggctgctgctagcccaaaggcacctttgtgcaaattagaaaaagacaaccatccccatcccttcttcaagatactttatagtacttccaactgttggcaaactgtcttaataaagatacaaatctttgatttctctaatgtgcatggtgccctacaagggttgtgcagtgcatagccgtgcagttgcatgtgatagatctatgttataattatttgtttaattgtctgtattcccctcaggaccaaggaaaattccttatatcttgatactgtttttatattcttactgtctgaccagatcagaccctcagtaaccgtttgctaaacaaaagaaggaatgaaggtacaaatatgtatccaccttgtctggaaaaatagcaggaaaggcatgcctgc

SEQ ID NO: 43612 - DNA, 1026 bp, Homo sapiens
attggactccctgcttccattcttgtcctttctagagaaatctttaacaaaaagcaagtcatactgtgtcatttcctgattgaaaccttcagcatcttctcttacactttgagtaaaatccagactccctaccatacctacaaaacctgcatgatgaagaccctgccctcttgcctggcctcctcttccacacctcattcacgagcctgccttctgcttcttgaagataccgagcctgtggctgcctcagggccttggcgtgtttggcgtgcccttcccctggttttcaaatgatccctccagtctcacatgtcaccttggcagaggtgccgttcttcactgccacattaaaattgcgcttccccctttcatattctagtatgtcatgatatttatttgtttgcttatttttgagagagtcttcacatggcatttcccacttgaatatttcaaggttttgatagtgaacactggcgagaggtaggagtgaaattagagtagattttagagggagaacaacccttactatgttatttggtcttaagaaagtacagtttagaaaacaattcgatttcattcattatttgggttttataattcattatgaatattagcatatgttttatcaggtgtttatgttatatcttagtttcgagaggtttgatttgttctcagatgacattttatcacatctttgagctaatttcttttcagtggtaaattttttttttttgagacagtctcgctgtgtcgcccaggctggagtgcagtggcgcaatctcggctcactgcaggctctgcctctcaagttcacgccattctcctgcctccgcctcccggtgcccgccaccatgctgggctaattttttgtatttttagtagagacgaggtttcactgtgttagccaggatggtctcgatctcctgaccccgtgatccacccgcctcggcctcccaaagtgctgggattacaagcgtgagccacagcgccgggccttcagcagtaacttttttaaaaaaaataaat

SEQ ID NO: 43613 - DNA, 1032 bp, Homo sapiens
atgttttgtgatctcataagacatcagatttagattgaaagctcaaatcttttcaggaaaatgtctgtttttttccccattttattgaagttgtagttcacagtagtaataacggtgttatagtggatgaaatttttttttccaccaaaagccattaacatgtaaaacacattaatgttttttgaaatgagcaattctcctatttttcatatatttcttttttattttgagacagagtttcaaaataattttgaaatgagcaattcacctatttgactacacagacttccagtatgcttgcataaaaggaaaagtcatgtgagaacatcggaatttagaagtacttgaaagtaaaagactgaagacataaaggaaatgtaagcaggatgataaatgtcagttgatttaaactgacaggagctctgttctgctttatagcatattcttgtagggagagctgatcctagctgatggctagctctggagcaggcttgttgaagctgttcataaatgtatttatgtttttagagacagtatctcacactgtcacccagactggagtatggtggcatgattatggttcactgaagccttgaacccctgggctcaagtgaccctcctactttaggctcccaaatagctggcattacagcagtgtgccacctgttcataaatttagaacaatatttagtgtcaagttagtgatttttctaagggtggaacagggattactacaaggtgaacatgcttctgtaatcgccacacaggtcaggaaataaaacgttatttatattctatatttctttatgtgatgtctagacactatcttcatattccccagaggtaactactgtcctgatttaaaacaccatagattttatgtgatttaaaaatatatggacacagtattatttagcctaaaaaaggaagggaatttggtcaccttgatactatgcgaagtgaaataagccataacaaaaagacaaataatggagccgggtgtggtgttgcatgcctgtaatcccagccact

SEQ ID NO: 43614 - DNA, 1015 bp, Homo sapiens
attcaagttatagtattgagtatacagggtccaaatattaatacaagacataagttctctgtccaatatttcagttagaaggtgctactctgtataaccctattgcaaatagtagagtgagtatagcagttcccacaagtgtggtatagtagataattttcatctaaaattttacttgccaagatatttggggatttatgaagttccttggttttatttcccaaacaaagaaacctcagggttatgggcaccctactcactttcattacctggcagaatttgcaggataattgcccagaaccagcatattgatccagatttttatgttatccatcccattttgtttcatccaagctgtaggagatcgccacttgattcacaggaataagcagggttagtctaaaatgtaggcaaaaagcttaaaaacaattagactaggatttaatgacaaatgtatgataagctttggagcacaatttctctctccagtcctcattttttgtaaaaacaaattatgataggaccgtgtgtgttgtttgtagaataaattttagtcttatacttggcctgattatttgcataaagtgcagcaagagtggttatttctacataggccttttggattggctttgatggaactctgttccacaggaatctcagataagacctttaaagctgagcccagccatccacatgggtttgtatcctcaaatacctgtgagttgggtgatctcctcttgaggtcccaagataaacttggagctgctggacctgttagaaagtgacattctttactgacgacaggttaagatctctgttcatggactgtgtagacaaggtatgaggccagtactccccaaggggcttttattggctctgcatgtcaagcttgattccttaaagggaaacacaccctttcagtcaaagccttggtaaaataaccagttttaccaattgtgtcctgtcgacaaagaaaaatggattcttattgcactgatggaaacaattatattgc

SEQ ID NO: 43615 - DNA, 1022 bp, Homo sapiens
tagtattccatggtgtatatgtgccacattttcttaatccagtctatcgttgttggacatttgggttggttccaagtctttgctattgcttgaaatagttttgacatgtttccttgagcagaggagaaagtgatggtgttacagtgagtgcacttatttattctatagcctgacagagtatttgtgattgtaaatgtcatctgtttgtgttggggaagaacaaaaaatgaagggctactcctgtgttcagggtttctaagaaaaacacaaagtgtaatatctgttgaaaacaaacttggatgatgacttttaacctttaaaattaccttcagccaagcacgtctatcaactttaccagctgttttgaaaatacctaatacctgtgccatggttcagctgtgaagaggacagagttggtttgaataagagtagttataggaagtttgtccttaaaagtcctgaagataagtcttgatgctgagtcatacatatttactccctctgtgactaactgaataaactcaattcatcaaggaaatcgtgtccttgactcaggtccatttgtcacaaatcacaccctccaactttaggattacatcagactaaaattatggacaaagcaagttgctatgttaattcttttctaacacaaggagtggtttatcatcacattgcccacagtaatatcattgcagttttatatgtttagggtgatttctccaactcttcctcaaaattatagagttttataaagccattttcatttttggagcaagaaagaagtaagctttgttgtgtattagatgcttaccacttgccaaacgttgtattatatggaacatgagacaagtaacacacagtttctacttgcaggcaaacaggacaatataacacatgaaacagaatgaaagtttactcagagttgaattttaagaatagttttgatttttatcaaagaccatcttagttatttatatgtgttgaaggtttataatctgtaaatctgaagtgttggagctatt

SEQ ID NO: 43616 - DNA, 1045 bp, Homo sapiens
tctgaaaatgcttacaagaaaaacatatagaaagcaaagaattcttaaggccaagaaagtggaacattaagcattttgatctgttaggcatcgtacaaaggatgaagagacccaccccaaggggacttaacagttggcaaggacaaccatagtatcataaataaattaagctagaaaaaatactaatgcatactgtacctctattattttaagagtgtagagctttcttacacaattcttagtgataaattctctttgctaccattgaccatatagtttaaaattttcagttatttttttcagccaactttggatgtgttctgaagtttttttttttaaattgacacatattaattgtacatatttatggggtacaatgtgatattttgatacatgtgtacaatgtgtaatgatcaagccatggtaattagcatatccatcatctaaaacacatcatttctttttgttgggaacattcagtatcctcttttttgctgtttgaaactatatattatgttacctataatcatcctactgtgctttagaacactagaacactagaatcttctgttctactttttacttatatgagatcaactttttttagcttctgcacatgagtgaagatgtggtggtgaactttctgtcctagcctattgcacttaatgtcttctagttccatctgtgttgctgtgaatgacaggatttcattctttttttgtggctgaatagtattctattgcgtatatataccacattttctttacccattattctgttgttggacactaggttgattccatatcttggctattgtgaatagtgctgcagtaaaccttatttctttttattgtttgtaagtttttcacccagtaggaaatctgtaaggcttaggtcttctatttaaaatgtcacctatttaatcatgtttaattaggttgatggaggggcaactttcctatttttaaaattttgaaaacaaagtggatactaatcgtactttcttaaaatggtatgctgctaacattttaaatttaatgtttta

SEQ ID NO: 43617 - DNA, 1030 bp, Homo sapiens
ctctctctctttctctttctttctttctttctttctttctttctttctttctttctttctttctttctttctttcttttctttctttctttttttgagtcaaggtcttgctttgtcacccaggctggaatgcagtggcatgattatcgctcactgcagccccaaactcctggcctcagggagcaatccttccactgcagcctccagagtagctggactatatataggcatgtactactgcgcctggccaattttcttttctttttgtttttttttttttttttttttttgtagtgatgaggtctcgctatattgcccaggctggtctttaactcctggcctcaagtgagtctcctgccttagcttcccaaagagctgagattacaggtgtgagccaccatccctggcctgatgatgaatttcttgattctcttgtagggccctccttcttgcactgtccattaattttccagttatagggaagaggatattccatatgtttgtagatctgagagacattagtctgtgttagaccaactaattcttacaggcagtgtatcaatgagtcttgcttttttccccctttattcattaggacaatctctgccttttagtcatagtgtttagacaatttacattatttttttttaatttatttttctatttcaataggtttttgggaacaggtgcctttgcatcctcataacttagctcccacatatgagtgagaacatacaatgtttggttttccgttcctgagttacttcacttagaataatagtcttcagttccatccaggttgctgcgaatgcaattatttcattcatttttatggctgagtagtattccatggtgtatatatgtatgtgtgtatatacatatatgtgtgtgtgtgtatatatgtgtgtgtgtgtatatatatgtgtgtctgtacatacatatatatgtatataccacattttctttatccactcgttgatcggcatttgggctggttccatagttttgcaattgcaaattgtgctgttata

SEQ ID NO: 43618 - DNA, 1029 bp, Homo sapiens
tgtgcttgatggtgtaaccttcaagccgtatctaattgttaaatgatttaatcagtgagaactgataatggacttttaaaacatattctagcttagcttagtgtcctttaaaactgggaaccaaagatcatgtgtaagtatggtatgctatttatgattcacatctcacagccactaacaatttatacaaatgattagcataataaggttgtcagagctagttggctggcgtcactgttggctcatggcagcctactgcatcaactctaaacctttactatggttatgtataggaggctttgcattgccttttgtcctatgagtctcaaaggtattatataaatattagtggatgacaagttttcaatatctgtgttgaattataacgaggaaaccttgaattacaacaaggaaaccatggcattgagaggtttgtcatttataccaatgagctggtcttatacctctgcatctgtaaattgtgtatcagttttcacatttgagatttaaaaaaggtagacttgcctgtaagaacaagttggttagcaagcagtgagttcctggaaaaaaaagcgttttaagttggttgtattgacaccactgaaattaattatcactgaaattaacctttctgatttacctactggctaaacgtttgtttttcatattgtctatgatgccataaatgtgttttgactttgcaaagtcagtttttctataggttatgctttaatgtttctggactttcatcctgtattaatctaattaataagtgatcttggtaatttttctactgatttgagctaacataggcgctttctggttttggtaaaatgtctgagaatgcagaagagattatccttctcttgctgtgattcggaaactcatgtccctaaatgaaagagctgctatctacctttatattagtcatccgtggcaactggtgattttagatgctcacatgagtcttggtgccttttgctgtggtgtgtctgcttcagattgcatttccatttcacagcccttgcg

SEQ ID NO: 43619 - DNA, 1078 bp, Homo sapiens
agacatatatatggccaacaaacatgaaaaaatgctcactatcactaattattagagaaatgcaaatgaaaactacaatgagatactatctcacaccagtcagagtggctattaacaactcaataacagatgctggcaaggttgcagagaaaagggaatgcatatacactgctggtgggagttaaatttgttcaaccattatggaaagcagttgtgactattcctcaactaaaaacagaactaccaatctcattactgaaccccaaaggaatgtaaattgttctaccaagaagacacatacatttgtacatttattgcagcactattcacaatagcaaagatatgggcacccaggtgcccatcagtggtggactggataaataaaatttggtacatacacaccatggaatactgtgtggccataaaaaagagcagaatcatgtcctttacagcaacatgaatgcagctggaggccattatcctaagcaaattaacacaggaatagaaaaccaaataccacacattctcacttataagtgagagctaaacagtgaatgcatgaagacacgaaggggaacaacagacactggggctgttgatggaggatttgaggatggagagtgggaggagggtgagggttgaaaaaactacctattgggtactatgcttactacctgggaaatgaaatcatttgttcaccaaaccccagtgacatgcagtatacccatgtaaaaaatctgcacatataccacagacctaaaaagttcaaaaagattttaaaaagtaaaaaagataattttgtgacaaggaggtatttcaactttgttatgaaaaagaatcttcaaaatatattgctgtaagttttaacaaaaactttttggttttgtttatagcttgcttgcttttgtaggagggaaagcaggtgagataggcaggatttaccagcataagcttattactactgttggcaaaatgctttgtttatggcatcattgctgtgagtcgagggaagtcttctgtgcttccagtaacagcctgagatgtacctacttctttacagagcacctagtagggaggt

SEQ ID NO: 43620 - DNA, 1028 bp, Homo sapiens
gaagctggaaaccctgcacagggttgccaagcaccacggtttgtcggtttgtcgctggccctgagtcgctcctagggatggggtgagtgaaattgatgtggagtggcccactcttgccgcggacctctgggagcctacctgtgggagaccccatgattctcatgaacatctgagctggcaggaagaacttcctggagagttgacagagatggaactctagcctgcatggagcccagagggtttgttgtgggaacagttgcagtggagcatggctgtggatatccataacaccatactcctctaggcagctctagcctttgttggctgccagacctggacaatagagggctggcttgcttgtggaatgggaccagtctgatctgaggacctcccccaactgcccgttgctggcctctgttagggtccctccctgcctggctgtacctgcttgcagcacagcctcagcttgccagcagccatcactatagctttttgccataagaccgtatctgtccattggagtgcttttgcaaatggacccagacccctgccaatgtgcacctgccggtagccttcccctgctggcacgtgcccacctgcagccttctcctgccagtgtgcatttgcccacagcttccccgtgccactctgcaggcatgcatgtgcgtgggagcctattgctgccccaccagagttcttttgctggcagctgccatcggagtgttgttgccagtggaccgggaacatctcagctccttcagagcagtaggtacttaacctcaaggagccagaaaataaagccacaggcctggtcccagcaccacaaggattagagcatgtagcccaggagtgctctgttgagccttggcctcctgaaagcatccacaatgaagccagttgactaaaccaaacaaatattagtcaaactttcaggagcatcaaagaatataaaaagcaagaagtcccatgcaaaaagtaacaacttcaaagattacaggatatcagcccacacaggtaagaaagaacca

SEQ ID NO: 43621 - DNA, 1030 bp, Homo sapiens
aggcatttatttgaagattatttaatgtatgcagaggttgagtgtagctattgtgttctgtattgtttggggcatgttggaaaaagtagttttataaaatcctattaacattgttttgtatttttttaattttgttggttaaaaggcagtagtagtaatatatatagtatatatataatatatatattttttgagatggagtttcgctcttggtacccaggctggagtgcaatggtgcgatctcggcttactgcaacctccgcctcctgggttcaagtgattctcctgccccagcctcctgagtagctgagattacaggtgactgccaccatgcccagctaatttttttgttttatagtagagacggggtttcaccatgctggctaggttggtctggaactcctgacctcaggtgatccaccgcctcggcctcctaaagtgctggggttataggcatgagccattgcgcccagccagtagtaaaagtatttttagaaactgagcattttgagaatctaaggaaagtgatatacaatagcttccagaaaaaaattgcatctctctgtttacatataatggccaagatttcattctttccccttggcttgattccagttagaactgtgtgtttcttgtttcagtgttttgtcttttcttttttaaaattgtgatagaatatacataacataaaattggccattttaactatttgtaaagatacagttcagtgccattaagtactttaacattgttgtgtaaccataaccaccatctatctccagaacacttttttctttttctttttttttttttgagatggagtttcgttcatgttgccctggctggagtgcagtggcgtgttctcagcttaccgcaacccccacctcccgggttcaagtgattctcctgcctcagcctcccgagtagctgggattacaggcatgcgccaccacacctagctaattttgtatttttagtacagacggggtttctccatgttggtcatgctggtcttgaactctcgacctca

SEQ ID NO: 43622 - DNA, 1042 bp, Homo sapiens
cctaaaagtaattagtacattagtacattcacaaagttgtacaaccatcatcataaaatatgctgtaatcttcttcaccttcattagttggtttaattttctatttcagacagactccaataagttattcttgtattcttttgttcatgtttaatatgctgcattcagtttgtgagagccatattggaacaattgaacattttcatcactccaaaaggaaaccctgtacttattcagcaggctcacctgacttccccatccccactccccattctaagccctaagcaactatgaattgactgactgtatatttgactattctggattattcatgtgagtgaaatcatacagcatgtggtctttttcaactggcttcttttacttaacattcatgttcatctgtgttgtatttaatagcatgtgtcagtacttttttttattgctggttaatcttttatgggtattaccacgatttattttccattagttagtggacgtttggattgtttccaccttttggccattatgtgtaatgctgctgtgaacattcacctacaagtttttgtgtggacatcatgttttcatttctcttgcgtatgtgcctaggagtgaaatggctgggtcatatggtagctctgtttaacattttaagaaatggtcagactgttttccaaagcatcagtgtgcatctttttaacattcgcaccagtagtgtattagggttttgatttctcactccttgccaacacttgtcattatctgtctttctgattctagccattccagtgggtgtgaagtgtgtgtcattgtgttttcattctttttcgttgacatgtaataattgtacatatttagggactacagagtgatattttgataaatgtatacaatgtgtagtgatcaaatcaggtaattagtatgtccaccacctgaaacgttcatcttttctttgtgttgcgaccattaaaaatctcctaactttttgaaaatattatggtttcaaatcgtatttccctgatggctaatgatgttgagcatcttt

SEQ ID NO: 43623 - DNA, 1031 bp, Homo sapiens
ggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggcc

SEQ ID NO: 43624 - DNA, 1041 bp, Homo sapiens
ctgtcgcccaggctggagtgcagtggcatgatctcagctcactgcaacccccgcctcctgggttcaagcaattattttgtctcagcctcccaagtaattccaagctggaattacaggcatgcgccaccacgcccagctaatttttgtatttttagtagagatggtttttcgccatgttggccaggctggctggtctcaaattcctgacctcaagtgattttcctgccttgggctcccaaagtgctgagattacaggcatgagccaccatgcctggcctaattttttaaaaaaagtctttgtagacacagggtcttgctttgttgcccaggctggtctcaaactcctggactcaagcactcctcttgttcagcctcctaaagtgctggggttacaggcatgagcacttgaaatttttgacagaaaggttctaacttgctgatgaaactaaatgtatttggtttcttttttcttctagatttggaatggagagaaatggaaggagatgattgcgagttccgttatggaggtagaaactacaggatttggcaacagattggactggggagagggggagtgggtaaagtgacagataaccgggattttatatttagaacaattgggagaagttgccatcttggtgagaaagaagggttctaggtttagcttcaattaatttgtgtcagccaagggtgcattatttgattgacacttcattttccattgctttttccatagatggtacaaatgaggctcaggacaatgattttccaacaggtaagcattttctctgccttttctctctgttctatgaaagggggttatcatctaggccagcagttcccacacctgactgtatcaaatcacctggggaggcagagcactcaggtttaggatgccctacttcattaaccctttatacattgttaaccatattgctaaaaaaaaaaaaaaaaaaaaaccctgggaagcttgctaaccacatagagtaaccaggccccccctccaccacccaacatactcactgcctttaataagttagc

SEQ ID NO: 43625 - DNA, 1071 bp, Homo sapiens
acagggtttcaccatgttggccaggccagtctcgaactcctgacctcaagtaatccgcccgcctcagccttccaaagtgctggaattgcaggcgtgagccaccacaccaggcctaaaatagtttattcttaattagactgcacttatcatagctatttaaaataattcaggatcaccccttccagaccacagtgttaacttcagatgaacatccttctagagttctgtatatatacctatagataaacatacacaattttattaaattgtaatcatactgtgcatacttttctgtagcctgactttcccccgactaattaatataacagctttccctaatatctcatccagcatctttttgtccacaaaagaaatccatagcgtattttttaatggctgcagaatttgaccataattccgttattgcactttgattttaaaaggcatcagtttttcgctattatatataaagctggcatcaacatctttgtaactaaatcttaattatttccttaggatagaagtggaattactgggcaaagggtatgtatatttttctgtctttctgaatgactgtatttgtgctctggccagcagttttggagagtgctggttttctagaccagtgtttctcaactgtgggtgcatatcagaatcattgagggcacttttaaaagcagtgatacccaggaccagctcccagagattctggtttcatggatctggggtgtgacccagggtttatagtttttaaaagctctccaagagattttatatgcggccagtttgataggtgaaagtggtattccatttttttaattataattttcttctgaaattgtttcaggcattcagatttgggagaagtagccccagaaataaaagcatcagagagacgaacagctgtggccattgcaggtaaagttggatgaattggatgtgggcccactctggagctgaagtacttctcctgtccccttgggattctgggttccagcccctcctggacttgggattgtgcatctcaaaaataaataagtttaaggcttttatttttccttttacaagaag

SEQ ID NO: 43626 - DNA, 1052 bp, Homo sapiens
ttataataaggcatatattataaatatatatttatataaaaatttttatataaatatatatatacactttttgagatggagcctcactctgttgcccaggctggagtgcagtggtgtagtcttggctcactgcaacctccgcctcccgggatcaagcgattgtcctgcctcagcctcccgagtagctgggattacaggcatgcgccaccacgcctggctaattttcgtacttttagtggaaacagtttcaccatgttggccaggctagtctcgaactcctgacttcaggtaatctgcctgccttggcctcccaagagctgggattacaggcatgagccaccacacccagccttttttttttttaactctttcctctctgaaaatccagaaatagatttcttttaaattaaaataaatttatttatttatttatttatttatttatttatttatttatttttgagacagggtcttcttgctctgtcacccaggctgctgtgtactgcagcctcaaactcctgggctcaagcgatccacctcagcctcctgaataactggacttaaggcacatgctcctggacccagttaatttttaaattttctgtagagtggggtttcactgtgttgctcaggctggtcttgaacttctggcttggaactcctgacctcaagtgatactctcaccttggcctcccaaagtcctgggattattggcatgagccactgtgcccagcccttttcagttcttcaagtcttaatcagattcagtattttaaaattcttctcaaataggtgttgcacatttgtaacatattatttttcttgttgctactacaaatcggagctctctccttccattgtttctaacctatttgtataataggaaggcagttactgattttaactttgtatgtccccggcttactgaattctctcattgtttatgatagttttcaggttgatctcttgggttttccaggtctacctgcaccatcatttctttgcattatggagaaaatgcaagttgattctgtctttgttgtgagtacact

SEQ ID NO: 43627 - DNA, 1052 bp, Homo sapiens; identical to SEQ ID NO: 43626

SEQ ID NO: 43628 - DNA, 1052 bp, Homo sapiens; identical to SEQ ID NO: 43626

SEQ ID NO: 43629 - DNA, 1052 bp, Homo sapiens; identical to SEQ ID NO: 43626

SEQ ID NO: 43630 - DNA, 1048 bp, Homo sapiens
ggaaccggggtgcgggtcctcgccgcggcccggggcaacccgcggaggcctggaaatgcttcgctccggcgcctggtatcgatgttcctgggttttaaacttgctcgcgttgggagtggacgcttgtttgccgcgtcgttgagacgtacccagaatgtcaggatccgggcagatgcagaccctttgctgacagccggagagccgctccgggatctccttggtcggggccattgcctaccggcctgccttggggtggctgcgcttattttgatattacctcttttcaacttttttgatttaaatgttattccttttaggaaatgatggcgacacatatagtttgtaatttttgagaaaaaattctcacttggcaaactaaaacctcagtaattcattatttttttgttttttgttttgataattttactagtactgaaatttgggaatgacagtccaacactttcattttacaaagaaagaaattaggctcaaggtcatcgctttagttgttaaaattcttctttgactgttacccatcattcagagggtcttggatctagtggctgtgatagccattcagaacagttcccaaagagctttacaggtgtgtgttcagtggtaggggtggggaggggacggtgctaaggggccgggatcatggatttcgtgcctcctccagatgaggcctgagccatgccctggggtgatttggctcagtacagtgggcctgaatgaagcaagctgaatttgaaccccgcctgctgtctttctaggctttggggcagtggtcatttccgggaccaggccttttcattgccagctgactacccagcactttgagctcatgaatagagtaagcagggaaccatccctgggaaggccaggctgattgacctaggggttcaaggtcctgcagcattcctttcccccttgtcaggaaagggtgggcagagcctcctggaggcaatgttgagggtggctgaacctgtgtggggctgccctgaacgaagctttaaaaaaaaaaaaaatagtggtgcatttggtgccc

SEQ ID NO: 43631 - DNA, 1048 bp, Homo sapiens; identical to SEQ ID NO: 43630

SEQ ID NO: 43632 - DNA, 1048 bp, Homo sapiens; identical to SEQ ID NO: 43630

SEQ ID NO: 43633 - DNA, 1048 bp, Homo sapiens; identical to SEQ ID NO: 43630

SEQ ID NO: 43634 - DNA, 1090 bp, Homo sapiens
ctacagacaccctcatgctacagtgcatgtggttgtgcctggcctagggggtcggaattttacaattctgggtctgttaattggtgtttaaacagagagctggcaatgaaggtctaacacactgctgacttctgagctgagccagcgaactgaccacagcagtgtttcccaccttgactgccctcagcctcaccttcggtatagccaagcagacatccccttgtcttaggctataaaccctagaatttaaatcagaatttttcttgttgtcagattcttctgagtctgttcttggctgaccactgattttgctggtcttgagggcagggcttggcaatgttttcatatacagtagcagcagctaatgagttatccaggaggggaactgcttttatctccttttccctccttagactcaaaggacatgttagtgagagagccaggagtccaagcccagggcacaccctctgtgcacatggctcagcatgggcaggaagatgtctgtgggaacctgcagcctagaagcaccagctcagagcacaggtactgcatggagctgcctggggcagccatggtgcaaaggcaacccaaagaggacacgtacttctctctgtcggccttgtaggtgtgtgctatctctggcaccagggggtcatcggggttggggtcgcagagcagcgagcagatggacaagagaactgggaagaaaagaaaaggttggtcagctgtagccacgaagctgctgggtcacccctgggtaaacttccctgaacttgcactctgtattttgaccaagcagttgtcttcccttcaacagcccaatctaaattgcttgatgcaccacttgccccgtcccatgtatcagccgaggtggtcctcactgtgtggcctgaggcatgctgtgctaggatacttccctcctgggtgcatcctggttctcattccccttctccactgaagcaccccatcttagtctccaactgccctcccatccttgtctgtaccctacatcatgaacctctggcatttagtcctaggagtcctgtttactgttaaggaaacaagaattcagagcattcaagtaacttgt

SEQ ID NO: 43635 - DNA, 1662 bp, Homo sapiens
ttcccagagagggatcctgagaatcccctgggagagaaaatgtcggagccccagtcctggcccccccttgaccggcttgggcctcagcctcctcatccatgaaaagaatggacaagaggggtctgggtgcggtggctcacgcctgtaatcccagcactttgggaggccgaggcaggtggatcacgaggtcaggagttcaagaccagcctggtcaacatggcaaaaccctgtctctactaaaaatacaaaaattagccgggtatggtggtgcacgcctgtagttccagctatttaggaggctgaggcagtaggatcactggaacctgagaggcagaagttgcagtgagctgagattgtgccacggcactccagcctgggcaatagagccagactccatcttaaaaaaaaaaaaaaaaggagggacaagaggcaccagaagctcctgtccaggtctgggcctcccttgggtcactcagttctcccccattcattcattcattcattcactcactcactcactcactcactcactcattcccacactctgcagccactgacttcagctagccatgctggatgctaagacatagagtcccggccatcaaggccagtccatctcagtggcatctagacatgcacagagatgaccagggagcccttgagggacagagaggcacaccctgcctcctgatcccatctgggggctgcatgaaggaggggcacaggtgtggccttgaaggctgggtaaggggctgggagggctttaggggcattccagggggcaggcacagagctggaggctctgccaggcacacccacaggagagcaatggctggagggtgacatggactgcagggtgtggccgcggcagcccagctcttaaggggacagcctgggaaaacagacttagggacaatgatcttgagccatgaaatgatgtccaatgccccttgtgccacctgacatcagcctgattaatgaacaaacagaagaggaagcaggggacctgtgtgtccctctctctgcttttctgtctttctccgtgccccctctcttatgtctctcacgctgtctcttgtccttgtttttaactctgacacgccgtgggaactcggctcacttcctagggggaagctgtctggactggcccagagatgggcaccaccatttcccaataaacacaagataaaatcagagagctggcgtcagttccacggctggactcagtggggaaaagggcaaaaagcagcagaaataagagcagggaaagaacgggctgggtgcgatgggtcccatctgtaatcccagcgctttgggaggcctaggtgggaggatcgcttgagcccagaagttcaagaccagcctgggcaacatacggagacccccatctcttaaaaagttttaaaaattagctgggcatggtagtgtgcatctgtggtcccagctactcaggaggccgaggtgtgaggatcgcttgagcccaggaggtcgaggctgcagtgagctatgattgcatcactgcactccagcccgggcacagagcaagaccctgagaccttgtcagaaagaaataaagagagaaagagagaggagagggagagggagaaagaaagggagagagagagagagagaaagatgaaagaaagaaaaagaaagcaaaga

SEQ ID NO: 43636 - DNA, 1050 bp, Homo sapiens
cttttcagaacagctttgagccccaaccctggggctgagtgacccaagacagatcactcacactctctgggcctcagtttccccttacataaaaagcaatggttaggccaggtgcagatggctcacacctctaatcctagtgctttgggaggccgaggtgggaggattgcttgagaccaagagttcaagtccagcctgggcaacatagcaacaccccatctctacaaaatataaatacaaaaattaaggctgggcatggtggttaaggccaggcgtggtggctcacacttggaatcccagcattttgggaggcagaagcaggaggatcacctgaggtcaggagtttgagaccaacctggccaacatggtgaaaccccgtctctacacaaaatacaaaaattagccagccatggtggtgcatgcctgtaatccctgctactgtggaggttgaggcaggagaatcacttgaacccaggtgaaggaggtttcagtgagcccagatcatgccactgcactccagcctgggtgacagggaacaagactgtctcaaaacaaaacaaaagaaaaattagccagacatggtagtgtgaacctgcagtcccagctactatggaggctgaggtgggaggatcgcttgagcccaggagttggaggctgcagtgagctatgatggcacccctggacgccagcctctgtgacagagcaagaccctgtctctaaaatgaaacatttttaaaagggaaggtgaactgggtgaactctaagaccctgcatttcacaaacccttgcccacaccctgtatgcgtcgggccctggcaggaaacagagggtacgctgtctcacagggcaattgagagcgtttacaaaggtgtgggcagcattaggggaatggaccagagagggtgacctgggacttggctgtaatggggccctaagcactcctggatctgattgctgatgggagggagggagtgatgtttcctggatcagcaggcagtagccatgggtgaggggccccgcaggagcaggggctgtaggtgaaaggatgaa

SEQ ID NO: 43637 - DNA, 1070 bp, Homo sapiens
aggccaaggtgagcagatcatatgaggtcaggactttgagaccagcctggccaacatggtgaaaactcatctctactaaaaaaacaaaaattatgtgggttggtggtgtgcgcctgtaatcccagctacttgggaggctgaggcaggagaatcacttaaacctgggaggcagaggctgcaacgagccgaaattgcaccactgcactccaggctgactccgtctcaaaaaaaaaaaaaaaaaaaaaggcatttcagttcaaatagggaaaggatacatctttctttcttttctctttctttctttctttctttctttctttctctttctttctttctttctttctttctttctttttctttcctcccttccttccttcctttctctctctctctctttctctcgttctctctttctttttgagatggagtttcactctcgctgcccaggctggagtacaatggcgtgatctcggcttattattattctccatgttggtcaggctggtcttgaactcccaacctcaggtgatccgcctgcgttggcctcccaaagtgctggtgtgagccactgcacccggcttaggatgcatttttcaatattttagtgtttgaataacgggctaacttgagaaaaaaataatttgaatcacacatcacaccaaaaataaattctaggtggattttaacactttcaaaaattattattattattagtttagagacagggtctcactccgtcgctcaggctggagtggagtggtatgatcatggttcactgcaaccttaaactcctggcctcatatgatcctccagcctcagcctctcaaaggactggaactacaaacatgcaccaccacgcccagcctaggtgggtttttaaaatccattcaagggcgggtgcagtggctcacacctgtaatcccagcattttgggaagccaaggtgggaggatcacttgagcccaggagttcgagaccggcctgggcaacatagtgagactacatctctacaaaaaatttaaaaatgagccaggcatggtggtgcacacctgtagtctctgctattcagga

SEQ ID NO: 43638 - DNA, 1146 bp, Homo sapiens
aggattcagtgggagaactaaacagataaacagatccagtccccaccctcagagagttacagtttaatgggaaaaagacattcaccaaagaaggacacagcccactagtgagttacactcgagagggatcatttacagaacaaagcagactataaaaatacagcgattggctgggcgcagtggctcacgcctgtaatcccagcactttgggaggcagaggcgggcagatgacttgaggtcaggagttctcaaccagcctggccaaaatggtgaaaccccatctctactaaaaacacaaaaattagccaggcgtggtggtgggcacctgtaatcccagctagttgggaggctgaggcaggagaatgaatcgtttgaacccaggaggtggaggttgcagtgagctgagaccgcaccattgcactctagcctgggcaacaagagcaaaactccgtctcaaaataaatacatacatacatacatgcatacatacatacatacatacggggattaaaatagtctagtagtgacacctgaacagagagattgatccaagaaatgaaacagaaattccggaagttgacctgaatacacacacacacacacacacacacacacacacacacacgaaggcgtgaaagactccatgaccctcaaggtataagatgcattttttttttttttttgagacagggtctcactctgtcacccagactgggtgcagtggtgtactatcccagctcagctctaccctccatccccccaacctcccccaaccaccctgagctcaagcaattctcatgcctcaaccctcagcctcatgagtaactgggactacaggcgtgcaccaccatgcgcagctaattttttgtatttttagtagagatgggtctaaccatattgcccaggctggtctcgaactcctgagctcaagcgatcctcttgcttcagcctcccaaagtgctggcattacagctgtgagccaccgcacctggccgcattcttctaaatcacagtacatctggctcccagtgcccaggctctcagggcagaaggtccagtgtgatcactttgcatggcctctctcccctcctgagcttgtgccagggccccagggctgacctggagaaggaaaatggcagagggtga

SEQ ID NO: 43639 - DNA, 1047 bp, Homo sapiens
ctcactctgtcacccaggctggagtgcagtggctcgaccttagcttactgcaacctccacctcctgggttcaaagagttctcttgcctcagcctcccgagtagctgggattacagatgcacaccaccacgcccagctaatttttctatttttggtagagacggggtttggccatgttggccaggctggtctcgaactgctgacctcaggtgatccgcctgcctcggcctcccaaagtgctgggattacaggcgtattccactgtgcccagcctgagtttctgtttagaaacaacagtctatgatagtataatcctctcttttttgtacacagagtaaagaggacaaataggtgaaagaataaatgaaaggctggaatcccacttcccccgctgtcccagggcattggatattgacggataggaggcagcaaaccactcacagagccaggaagaaatgaaggcgttggtattgccaggaggggaagccggctcggctgaaatacgctatgaccatagcaaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcgggatggaggggtattcgaaggtcggatgcaaatccgagaagccagaggaagggttttgggtgatgctcccaggatggtgggctccgatgggatctttggagggggtgtgtctaggttggctggtgtcaggagggtcttttgtgtgccaggcagagaactgtcccgaagagctgagagtagaggggccaggagcttcagggctgcggccagactgtggcccagagctcagatcccaaaggacccataggagaggcaggggccactcattcactctgcaagagaccagcagaatcctgagggagatgctgacaaatcataaaaagaccaagaatagccgggagtggcggctcaagcctgtgatcccagtacttttt

SEQ ID NO: 43640 - DNA, 1115 bp, Homo sapiens
tagggagcttgtggctgcacactcatttcagagtctgggagagggagcagggactggttgtgaggattccccatgggaatcctcccaggaccctaagcaggagctgcaagtgctgttgagaacctgatgagaggtggggagcatgagggaagtttggcagaaacacaggaaagctaccaaatgcagacagccaggggacgcagggctgctagagcggtgccccagagccaggagagcaagcctggaaggagagccagaggcaggaggggcacaggcagcccagggtgtgggaagcagccaggaaagatctagagctggggtggcaggggaggggctgctgacatcaggaatgttggatggtgccttggaatctcctgggagacagggatcacaagaccctctgccaccttccagagggccacgatgaaaacagctaagatttactgacaactgattatgcaagaggccgtgggttaaatgcttcagtgatgcatcacctcatctaatttcctgtactaatgtaggaccacccattgctcaccaccacctgaagccctgtgctcaccaccacctgaaactctctcacctacgtgagacctcctggagtaggagggcaaaggcaggagggagggacgacgtgaagctgtgccaccaacagggagagtggtcccattagtatggcagggggtgacacagcacagtcccctgtggctcaagcctagtacctgtcgcgtactggaggaatggggataagcgacccgtacaaccacagcaccaaccctagagccaccggcccccaaaagcggccctgccgcccgggtgctggatgtgcctccacgccagcgctgacctcggcctagcacagggtccctccaggcatctgggctcgcgtgcgcattagtaagccagccattcctcccctagcagactggggagtggccagaccctaccgaatccccctgttcccacctgagatgccagccccccacacccccgccctgccctgggctcttaccttctgcggccgtccctggccgcttccctggcttgccccccgcctgggcttttcggacccgcggggtgggctcgggaggcggcggggcctccacgtcgtc

SEQ ID NO: 43641 - DNA, 1034 bp, Homo sapiens
aggcgggcagatcacaaggtcaagagattgagaccatcctggctaacacggtgaaaccctgtctctactaaaaatacaaaaaaaaaaaaattagctgggcgtggtggcacacgcctgtagtcccagctactcgggaggctgaggcaggagaatggcgtgaacccgggaggcggagcttgcagtgagctgagatcgcgccactgcactccagcctggatgacagcgagactccgcctcaaaacaaaaacaaaaacagaaacaacaataacagaaaaacacagacatttactctctggcagttctggaggccagaagttgaaatccagatgtcagcaggattggctccttctgaaggcccgaggggagggtccttcctggcctcctccctggtgttcctgggcttgtggccgcatcactccgctctgcccgtcttcacactccctcttgtctgtgtgtctgtctctctgttctcatgaggacacttggcatccagggcccaaccacacccagagtccctggtctcctgtggctgactcactttttactgtcaccgtgaagtccagggggtccttgtacttgatgttctctcctggcaaggccagggccctgtgattggcctctcatggagtgctgggcagggcctccatggcctctgtcgggcgggggggctacttcatctctgagtctgtacccctcgtgtcccaggcagtggagtgggagtgaagaagctgtgtgaactgcagcctgaggagaagtgctgtgtggtgggcactctgttcaaggccatgccgctgcagccctccatcctgcgggaggtcagcgaggaggtgaggcagggtgctacacagtggggccgccaggcagacctggcctcccactagaacacctccctggaggtggggttgtggggaagcaggttcagagacaatggactccagaggggtgggggctgcggtgccagctcactaacaccagagctttggtgggctctggccccaagattatacctcctgtctctgcattccagcacaacc

SEQ ID NO: 43642 - DNA, 1040 bp, Homo sapiens
tgtcgttctcctgcctagacccagtgggctgagtgggggcaagtgttggcttttatgtccagttttgatcttggtgccagcacattgcctgggtggaagcatgtcctactatcggttacagggatgtcattctgcccagtgctcaggggcatacacttggatcccagttgtgtgcccttggacacattgcttaacctctctgtgcatcagttgggtgataatatctactcctggcacattttcagcgttggctgagttacatgtacagtgcttaggccacctgggggagagtaagagtgggatacgtgaggatgtggagtctgttgcatttctgtctgctgctggcatccttcttgtcttgttttgagttgctcgcctctgtctgctccctagggcgtagatttgaggaatattcctggttcttcccaggcagcaggggctcaggctgtgctggagtcagctaggctaaggggctggtctggcatccgcgttgtcctgtcacctccttggtgttttctccaggcctggatctgtgctgtgtgggcacctgtattcctccctcctgccctcactgattctccatacctttcttctcgagagtgccaagcccctcccatgtgttcttgttcatacctaggatcccgggaaggggctggggaagacggtgcccaggtgccctgggtaaacaaagccacctgactccacgggaatggaatgggtggaggggatctgaggtctgcattttgagtatctctggtctcagaggatgaagcatttggtgggggttgggggtggggggtagggtggaagaatctaaagtcttaaaagaaaatggcagttatttgtgggacagggctgtgttgagacttggcatgcttctttttaagagtcagtgttgtaatttaggtataagtgaagcagtactttgtattagtttcctgtaggcgctgtaacaaagcaccacaaactggttgacttaaaacaacagacatggccgggcacggtggctcacgactgtaatcccagcactttgggaggcc

SEQ ID NO: 43643 - DNA, 1066 bp, Homo sapiens
cccaggcaggaggctccaggccaggagagaggtctggggcagcatttgtgccagagtggagggcagatgtcccatgccctggccgcccctccccgcagtacggtagggccccagtccgtcttcgtgggcaacaacaggacagactggctcaggccccaggcgcgcccctggaggtgcttggcacagttgcgcccggtccccatgtggccgacactctcagaccagggctctgcgtgtcccacctacggcaggcagtagggcttcctgaggtctggagcagggcctgcatctcaggagctgcatccttggccctcctggctgtcctccaccccacctccctcacgtggcccccagtgcttcctgctgagcagaccctccctcctctgctcccctctctgctctggccatcagctcccatcacattggcatcatcactctggggccagggaaggggctggctctctggggtggtgggagggatggggccagcagccaagccatttccaggacttccaaaacagcgccactacacccaacacggccctccagcccagctcccacctaggcctgggctccttacagagccccagagtgcctctgtggggaccccccacttccttctggccagtgccaccacccagcccatcatcagaagacatctttctccatggcagggaccagggggtccaaggggcacccatggtgctaggcaccagggcctgggcattcttcccatctggcagctggggatgggtgcccctgggacccgtgtgtgtctggggtgggtcatgctctctgcaggactcctaaacaaccttctgggctgtggtgaactctgagcctgcacctaaagacctgtagttctggtctagggcctccaagcagtgtccaggcagtgtccagaccagggggcggtcccccagggaccttgtaagatgtttcctctgaggagcagagcaggcctcctggggacctgggggatggtcttttgaagggcagcagccctggagcagggtgggagagtctggggccacctctgccctctaaggccacctgagaggtgagg

SEQ ID NO: 43644 - DNA, 1028 bp, Homo sapiens
ctctgtcctggagggtggtcagtgcatgtggacagagcccagcatggctgtcctgggtgaccagctaaggggacaaggcagaggcagggctgagaggaccacccatcctgctaggtcagcccagctcagccatatcacacggcagtgagcatggagctcagttctctgccaatggcagctgagtctagtaccatccagtcagagtctggtaccagcccatgtggcatagccccctcggcccgcagagagaccccgtctgtcgagtgtgcttcagtttggcctctgtggtctctcctgcattgatcaggtgtaagggcataggagacccagtgtccggccagctgcagggtggcagcagttgccccggcctggagacccgggaatgggcagtgccttcccaggatggagggcagagggtctctccttgtcccacagaggcctgcagaacccccaacccaggtgtctgagatgcctgtgactgctccgcctaccctgggctcctgcggcacctaacgcatgctttgaacttgagacacagaaaggaagttcccgtgcccttgaatgctagtgtagatgggcatcgacaggactctggccacggtgaatctggagttagtcccaggcagagatgtgaaatgagcagccccccaaaaaatggttggccgggagccatgcactcaggagggccgggcccatgcaccccacactgcgcccaaggcgtgcacaagcgattgttttaaaagcgggttcacaaggaaggatgtttgggaactgactgagacaacagggacgtctgctgcagggcttcccagagctctgatggcagcgtcggcctgagtccttcgaggagggctggtttgtacgtggcatttgctgcccactggactgtgaacttctgtctttttatttcccactgctgctgtggtacatctccagtagcatagtttggaaatgcaggttttgatagactcaaggatctaaatagaaccctcttagtaccaaggactgtccggggtctctgccagccc

SEQ ID NO: 43645 - DNA, 1038 bp, Homo sapiens
ggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctct

SEQ ID NO: 43646 - DNA, 1046 bp, Homo sapiens
gatctcctgacctcgtgatccgcccgcctcggcctcccaaagtgctgggattacaggcgtgagccaccgcgcccggccggcctccttattttgatggcttgttgccaagcccactgcccaggaccaggaatggggaggtctgttcattccaggtaagccgaggcaacttccaggcagttctggacctcaaacccctacctggatcctcactgtcagttcgggacaggccaacctcaaggggtgaaagatggcagcactacacattgtatgtatgcaccatgcacatacatgcttgcacacatgcagcatcatagggtgcaactggcatcccccttcatgccctgctgccctgctctgagggcaattcagtggggtcatcctgttggtgtcctcttggcaagctgtttttttggcccctagggcactgcatagcccaggcgtggaacagaaagtccctgtgcctgcaaacagcttcttgtgacctagcatgggggagcccgtagactgggcagcgacccagttaggaaggattcaaagaaccttgaagatgctgtggtccagtggaaagagctctgtgtgttgaatctaaatctattctgctgtagacttgccatggggcagcatcctgacccttgagaggatgtgtgtccctccccagagtaaagtgccctgggagatcttcagcgacatgcaggagcccagggctggtggcgcgggggtaggtcccagagtgaccctctccctgagattgacctgctcctcaacagccagggagcctccagctctcaggtgacagctatagacagtaatgaactgacctctcagggctatggtcgttcactgtgtgtgtccaggcacctgcctggtgctgatgctaaagtctcaactccttcctgggcatgacagtgtctggggcagggtctgcagcatatggaggcttgcaacacgcagaggtttcatgtaaaatgtccttagtgactgtagcctttttttagaaaatcaaatgaggaaacacctagaaggtaggtgtgtgccctcatgtggcc

SEQ ID NO: 43647 - DNA, 1048 bp, Homo sapiens
ttttgaaacaacttgggcatgtgaatataccctttcaattgtaaatattatgaaatctgaacacagatgaagtatttctgatgaaaaagtgcagtgctcatcttaatttttgttgggttcaagtgtacttctgtgtccaaagtacacttgtggacacagaagatttggggatgttcccctccttcctgttgggcaggtggctcattgtcttcaggtccatctcccactgtgcccaggagccctccactctgggtgtgtgtttggacctggccagtgaaaccctgtgttggggtctgtggagtgccaaaaggcctgagagcaccagcaccgtcccctggatggtatgtaggccgaccccctgcccacatggtgctgatggtgggctgtcagccccagtgtagctctgctttgcctcttcatgctgggcaatctggaaaaggcccttacttccaagggtttgtcctcatttttaaatacaaaaaatggtatgtatggtaaatggtaatggtatgtgttttacaggacttgtgaacgctaataaaataagttacatggatcacagtaataactactggtgaagataaaaaattcgtaaaggatctcttctttccagagatttacagttctgtgagttcctctgaagtcttccctggaatagagaaaacaatgcatttccctcttggaaggttttcattgcatcagcttggtaaagacgaggtagagtttgtagtgttggggtctctgagggtgagtcaggtccccgtcacacaaactgtaaagtcaacgacaaaccagcttagcagagtatctggaaatggaagattcatcccaaatttaaattgcacactggcagagcagcgtcatttactgggtagagctggcgtgtaggggagccacccactccccctgttcaccactccccctatctgcattcggaatgtcagacaagatttctgggatgctggcttcagatcatgattgcaggtttttgtcttgctcttcccagttctggaaaatctccactgtgtgctctcccgcaccacatcgg

SEQ ID NO: 43648 - DNA, 1051 bp, Homo sapiens
gtgtggtctgcctgtgccatgaagcacagtgtggctgagcgtcaagagtccccacactcaaaggaggcagcagatacagggctgcacactgtgtgattccacacatgtgacattctggacacggacatgctggatggcaaaacgagcatcgggctgagaggactgctgagaaggggaacggggctgctgggatgtgggttgattgtagcagtagctcatggagatgtgacctcaaaagagtgatttttactatgtgcatactatacctccacaaacttgactttaaaaaaataaaatattcacagaaaaaaacaaaaacaaatgtaaaaccatcagactactttatcagaggtgttatttttagatagaggtctttgaactccatcctaggaacattgtacccatgtcctcccagaactgcatcttgcactgggtgtcggaagacagccctgcaagacctgtatgctctgtaccattcagtggtttttaaggttaactaccagaagtcatatctgaggcctcccagaagcattactctaaggaaagtagttaaatgtggacagtgacagcagaaacatttacacattaaaccagtttatagaacatgagaatgttcagagcataaagaagcttgtcagctcaatgacttacgaggcgtgggccattaaaaaaaaaggtctggagtttgggaaggagaaaggaatggggatctgcagctcagagtgagagatggaattctgtaaaggaacagtgtggagagggactccaggcaagtcaataacgatgttagaatgcccttgtttagaataattatcatgctaataatattgttcatattgtttttactaatatgctcatccttaaaaatagaagatattctaagggtactaaataaataaataattaaaattttgcaactgagaccttcctcttccagagcctttacaagaacctttatagacaacacctcaggtcctgtttgctgccccagcatggagggcagcccacttggttacagtgatgacagatggaaacttgactggagcaggtc

SEQ ID NO: 43649 - DNA, 1050 bp, Homo sapiens
ctgtgaggctgcatgagatgagaaggatgcaaagggatggcgtccagagctgcgctgctgccaccaccctcagctccttggttagatattctgaccttctgacctcctggcagcccagtgcagacatggccttcgcttcccagctgccttccacataacctgctcctccctgtgccgtggatcccacatcagccagccagggcaggcaggggtggctgctaaaaccgtatgacagttcttgcctccctccctccctcccacacttcagaatgttaaatgagacttcttgactcaggcaagctcctttcttggttacgaagatgtaaaatcagccgtggcaacggcaccagctcttttttccgatagctcgttcagtccccaaagctaggcagttggcatgcgcaccatcctcctttcttcctgcagtcgggggagctgacaggctgtcctccatgctgccgtgggtggctgctctgctgcgggggctcttggacatggctatgcttgagatggtcgttgtagctgtatgtgaggtgaatgccgttccatatacacttcttcatgtattgacgtggtgcgcacacaagtcatttaaaatcagtgaaattgctctggagtattctttgaggagttagaccttgaagctcaggctttaaaactcatcgtaatatatttgtttatgatttttgaaccctgtgagtgtttttgtgcaagctgtatccacctcctcccctcaatttagattatttctcaagagtggaattctagtgtaactgcagcctctgagctgttgctgtggttctccctggtggatgagttgtttctggagtgtcgccgatgacattagccctatatccccacatccccaccaacagtgggcttttcatcttcacttatctttgctaatttacccagatacttccagtgtcacttcttagaacaattgtgaggataaaatgaagatgggtggtttattgtctacttgtcctcattggcgagccactttcctgagtccccacaactttcctggctcattgaggccatcccatg

SEQ ID NO: 43650 - DNA, 1047 bp, Homo sapiens
gagctcactctggctacacagaggtggggccaacctgggcacagacaacatgctccttggtgctgccgtggcctcaactgctcactctcctagtgagtgtttcatcctaagcagggcctcctatttaggccctacgtgaggccctatgtgtgatgtgtagagtttccagcaatggggcttggactggcccatcccagttctgactctcctggccacccagggcctacctctgctgatggccagtggtagatggcagtggttctttttctaaatctcaccctgtgtgctcccctgcccatggcattcagcagccaaagaccagagaagtgctcttctcctgcctgcaaatactgtgaagatcaccccatcacccagcagttcagttcctcatcctttgaccccagacatataaagcctgtgcattatgacacagcctggagccttttcccaagctataggctcctgtgactactaccagttcctttcctttatgtcatacttgactttgcagatgccattacggcctctccctcacttgagcttcacgtggttgtggaggtatgagagcatgagtgatgcactagtagtactggggccggctagcttgccctctgaaggtgcagccctggccgcctgtattacactagtgagcccgtgatcctggggttgccatctccatggactgagaggtcgtgatagccctgccttaaaacactggccttgactctcctgccttccgttgggtgaactcagtgcagatcatggagcaggtcacgatgctctcaagttggttccctctgagcgaggagctcttggtgagcaaccccgtgtgtggtccggttgcactttttagatacttcatgcagaagcccaaagccttagtcactggtctctgagcccatagccaccgtatttggaatcttttgggattacaatcagggtaccaatgattccttttactttacactatttgcataaatatgtgattattaatacatagctcaactcttaagggttttgttgacggaagtaactctaacttcttcg

SEQ ID NO: 43651 - DNA, 1034 bp, Homo sapiens
tgtttttgttctgttccttcattattgacttggcttttttgacagtttgattatgacatctaggtgaggctggctcccttttagtttattttacttggaattcattgagcttcttgggtgtaatttttttcatgtcaaatttggaaagtttttagccattattctttcaaatattctttcttcttttctcttctgtatgttggtatgcttaatagtgtccctcaggttctgtgactctgtttatttttcttcactgttttttcctcctgtttcgcagtttgggtaatctcaattgacctgtcttcaagtttgcttgttctttcttctaaatgctaaaaagtggttttgagcccctttcatgaacgcttatcttttcccccttttacttttgaactccagaatttgtatttgattcttaaaaaaatggtaataataatttctatctcgttatcagtatcaatagtgatactgatatttattgatattctctacttaaaagacgttattcccatactttcctttagtaatttttgcatagttttcttagctctttgagcatatttaaaataggtgatttagagactgttttctgctaagttcttcatatgtgggcttcctcagggacagattttattgattgctttctttttcctatgtatgggccatactttgttgtttctttgtctaatttttttttttttgctgttattgagaaatggatttttaaataacacaatggggtgactcaggaaatcagatgctcctttcttcccatggttgctattggtacgtgatatagttgttcttgtttaatgacttttctgaactaattctgtaaagtttgtattctttattgtgtctgaccagtgaaatctgtacttggtgaacttagtggccaagtaattattagatggcgatttccttaaactcctgggatcagtaaacacctgtttttgtcgaggggcttcatctacctgttggagcataccttcattgcttggcctaacagttaaaaactgccttagcctttattt

SEQ ID NO: 43652 - DNA, 1056 bp, Homo sapiens
catgcccagctaatttttgtatttttagtagagacccctgtcttcaccatattggccagactggtctcgaactcctgacctcgtgatccacccaccttggcctcccaaagctctgggattacaggtgtgagccaccactcctggcccatctgtgtcttttaattggggcatttagcccatttatatttaaggttaatattgttatgtgcgaatttgattctgtcatcatgatgctagctggttattttgcacattagttgatgcagtttcttcatagtgttgttggtctttatattttggtatgtttttgcagtggctggtaccggtttttcctttccatatttagtgcctccttcaggagctcttgtaaggcaggcctggtggtgacagaatctcttagcatttgcttgtctgtaaaggattttatttcaccttcacttatgaagcttagtttggctggatatgaaattctgtgtttaaaattcttttctttaagaatattgaatattggccttcactgtcttctggcttgtagagtttctgcagagagatctgctgttagtctgtgggcttccctttgtagataacctgacctttctctctggctgcccttaacattttttccttcgtttcaaccttggagaatctgacgattatgtgtcttggggttgctcttctcaaggagtatcttcgtggtgttctctatatttcctgaatttgcatgttggcctgtcttgctaggttggggaagttctcctggataatatcatgaagtgtgttttccaacttggttccattctcctgtcactttcagggacactcagtcaatcgtaggtttggtcttttcacagagtcccatatttcttagaggctttgttcgttccttttcattcttttttctctaatcttgtcttcacaccttatttcagtaagttgatcttcaatctcagatattctttcttctgcttgattgatttggctgttgatacttgtgtatgcttcacgaagttctcatcctgtgtttttcagctccatcaggtcatttgtgttcttctc

SEQ ID NO: 43653 - DNA, 1043 bp, Homo sapiens
tcattgatttttttctaagagtttttcatgtctctatctccttcagttctgctctgatcttagttatttcttatcttctgctagcttttgaatttgtttgctcttgcttgtctagttcttttaattgcaatgttagggtgtcaattttagatctttcccactttctgatgtgggcatttagtgctataaatttccctgttaacaccgttttagctgtgtcccagagattctggtatgttgtctctttgttctcattggtttcagagaacttcgttatttctgccttaatttcattatttacccagtagtcattcaggagcaagttgttcagttttcatgtagttgtgcggttttgagtgagtttcttaatcctgagttctaatttgattgccctgtggtctgagagactgtttgttatgatttccgttcttttgcatttgctgaggagtgttttacttccaattgtgtggtcgattttagaataagtgctatgtggtgctgagaagaatgtatattctgtggattaggtcagcttggtccagagctgagttcaagtcctgaatatccttgttaattttctgtctcgttgatctaatattgacagtggggtgttaaagtctcccactattattgtttgggagtcttaagtctctttgtaggtctctaagaacttgttttatgaatctgggtgctcctgtattgggtgcatatatatttaggatagttagctcttctagtttcattgatccctttaccattatgtaatgcccttctttgtcttttttgatctttgttggtttaaagtctgttttatcagagattagaattgcaacccctgctttttttttttttttttgctttccatttgcttggtaaatattcctctatccctttattttgagcttatgtgtgtctttgcacatgagatgggtctcctgaatacagcacactgatggattttgactctttatgcaatttgccagtctgtgtgtggttttttttttttttttttagacggagtcttgctctgttgcccatgctgg

SEQ ID NO: 43654 - DNA, 1084 bp, Homo sapiens
tccctgtgcctctgttactgcttagcggcgtgatgggtaggtctgtagtttgtgcactgataccaaccattctcctttccccaggtttcttttatgcctcctcagggaacaggtgtcaggctgtgggcctttgttcccctcagcaacaaacacaaaatttatttttcttcagctacaaacacccggtcacccccctttaaactacatcaggtcatgggtgagacccattgaagccccatccagtcctgagaggcaaagcaaagaacccaggtcacagcgatgaagtggacggccaggcctgtgtgctgtggggctcttccatggagcagggagccatgtcctataagtaccgcatgctaaccgattgcgccactggagccacaccatgtcatgatgtacctgtaacattcgcaacttgagtttcaaacactaaagtttctgaaacctccatctaatgagtttaagtgagtagacgtttaatcttttttaattttttgatagagatgacctcattctgtcactcaggctggagtgcaatggcatgatcgcagctcactgtagccttgaactcctgggttcaagctattctcccaccttagcctcctgagtaactgggacttcaggtgcttgctatcatgcctggttaagtttaaaaaaaattttttgtagagatagggtcctgctgtttcccaggctggtcttgaactcctggcctcaaatgatcttcccacttcagccttctgagtagctgggattgcaggtgtgagccattgttcccagtggaagtttaatcttttagtgggagagagatgtctactcaaggaattgtgataagaataacattatcataggttgttgtaaatagataatttccactttaaaaaatctcaagtaacaatgcaaaatgggacattacataatttaaatccataatataaaaaaatttgatatatgccagaaactgtatccatgtttccttcttcatgagaacctgcaacctgtgaagtaagtaatttcattctattttgttgtaaatttctttttttaaatttttattttactttaagttctgggatacatgtgc

SEQ ID NO: 43655 - DNA, 1011 bp, Homo sapiens
tgatgacttttcaagttgagctgttctctgatcaccaaaggtgacccctggagatttcgttttatgaactcatggatttttcatatgctacgtgcttcagtccattgtggactttatttatttatttctgattgtcccgtctttggccagcagggagccttctgaaattggctcatgtgtcctttcagcatgaccctcctggtctttgacagttccccacttgtaaggaagacggctaggcttaccgtgtgtgttctggtcccaggttggggactagctacatctccaggaactctggctctcctcttggtgagttagcattgtctttaaagtaggcaggctactgtcattgcaagaccaaagtgtggtagatgctaaacagataacaatcaggtattgataaaattattgatactagatttttagaaaaatctaaaaaaagtgtagaattattaggcaataaagaagtgtagaattactaggcaaaagacataacttctctctccaaatgtctcagagggttcaagaatcatcccatagtcataaaagctgctcagtgagttctttccatagccaaagactttctaaagggaaagcagtgagtgagaaagcaatactgagtgtcacgagaccttgttttagtcattttaaatggtttgttcctcacagctaccttttgggagagatgctattagtgttcccattttataggtcaggagaccaaggcacagagaggctgagtgacctagtcaccgttacctggttgctgtgcggggaagctgggcttgacctcaggttggacaccacggacacacagagcattcagggaaactgcttgactgctaggggactggcttggagacattgatttgtaggacatacttgagaccagagcccgtggcctggggtggctgcttgctgcattggcatcaaaccttttgtgtgtctggctgaggtggcagggtatccacagttggcctgatattgcggggcgggggggtcacatccctg

SEQ ID NO: 43656 - DNA, 1046 bp, Homo sapiens
taccaagtgtggtgggtgcaggcggcggcctgacaggtgcattacagcctgaagaactggggtgaggccagaatttggctcagccacttagggtatgtgactatagaccattcctttagcctctgggagcctccatttcccagagatgacaatttccaagggtgtggtcaattctgtgtgcaatcctgtgtggccagacagaggtgccccttgctgatggcctgtccctttttcttattcccttctaattgatgtcatatgtctcttgtcttcatgtgaacttgatatcacctaagatccatggctttgaggaaggctaatgcaaggatggtgtttcagttcatttgggctgctgtaacagaatacttgagagcaggtgtttatacaaaattttattttcctacagttctggaggctggaaaatccaagatcaaggctctggcaggttcagttgtcaagtgagggctctctgcttctaagatgggcctgatgctgtgtcctttggaggggtggaatgctgtgtcctcacgtggtgacagggacagaaggggaagagagctggatgctgcgtgaagcctgtttaataaatgccttaatctagtcataggggaggagccctcataacctaatcacttcttaataccgtcacattggccattaagtttccacacctgaattttggaggagacacattcaaaccatagtagatgggaaacatacggaaactttctacagaagaccttcgttacagtgtttgttggcctggggcaggctactcaggctcgtcacttaaagaattatttttattgtcttcctctggagacttttggttttgtcaggtgaacgttgtggctgtcaaacttgcacggaccatcccatgctgagatgggacttcaataagtgcgttaacagataggtatcaggtcttcttctcctaccaggcctgcccctagggaatgaaatggcctcatggcgaagcatctcttggttaaggctcttctaaggcaagaactaattgcttttccttggcagcccaagtaaatgtt

SEQ ID NO: 43657 - DNA, 1034 bp, Homo sapiens
tcctatccttttcatcttaatttcattcatatcttcatattacgtttttgagatagctgtttatttttttgagggggaaatagtgacataaataggtttagaacctcaggtggcttaaaaccccagatgtagtcagtggtaaattttttttttcttggttagtctagttttggtgttggtaagtattatatatgctggtgggtttttaaaaagggcacgtggtagagtctggcatactatttggagtcttgtggtagctgcccacttcctgctaatgcagtagagcatgttcataatggccttatatgctttccttcctagggcaggccgtacttagtcataccaggtaagaaatatgttttaaaattttagttaaacagttatgatgatagcttatagtttactttgcatttctttatttatagaaagattacattttctacacagtgatttactgttgttatttcctactttgttaactcattaactccacttactcattgatgggagtctggatattatccttctgtagttttacaaatcctcacattttcttattcactgcttttcttctatcagttgattcactgaatttagtgtggggattttaccacatcgatactgccttcagtgattttctttatgttagattttagaaatttctctctgctttaatgttgtaggctaaatataccattccattgtctactaaagggctcaagactgttctttaatattgtttgatttctttaaaatgaattccactgtgacttgatcaagttttgtattataccacttggggactttaattgatattatgttaaaactccatattaacttgaagagtatgatcagttttgttctcgttaaattttcctgttaaaaggaagcatatcattctattgttggtggcttccttttttctgtcattaaattcagttacagaaagttgccctcaagaattatatacaaatctcatgtgtcctcagatccattagtagccatacagttaatgtttgtgttgcttttagcaa

SEQ ID NO: 43658 - DNA, 1029 bp, Homo sapiens
attcctggaaaattcatgatataataaaagcatgcaaaaaattatttgggtttttatctaaaattgagttaggttacaggctcagaagaatgttaaacagcttctgtctacctgcatgtctaatgggatgtgtgaaggtaatgcagggcaggggacagtgcccattgactgccccaaggacacctaacgctgcccacacactcccaaactcccaggaggcagggcctaccctccctttgagagctgctgatcaagtaggagttttctgttttcattcatatttgaaaagttggaataatctgctttatgatgtctttattccctgaaaagttaagctaataatattggtcagtgttttcctatttaggaacattttctgaacatgtggtcattaggggattttagagtataagttatgtatctgttaattttttctgggtaattatgtggttgagatgctagtggcacacattatggttacatttgttcagtaactgtaactcgagccctggaaattaggcttctataaaatttcatagcaattcatgaaatgttgtttgtaagcaaaatgtacccagctccttgactaaagttaccttaaatattcttaaagatagagaggtaatacgcatttctttttctctttctgtatgtgtgtatatatgagagagagagagagagtgtgtgtgtacatgtccctgataattcctatctcagagcagtggaagtcctctgagtttgataatatgctttgcatgtgctatatttgtggactgcctcagaacatctcttggggagactacctgggttcagggaccacctgcctatgcacctgaatcatgtgagccctgattttatttaccacggagccaggcacttgaacactgtcccatcccaactgtgtccatcccaactgtggacagcttttacacggtccacctccttgccttccaggaccccttcctcccttctccttggcttctgtggccctgcacccatgaaggccagcacaggcaccaccttctctag

SEQ ID NO: 43659 - DNA, 1032 bp, Homo sapiens
aacatatctcatgaatgccactcttcagtaacatttagtttttctcatattttcacatttgtgtatgttctctgtcttcttagggcaactcagagttgtactttgaacttggtagtagtttgaactcttgttttggtttggtcaaagtaaagataaataaaaatagttaaaagttaaacttgctagtagagtcctgaggccacttctctgtcttccagacattgtgctgagccgtcaggctgtcagctgccccttctggttttgttgtttgtgctcttgcccttctttcccttccctcatgggttgcttcccttgcagcccctgagttacagatgcccaggactatgcagagcccggtccacgcaggccttgtgctctctgagccacgctgtgaggtagttggagtgacctgagtttttgtatctcctttaattaagccaaggaatttgctgtggaagcagcatctgagtgagaggctaacattggggggaccttaaaccgagcctgggcgtgtaggcagctctgtcctataggatttgctttgagaccctctggaataagtcatctcaaatgacttggctgtgagttctgtgagctgagaaatcagatttggagcctgttatctggtctttaaaatagcagctgtgggattctgaagagtgagggtcagatctgtggtctggctgctggctgctgtggtatggagtcagtgttcttagctaaccaaagactagcatattctctctctcatataactgttaatgtctgtttattttttggtcttttaaaaaaatctttgaattttagataattcatatctaccaaaaaaaattgcagaagtcatgcgaagaattctcacatatgctcttcacccagcttcaccaaatgttagagtcttttataatgagggattaccattagctcatctgtagaccttgtttaaattctgcctgttgaatcatgtcctttatccttggctcagggttcaatttgttattgtcattgtattcgtggttgtgtctctcttcagtc

SEQ ID NO: 43660 - DNA, 1034 bp, Homo sapiens
ttagggtttgcctcttggatgacctcacggtagggtttggtgttggtttcctgggcatgggccgtcagtgtcaactttcatagcacctgcagttcaggctcttgacctgcaggtgttgctgtagacagtgggatggtgactttgcctttgcttgtgctgggatgctgacaaaaatctctgaaaggctgtgtcagtcctgggcttttccttttaaaaatcacgagcagaattctttaacagagaagaaggaaaatatggtagcactaagaatgtcagttactgcctagaaactgttgtctttgtcctttgtgcttggactggttatctttttgtcctttggatgaggaacagagtgctccaacactgttggtgtgcattgggcagtgacagggccctgggtccaactaggccattcctcctgccctgggcagggaagcagagtagtgacagtgtacaaagagggtgtcatggaacaatctaacatattaaccccttctaggacaagcccgttagaacataatacctgagaaaactgttcagtactttctcttgctttgggtagtgtggcctttgtgcgcagttacagggacctcggtgcttcttgggaagggaatggcatcatttggaagataaatttcaggtttcctaatagtgtccttggcagatacttcatcatcatcatcaggctgctccctcctgacttggtctccgtaggtatgggcactcttcacttttctcatcagcaaagtcttttccagtagttcatccctccgctttccccagcaggtaaccatgcctccttggagtttgcacttcattttacgttattcctttatggctggctgtgcccacattttcagtgattaggggcagagacttactcagcctttctcacttcctggtgctgtgtgagatgacccccccagtgcatgccgaattccatttcttagtacctcttctttggttttgcttactgttttcgctcagtctgttataacaaaaatactgtagcctgggtggcttataaacaacag

SEQ ID NO: 43661 - DNA, 1047 bp, Homo sapiens
aacacattaattcttgatctcagtatttatttagctcttcatgtttgtaaactgctgcattacagtctttcagttatgtaggatgggaggtcagttggcttaaggtcagttccctcatttggtaaggtcagtagtcatacaaccatttgagatccagagccaaaattagagcacttgactcctctcacaaagacctaactttatctgtgtttagaggcttagcctcagcagctcgattgtttgtgtttttctctctgcaggagcactgctaggatttgctcatgatgcctgaggtataatggacacctgaaatgacagtctgttttaggtgactggattcacatcctcgctatgccgcttcctgaatgtattaccttgaacaagcagtataacctttctgtgtctcagttttcttctctataaaatgtaggtgataataatagtacctgtctcatagagctgttgtgaattttaaatgagccgatagtcaagcagctaatgagcagtagagcttgaatatgacatgaggtttccctgaatcaagcctcttgctttatgtacttgtactcactttttaggagttatgttttgtgggtgctctaaacttagttatacagtccttccttacagtctgagtgagaggagctgatcccttcttgtgtgggagttgtagtagtgtctgcaagacagccacgagcctcctggcctgctttgtttttttggaaaattcactctcttccctccttgataggatgggtcacctgtgtgcccccaaatccctgccaccttgagttctcttctgtttttctcactcctttactctctttctgacgtgttttgggggagattgtgtgtgtgcgtgcacactttttaatagagaccggatcttactctgttggccaggctggagtgcagtggtgtgatcatagcgcaatatatgaattgaactcttgggctccagcaatcctctcgcctcagcctcctgagtagctgggaccataggcatgcaccaccacatctggttaattttgtaattttttgtagaga

SEQ ID NO: 43662 - DNA, 1035 bp, Homo sapiens
aactaccaaagacttgagctggcggggatgacggaggcattgtgttgatcaatgggtgtggtcgcttgtttgaaatgtgacttcccaggtcaaagactgtcaatgtagtgcttattaaaatttctatttgagcttaattccgtaccctccaggttaagtttattgtatgttggaaacgctgtcaatactcattcagtgaagttgactgggcacttttgaatgtagtggtaagcaaccttttgctgaatgtagtttacactcttagttgccgcaggtgagggtgatacgggtgtttaagtaatggtttctctctccttgtgacacagttaaagagagaaaacccagaaagtaatagaaaactttttaagggcaattatttgatggagcccattgtaaagaaaggaaatagaaatgatggttgagaagtgaagtttttataagagaggtgggacttctgatgagattaaaagaaactattcagccaagtattaagcctatttgtagaaacccaagaagatagaaatgctgatgatacctccctcagttctctagatgttacagtttataaaatgcttcagatgtttcctcctgaagtcttaatgcatgctgcaggttggtaagatgttactttcctcagcagaagccaaagctttgaatgtcttggtagctaccagggtaatagggccaaacgaggaatggggttccattaggattcaatttcagaacttaaggctattcctcgtccttgtcagtggcataagtgccatcttagtgatgagagagctgttggaggtggcctttagcaggatcttatggcaggttaatgaagtcttgccatttgatcttcagtgtctctgtgaaacagataagtttcaagtttacgtaccaattcagcaaggttaagtgatttgaccaagaacacacagccagttcaccgtagagctgaaactaaaaatttcattttgtggattccaaatcttcctgttctgttgtttaaccattccatagtaggatgagaacacttttgtctagatt

SEQ ID NO: 43663 - DNA, 1058 bp, Homo sapiens
gggttttaggttacaaaactggaggagagttagggtgccaggaatccttaaatgcatctctgccctgcactaaaatgttgatgctttggttggtgagtaagtggccatacatctctgtgttcttttcctttctgaccacaggcctgttttctcccccaggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtctgccacagccaacatcttggttgaaataagttgaagatagagatggaaaggggacccagttaatgttctgtttcttaagcacttagtaggggccaggttctagatgtgactgatactgacttctcccaactccaaaatacctatcatggccgggcaccatggcttatgcctgctgtaatctcagcactttgggaggccgaggtgggcggatcgcctgaggtcgggagttcaagaccagcctggccagcatggtgaaaccccgtctctactaaaaatacaaaaattagctggacatggtggcaggcacctgtaatcccagctactcaggaagctgagataggagaattgcttgagcccgggaggtggaggttgcagtgagccaagatcgtgccattgcactccagcctgggcaacaggagtgaaactctgtctcaaaaaaacaaaaccctataattatttccagctgaggaaactgaggcacaatgattaagtagggaaagagattaagaagaggaaaaaggaaagggtgatggttactgtgatactagggatggcagaggggccttgagcttgctctgctgagctgattctctgtccgctcttggctgcaggtgccacatcatctcacagttcaaccaaggcttctacgac

SEQ ID NO: 43664 - DNA, 1012 bp, Homo sapiens
tatggtaggtagaataatggcctaccactctgaaacatatgaatatgttacctaacatgacagaagagaattaagttgctaatcagatgactgtaaaataaattatcctggatcatctggatgggcctaatgtaatcacaaaggttgtttccttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttaaaacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgc

SEQ ID NO: 43665 - DNA, 1031 bp, Homo sapiens
catggtagtgtgtgcctgtaatcccagctattcaggaagctaaggcaggagaatcgcttgaacccgggaggaggttgcagtgagcagaaatcgagccactgcactccagcctggggggcagagggagactctgtctcagaaaaaaaaaaaaaaatgcaatttagttctctaggcttttccatttaatagttttatatcctcctgtttctaaatctggatgacagtgtaacactccagtaaggtgaattgtgaattgctgaaattcttcagatgtttaaaagagttttcagtattcctcatgttagaattaatgcagagaaaaattttatcctttgaactagttacatgttgtggacttctggcctgaggctcttggggattatgtgacatattgggaagggacacatttctgctctgtggctgttactagaaatctagccagcaaatcagactacgtttgtgagaagacaggaaggcacagattagggttgagccagccttcaacaggtttggctggcagtagacacagtggagcacatcttaactattttggtaggtcctgggtttctcttggtagtttttgatagaaaggggaatggtgtgaggaaaaagtgggcatacatttcacctttccactgataaggcaggtggaattgggatagtcagtggatgggccaatagctggtggctgtgagaagaataaggatttccatactggtgtgtcatatttacagataggttgtgacctaaaaagttttttaaaaaacagcagttagggcctgggcgcggtggctcacgcctgtaatcccagcactttgggaggccgaggcgggcggatcacaaggtcaggagatcgagaccatcctggctaacaacggtgaaaccctgtctctactaaaaatacaaaaaattagccgggcgtggtggcaggtgcctgtagtcccagctactcgggaggctgaggcaagagaatggcgtgaactcgggaggtggagcttgcagtgagctgagatcatgccactgcactccag

SEQ ID NO: 43666 - DNA, 1574 bp, Homo sapiens
ccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctaaatcttagaactatttttggataaattatatattttccttcctagtagaagtgttactgcctgtaactagctcaaaataccaatgcagtttctgcattctgggttttgtttttccttttttttttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaatagctgtgtttgagatgaaataagaggttgtgggtagaggggaggcacctaaaggaaaagaggaaaggtgcctgggctacctatgcagataacctggagtggacttcactgtggactcgtggtactaaggcttggcctggacaggcagtctagggggtatgggaatacacggtgtggttgttcaactatttgcaaaggtcaaccaaatagaccacatgttcgcaaagtatcatctgaggaaattaagtaccttcttagccctctcagtcataaatttgaacaaattttaatacacttccctcatgcccttctatataaaacttaataccattagttccccattcttgacattttatttcagtttttattatatatttatttgaaatatttattaaattatctgacctacagaactaaattcttctccttttgttatttcttatgtcctataccatatatgtacctatttatatatatatttatgtatttttaaaatttttatttattttattttttgagacagtcttgctctgtcgc

SEQ ID NO: 43667 - DNA, 1050 bp, Homo sapiens
ttggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttgctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattagccgggtgtggtggcacgcgcctgtagtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccac

SEQ ID NO: 43668 - DNA, 1058 bp, Homo sapiens
cttgtctcaaaaaaaaaaaaaaaaaaaaaagacttttctaaatgttcacatctggcatcttggctaaggggtaatatctcctgtccttacctttatttctatatagaagtgggtttttgctcaagtttgtgtctctgttgcagagaatgaatataaatgaagttaaatgaattagagctttataaaagcattatagaaatacaagaaagaaaaatatattatcagtttatgtattgtgtgtgcattttgtatgtacaaatgctaagtgatccttcatttgggatcctaggtccttcatttgatatgctaatcatggatgctttgtaggtgctggagctggcaggtaatgcttctaaggatctcaaagtaaagcgtatcactccgcgtcacttgcagcttgcaatccgtggtgatgaagagttggattctcttatcaaggctaccatagctgggggtggtatgtattactacttaagccttgattcttattggtctttctgactaatatatcgttcagatcaatgatatagtatatttgatcggttaactagaaagcatataaactttaatttcataaatactaaatctataacaattctaagcttttcataatgatctgaataaatatttcaccttctagccatatgtaatgctatttttattttagccagttctttgtctaaatttcatatgatacttaaagcctgatgtttaacatatttcccatacttttttaactgtgtttgaaaaatgagttggagaagttgcataacatacactggaaagggttgaaataaatacacttgaaaagtgggtcaggatcaatgaaagtgagaggtaagttggtggttcttaatcttctttggataaccctcaaagaacctcgtgaaagctgtggttacagctgggcacggtggctcacacctgtaatctcagcactttgggaggctgagaggccccggatcacccgaggtcaggagttcaagaccagcctggccaacgtggtgaaaccccatctctactaaaaatacaaaaattagctgggcgtggtggtgcac

SEQ ID NO: 43669 - DNA, 1045 bp, Homo sapiens
gggtccccgggtgagagctgggcctggccgggtagagcgcgaagtctgttccgagccggatagatctgtcccgacgcttgtgacgctgcaccgcccgtcttagaaggaggaggacggcagaatccggcttggaaatgtagaaacaagtgctggatcttaatgtgatcgcttctctgtatgaatgaggtcaaacaggctgccgctgtacaagttagataagtctttggcgatgtttggttacgtaatctccctggcagtcagtttgagggtttctgcgaaagggtgcttgtatttgtggtcttttgagcgacaaagaatggttttatagaccagaaccacacgatttgttctaggtgattgcacaggttagaaatgaacgcccgttatcttctgagccccttgcagtttgcggttttcattatacaacagtactttcctttgcccttgctatggattttcagtcttaaagtattcatcttttcattctgaaattcagatctagataagaagagtgtggctttaaaaaaatgaaagtgaatagaacttcagccccattttaaagttgaggggaaaagagaaggtgctaaaggatacgctctgagttgcatcaaagattgtgtaaaaataataagactgttatggaatcttatttttgccggtattcgtgctttaagcattctgttgaaaggttacttcaacgggagctacctgcttaaaagttagcaccaagctgtcatttatcatactgcagatagtattagatgatttgtcttgtgcttgatgtgacagatatggtattgaatagacataacacctaactgtaaacagattggccagtcgagaggacaatgtttggttattgtaaaatacccaaatcttagagctggaatagactttagggataattgcttccaacgtctaacgtatagtttattgttattgtaaaaaacccaaatcttagagctggaatagactttagggataattgcttccaacgtctcacgtatagtttattgttattgtaaagtactttatagtactttat

SEQ ID NO: 43670 - DNA, 1688 bp, Homo sapiens
actctgccttcctggaactaggcctgcgttttctctgaaccattatttcatggggaaaatgaaatctacttcatgtgcctggtctacttactccttcagaagtgatttctgagccgtaagatacatgagaaaaaaatgaaggggaaaaggcagtatttatattaactacatgatgataaggatgtttctggtcacagtgaaaagccatgctagaattgtagtgtcatagaataatgtggaagtttagttcgtgttgtctgatctatttaataatttaataaggttatctcttccaagacaccttcccttcttcctcagccagaaaggatctttccctgagagtcattagtagctctgggctcctggaaccaagctcaggtgcctaattgaactctggtctcttcccacagcccccagcagggactggtgcttagtgagagtggactgccagattccttgagtgtgggggatttgggtgaatgagggtagcaagcctccagcgtgcttgggtctgcggtgaccctatgcattccttcagtgcttgctagaacagttttgaaacggtttgaggccttgccctgctccatccagagcaaggttatagaaatttcagacaatgacttcctccctcctggatctagtgtcctgggccttgtatagatccgtgccatctaatgtggtagccacttggcacacatgattaaattaaatttggagttttatttcattttcacactagccacatttcagatgatcagtagccacaggtggccagtggctaccatattggaccgcacagattagagggcatttctgtcgctgtggaagttgttttggacaatgctggtgtgaaaggtgaagggaatcctgagtgtttgctgtgctccaggctcagtacaaattttattttattatacacttaaagcaaaagtcttataaaagttgaggatgaagccaagagtggtggtaagggtaggagttgaaacagtgaagaggaataacagggaagagtcctgccctgagagactcatggaataggatatttacaaggcaaagcaaagagaaccaaagtctcagttctgcagaggagctgagtgccccaggagctagtggagggtgaggtcaatgtgtgctcatcttaaaggaaaaactcatggaagaggaaggtgctaatgttgaacacctattttgcgccagacctcttaattgttttaaatctttgaggtatcatcatgaggtcgtttttaagttcagtacagatgaggggcccaaggtcagaattatgtgtccagggttgcccagccacaaaccagcagatcagggtttgatgccaggcctctctaaccctgcatcctgagtggaatatagaagccggtgggaagtttggatgggaaggagatggatgccttcaagttcttgtcttggtgttaggtgtgttaaaggactggctgggatgagaagagtgttgctggcttgagcatagcacgagcagcacagctcctgtgttcctctgggtggtggggtcacctctcttaaaggtagaggctttcagctgattctgtcttttcaggccaggaatagttgctgaacaccccaggcctgctgaggtccctccttgagtctcatgttcaagcagtcttgtgagtaaagcactggctaccccttttcacttactatcttttcaagca

SEQ ID NO: 43671 - DNA, 1026 bp, Homo sapiens
actcctgcttattgcagcagttgcattcctaagaaactttcacgttgccagaaactgcgagattggtttgttagagaacagtttaggggttggagcttctctgactcaaaaacaaattattttcctggagaaaagccagtgtgttttgttttgttgtttgagacagagtctcactctgtcacccaggctggagtgcagtggcacaatctcagctcactgcagcctccaccttccaggttcaagtgatcttcccacctcagcctcccaagtaggtgggactacaggcatgtgccaccacacctggctaatttttgtaattttaataggcacagggtttcaccacgttcaccaggctagtctcgaactcctgacctcaggtgatctgcctggcccaagtttttaatacctaaaacttttaatgtcgttgcaagtaaaagtcacgaatgataacaaaactgatcttagcaagcgtaagtgccaccttctctgccatcaggtgacatccatcaggctcaactttttctctgacctcttgtattgatttgacagctttacttgcagctgaagtctacgtgcccactacccagagctgtagccaggaccatgtaaaagagtgtggtctctctttaatcaactacattaggtcaaaacttcattggggaaacttggagaatttcccttgccactctagagttcttgcttgcaagcaattgcaaatgacctcagccaccttgagcagaaatgtgctatttattgtagcctagaggatcaggctcagaggtgtacccttggatctggcctgtgcctgaggggtgctctggctctgcaggtgcttggcagccatgtcaaattcagtgcctgccctgtctatggtaggcactggcccagaagactgccacagaaacagtgactcacaggccctgttactgtgtcccaggctcagggataaatttggttacagacaccaagcgtctaggcctcgaggctgagcaaggctgtgaggagcagccaggcactggggccctg

SEQ ID NO: 43672 - DNA, 1088 bp, Homo sapiens
aagcatagacaggggccttgcatctcttgtgatattttttatttttttataaatttcaaagtgctttatcgtgctttctctttgtttatccttacaagaggcctgttaggtaaatattgctatgctcgtcttacagacagccaagacgcatagtgatagaagcatgggaagtgagcctggttcttctcagttctttgggtgctttccccctcaccatatagtcttgacttgtattgctctctgccagtgtctggctgatggcaaggcactgtttttgaagccaaaggagatgcagcatgactgatggaaggtccttgaaacttgagacagacgtgggcatgatctagccatgttcagaccctccaaggatgaccatggagagaagcaacaagacccatttgtgtggcactgagcagggcagaactcagactacagaagccagttcctgctcactgtgagggactcccttcttagagagtcttcccctgggctccatgtacaaaaaaaggagtacagactcctgctgtggctgaactggccctaaatccctggtctgctttggaagggaagtgctggggcactgaaaccatgtttccagttgtcaggtgtaatgaagagaaaggcactatccaaggaaggagttgcactaactgagtgcttttcaaactgcaggttataaaatcagtgtagtgggatgtggccagctgattcttaatgaggtagagtagtataaaaaataccagaattcatcacatatagtaaggggattcactaatgtctcatggaacttttgttctagttaaggatgtatatatatgcctgtgttgtgtggactggggttacagtacataattatttcttgctggggatataattcataaaatgaacttagttaggcccccttgttatttggctacaattctaattgctgtttattgactctttttactcacatgtgatttaagaaagtcttatgatgcaagactgaacattgtaacaaaattataaggcaagtatctgtaatgtaataacagctttcttttcaaagattttcctgctgtccatgaaaccggaaggtagacacccag

SEQ ID NO: 43673 - DNA, 1054 bp, Homo sapiens
tgctcatgatggccataacgcccacgctggaaggttttgggtttaccggaatgaaggcaaggaacacctggcctgcccagggcagaaaaccacttaaaggcattcttaaaccacaaacagtagcatgagcgatctgtgccttaagggcatgttcctgctgcagataactagccagacccacccctttatttcaggccatcccttcatttcccataagggatacttttagttaattgaatatctatagaaacaatgctaatgactggtttgctgttaataaataagtgggtaaatctctgttcggggctctcagctctgaaggctgtgagacccctgatttcccactttacacctctatatttctgtgtgtgtgtctttaattcctctagcaccactgggttagggtctccccaactgagctggtctcggcacttctctttgccttaaaaacaggtacagcggaccttcctggcatcagaaaaaggcctccagaaaaagagacacaggtactagcaattccaaattatccagagcccttctaagttgtaagatctgaaagaaatgtctgccatctatattctcagccacacttagtttcttaatctgcaagatggaattaataatagtacttactttatgatgctgttgcagaaattcactgagttgctacacgccaaacactgagaacccagctgggcatataataagcattctattgcatggcattattgccatcatttttacttctattactgctactgcttgtaactgcttgtaactgtttgtgcttttttgatatgaaagtccaccatcagggagcactgtagtggaaaaggtattaggccaggcatagcctttagttctctggccttgggtccttcatctgtgatattcagttaacaatacctagccagtaggggtgttaaagattaaataaatgtgagaatgtgcctgttgcttaatcttcctcaaagggttatggactctcagagccagaagaaggtcatctctcctttgctcctcgtatgctgggatctgccacatcaatggcaac

SEQ ID NO: 43674 - DNA, 1086 bp, Homo sapiens
aggaattttaaccttataaagacatccctagaaggagctaaatctttggggatttagtttcatattcgggttatgttgtaaccatttacttttgcttgttttactaggcttttttcatttctttgggtttttaatttcgctgataggtttataagctttactactacatgtgtgtgggtaagagtttcctatttaaaagcaggcaggcaatgatataacttaaatggtttttccagctgtttaataaaaggttttacttggaaaaaaatagtaaatatgaagacaaaaagtgatctccctatattttctgccttgtaagcataattttttgtttcgattttctaaaaattaataaagatgtctagaagtgaggcattaatttaaaaattaaaaatgtgaaatatttttactggtgagagacttcaaaaaattcattttaaatatgcatgaacattttttcacagtatttgagtatgtttggtcagattatttttacaagcctaaaaacttacagtatcttaactgttaaatattgcacatttcttttagaaagtacacacatttagcaggtttagaactttgaacagactttcagaagataatggcacagcatatttattttcatagtgatttagtgtaatgattacgaacataatttgggaaataaattagctttagcgaattttactgtacattttttatttacggcacataccttcataatttaattgtgaaagctacgcatttgcctttaattgaagcttttagcatgctttacttttaatgtgctaaatcgctaatttttgttcctttagatatgatacagttgaaggcatgtaaggcggggaattgtttttccaaagacatagtagttttactatacagggatttttaatacttaaattttgaatttaaaagaagtttttttttcccttcgagatggagccctgctctgtcacccaggctggagtgcagtggcacgatcttggctcactgcaacttttgcctcctgggttcaagcaattctgctgcctcagcctcccaagtagctgggattacaggtgtgcaccagcacatctggctaat

SEQ ID NO: 43675 - DNA, 1101 bp, Homo sapiens
tccttttatagctgctgggaagctttgccatgaaaattgcaccaaaatataagtataggcagggaagctagttttaggtatatcagccattggtttgttatgggctcaaagaaggataggtagttgaaaattatttggatgtctgtattctgtttagaatttggagtggttttggacatgataatttaatttgaactaggtcattcctgatgttattaataagttgtcttctttagttttctgcattcttattaattcttgatttctagggtgtgttttctccctgtgtcctcccctaatcttatacctgctgctcctcagtttgtgtgtatgcacatgtacatgcaaggatttttctgatgaatgtgcagggggcagtgttgtacttagtttcactttacttttgccagattctactaaaaattttaggtgagtttagccctgtttattcaactaaataagatacttggagatttatatctaaaggaagaatctcagtcattgtaaataaatgacctaaagtcattattctggaaatcaaccagagaaattcctttctggagttttacatcttttttggaactcttttgatatgatagctgtatgacttcaacacttctgaagtaattggatttggtgtttatatatcaactttacagtttaaaaaaaaaagaccagcatagtactttgattttagattacaactttgcatcattaaaaaaacagtaaaggatgtggaaacaaggagccatataggaatctaagaagcatgtaataaacataagactaatgtactaattatgtatggtgctcttttgctgactacttccattttagataaagaaatccaagaacataaagttaaaatatatgaatttccagaaacagatgatgaagaagaaaaaaaacttgttaaaaagataaaggtaggttcatccctgtacatacactaaagtaatctgaggccttaaaaacatactacagcgtccacaggaaagatcaaaagtatcggtgttttaagtagttggcttacaaaatgcctagggagatttaatgttgaattcaactttatagttaactttgaagattagctagtatata

SEQ ID NO: 43676 - DNA, 1070 bp, Homo sapiens
tgggactacaggtgcgcaccaccgcacccaggagttcaaggctgcagtgagccatgatcgtgccactgcactccagcctgggcaacacagcgagaccctgactccacaaataaataaatcaacatcatatgatctgtaccagggtataggcaggtgctatgatccccacttttcatcctcaactctaagttgagtcatacatcaacctctagtaaaaagtggcatgctctcagtcaaaggggtaagcccaaaccacgtggagagaatcttatctcttttgagagctaatataaaaagaattcctcctaggcataaaaatattgtgacatcagttacttaggctaaacatgcctattatgctaagtgagttattaacaataaatactttaactctgtgccatgttaattatcataatctgatttataatttgttttaaccttaggttatatataccttgaagccatttatattttggtatacttgtaatagttactatacactggactatgtatattggactaaacatggagagtcaaaaaagagtatgtggtcagagtagaaatcatgccctagcttccttcgtgtctacctcctaccttgagtagaagcggtagaaaaagtaattacctaagattttttggattctggtttgtggagaagcacccttatatttaggctgatgggtggcgaaattagaaagtattttttgtgatttagaattttatacggagatgttcattgtgattaattattctttgtattagcagatttttgctttttatagctgcatgatttcttgtttattattcattcattattgtctattaataaagaaaaactttatttcactgaagcagtgatacataatccaacttggatttttaaataatgactgacttttttctttgggaatacattactgttaaaaatgtagattattagatacattacttttaatgaatataagtggtataattagaaggctgaaaagaatccttggaaacgtgagtttaatttgatagctaagaaactgaggacaagatacttattctttgtagcgtattttcta

SEQ ID NO: 43677 - DNA, 1027 bp, Homo sapiens
ataattattatttctagaaagaataacaatgtctttatctgtatagcctacaatgtgcttcaacgctttaacttgtgtgttcatcctgaagtgggtgctcttgtcctcattttagaaaggaggaaatgagtcttggagagggtaggggacttgtaccaagtataggagcaaggaaaaaagtgaagtgactcaatcacagtgagccctcttcacaaatccagtgttgttcccactgcccatcaactgagaagctgcttttcctcttaaaaacaaaataaacgtagaaacaaagaaacaaaaatcctctcttctactctggattcagatgacagtcgtattttgctcaagaatattgagcaatcataaatgagttttctcccctccacactggagataaaccacaacttattataacaaaactggtcactgctcttgccaaagtatttcatcagcttctggcatgcgttatatcttgatacacttatccagcatgatggctggcgtgatcctctgcctatttagtatgtaggctagttcagcagaggatttaatgacaggagatttttctttggctccagggatcggcatgcacagacaggaccctgtgtgaattccccagcatgtgatgataagatacttccagtctgccagcatcaagcagcttcattaattaaaaacacattgcgtgttatcactaaagattgatttttctaggaagaattaccctttggcatttatgatgagcatgaagaagaacagataatacaattactgacaggactttcctcattttaggacagcaaatatttaagattaggattaagatttcaggagagacagcctttgtgattattctgcaaaggaaatatttgggactgctgttttcgttttgtttaggctgaccctgggaagtaaacatttgctcagccatactgagtatctgtgatttaatgggatatgggccctaaacatattttagtacttcacccctttatgcttaaaacaaaacagtgcaaaataaacaata

SEQ ID NO: 43678 - DNA, 1015 bp, Homo sapiens
tcaacctcctgggctcaagcaatccttccacctcagcctcttgagtagctgagactataggcgcacatcaccatgctcagctaattttaaaatttttgtggagacagtgtctcactgtgttgcccaggctggtcttgaacccctgagcttgaataatccttctgctgtggcttcccaaaatgctgggattgcacgtgtgagccaccatgccctgctcttctcacattcccatgcccagggttttcatgcatccttcccgtcattgcacatttgaagccagaacatttgcattttttaatgcttgctggattcaattttacattccaaggttaatccctctgctcctgagattagggaaatgccccttactccttgctcttttctttttattttgaccagagcctgcatgaaaagatgctcaccaaatggtaatcgagcatgtaaacgaatgaatgcataagataaatctggaggaaagtttgagaccagaagaacgtgtgaggacagcttgtatgggaataggctctgtgatgggaggcttctctgttgtcctgaatggcctggggagtgggatgggtgcgctgcaggctgctttaggactgagctcaagaaatcattttaaagtcaaactcgtaataatcactcttgagaataattaattagcaaggaatttgtgactgggaagctcagaagtctcaacagcaactctgatgggaggtcaatctttgttacactgaaacgccatggagcagttggcccatggagctgacccgtaaaactcacatgtgcccatgtaagttttctgtttttataccttccttgtcttcagcaaatcatgagaagcagcttgttgacaccccagtgtggcctcctgttggtgctcatgaccaccattgtgttattgaggcacccctgaacttccttccctaaacttggaagccttcctctttgagaagtagttaaaaagaaatactgggtgtggcacagtgactctaacctgtaatcccgattcttt

SEQ ID NO: 43679 - DNA, 1041 bp, Homo sapiens
ttcagcttttccaattccgaatcagttctatgattgatgcatctgaaattcatggtatttctgttattattatgatgatgtttttcatggagtaaccagttttcccagttttgttgtctggctcctcctttctgtctgagttgtgaggtctctctccagtgtcattttctctcctatagatgaggccaccgcgcatgtctgtcggtcacaaagtttatttcatacaacacagagtgctgtatatctgttagccttgccttttgtaagaactctcacatgtgaaatagtttgagatcataatttttcaatagctacctaatattttgtttgtatatatatgtaattttatctttttattgcttaggtaaactattcttttcatggcagagaggaatcttggctatcaccctgttctactcctaattacagaaggggaaatgtgtgccagaggggacatgactggcacggatccttggagaggggctggagtgagcatgtgagttcagactcctgaggtccctggacacctgctcctggtcctggtgtgtagctcatggtagatgtttgctttagtgggctcatgcatgtggagccccagttcttgcaccaggcacagaagagcctttgcacaccagctcactgggtgttccagtccagctctgggaggtgggctctgcccatctagagctgggctggcagctggtgtcactgcttaacctgctctgtcgcccagggcaggcagcttccgctctgtgctgcagtttgctgttcgtgcaacggagtgagaatgtgactttctccctggtccccatgggaacaggtggaacaaggcgtctaaagtacatggagcttcgtggaaggcaccgtggcagccaataacggggctgcatggaaggagcctctcccagccagcagggcatgtgtcttctgcagggggaggtgcagcggccggcaggctccgggcagtgtgcctgggccccggttctgcaacccaagttctccaggttcttcttgtgggtccagctccgtgctcagaggggg

SEQ ID NO: 43680 - DNA, 1080 bp, Homo sapiens
attttcctcaatgaatgtttgatttggatctttttatgtttttcagatctctacttaactttctagcatatagaatagttattatgatggacatttgggttatataaagctgttatgacctttctttctcttgtggacataggcttttatttctctttagtgtaaataagaatggaattgctgagtcataggttaggtgtatgtttaagtttataagaaattgtcaaaccattttctaaagtagttgtaccatttattccacattctaaataccatttcatcttttcaaataaatttaattattccagtgggtgagtaatggcctcactgaatccatatggatattaagtactgatagaatacacggtcacatatcagcaaatagacatgattagtgcttgactctaaaagcaaattgaattcttataaggttatcatatagctgagagccttggctctacaaacatgaataggtagctgagtggttagtttttccaagtgctaatgcttgtaattgtgtttgaggaagaaccacatgtgtatcacaggctggactgtctcttcttctgcaggagagctcagagaggctcaagagcttaatggtgattctggaacacctttgaaccaggaaagccagttgacttcctcataacataattatgctgtttagctaattactttttccagaagaaaaagggttgagagtctagaagtgtatgtggattactttgtcacagaagtaggtggctctacggctgaagtctggaagggagtgcattttcacataatgatgttggttgatgtaatgtttctaggcaccccatgtggtgattgatgagttgggtgagagtgaacgtccgtctaggactctggaattgggaatgctaacatggtatccgtgggtcgtcttgggaattttagcatcaccaagatggtttcttgttctctgtttgcttggtaaaattcctgtttttgctctttacaattccactagatttattatttcccttaaatgaaaaggaaaaagaaacaaactatgagatgaaacgttgacaatttcttcctttactttttcagccg

SEQ ID NO: 43681 - DNA, 1029 bp, Homo sapiens
taggctgagtttatagtgaggtactgtgcctggtgtgaaggagcccactcttggggacctagaatgtggcctcaacagtagtcctggggttgggattctggttcagccactaggcaaaggtatttaatgacattcatgttcttagtgtatgttgccaatttagcaaagcatccatcgttttgaagaaataacaattcagaactttttaaaacagctgtattgagatataattcacatatcacacaattcaaccatttaaaatagactgtctagtggtttttagtatgttctcagagttgtacaaccatcaccactatcaattttagaacattttcatcacccagtaaagaaacttcttaaccataagtaatcatttttcatttttctcttctcccttattctgctctcccccaccatatacctcctggccccaggcaattacttgtctaatatctgtctctatatatttgcctattctggtttttagctcttttttttttcttgggggagacagggtctggctctgtgccccaggctggagtgtagtagtacaattatggctcactgcagtctcaaactcctgggctcaaccaatcctcctgcctcaccctctcaagtagctggaaccacaggtgtgtgccactgcgcccaactaatttttgtattttttgtagagatgaggttttgccacattgcccaggctggtctcaaactcctgggctcaagaaatctgcctgcctcggcctcccaaagtgctaggagcacaggcatgagccaccacacccagcagttctttttatctaactgtaactatatatcgttgaccaggatctgccttccccgctgcccccaaacacttaagcatctggtaaccaccattctactatctcctatgagatttgcttttatagattctaaatataagtgagatcgtgtactgtctgtacccggcttatttcacttaacataatattctccaggggttcatccatgtggttgcaaatgacaagattttgttcttttttattg

SEQ ID NO: 43682 - DNA, 1030 bp, Homo sapiens
gttttgggtttaggttgtaattccttatatttctttcttccacagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggctggtcttgaactcctgggctcaagccacccgcccacctgggcctcccaaagtgctgggattacaggcatcagccatcacacccatccataaacattatattaatgtcacattacaaaactgagacctaagttgcttaggataaaatgaaattggaagactagctaacatgaaaatttatattttggctttttcatgttttttgataaaaccagtgtatttgaatgattcttttgatgtttagtaatggttttttgtttgttttttggtttttttttttgagacggagtctcactctgtcgccagtctggagtgctagtggcgcgatcttggcttactgcagcctccacttcccaagttcaagcgattctcctgcctcagcctcccgagtagctgggactacaggcgcatgccaccacgcccggctaatttttgtatttttagtagagacggagtttcactgtgttggccaggatggtctcgatctcgacctcgtgatcacccaccttggcctctcaaagtgctgggattacaggcg

SEQ ID NO: 43683 - DNA, 1023 bp, Homo sapiens
cccatggagtttttttccttttggcttccttttctaagactatgtaaaatactcaatttgcaggttattgaagcaaacctagatggagaattgaatttgaaaatagaaactgaattagtatgtgttacaactcattttaaagatcttggaaatcctccattaggtaagttttctagtgggttatattttgctttggataagttaattgtttcagataacctacctgttgaggtctcttcatgtaaaaaggttgaaattcagttgactttgtttcatgcttgggtgaagaacaaaggaattgagactggactatgtatccctgtggtgtagtggggcagttagccaccagggggagaagctgtgccaccaagtagctgacagatctgtgcagggtctccatcctctgtagaattcggatcaagttacataacctccaagatcccttccagctattcaattcctgtcctactcctaaagatttctatttctcacctggcatggattcagaaaggtagatacatttgttcttatattctcctccttcagttacttccatatgtatgaaattagtgtagcagatgcaaaactgtttcacttgatcacatttcttatctcatacaaggtaataagggacgatagagtcagttcagcaagtggggagagaggggacggttggacagtttggtgagttataagccaagagggggttagaatcatggctggaaagtggcagctgcacagtagcaggggctgcctgagcaggaaagcaggtaaaggaccaggggagaaacacctggggatgatgagaaaatcattttatgatacataagtgtgccagaaccaataaaatcggccctagtcacatttaagttactacgagtctgcttgaatataaacacagattttagcatagagttggaaggaatttttactttctagttaagagcatcctgctccagcagagtgaaatccatacggttatgcctttgataatattgtgtaaagcgattcattctgatgtca

SEQ ID NO: 43684 - DNA, 1026 bp, Homo sapiens
gatcctgatgtaggtgatgcctgcagtcctgctgtacaccccacattaaatggcatgacttgaattctctagttttagttgtagtcttgcagtatattttatttttaaaggatacttaacgaaaacattagattatttgccttttgttatttacataaagcatcttaaaaatgttgcatatgatagaaatgtcatgccatcctatatgtagaaaatgtctcgctcagtaacatcacttaaaacacaaatgatacttttggaggacaattagtatttattagtattcttggccttagacaccaatttgggtttcacaggacttgatcttttcctcagccggtcaggagcgatatctggatgtgcacgaaagccaagaagagaagaatttcatggcttagggctaacatggggtaacggtcatgccgatggttaaccctagagctcctgaaagtaaagatgatgccaaagggcccatttcctcttgctcacaatttgtttaagaagaaagtacagaaatatgctgggtaaaataattacttgacttttactagatggcacctacactgattttgaaaaagcctgtgttttatagagcactcttggtaacagtctcagatgtgatgcagtgactgtctgccatgtttttgtacagagcatggaaaaggcccttgaatcataggtgtaaatgtcccttagaggagggcctcctgctgattgcctgagttatattccccctggaccaatataggggcatctcagctgaagtaccctattccttcttgagccaaaagaatgcccacagggacatggttgctgaggtaaccagaggcaggcattccattctttaattttgcttgagcatccttgagttagtgaaatagaattggttttctttttatatttttaaaagaactttattcagaaaattgtaaaatagtatcccatagtttttgagcatgcatgtgttctagagttagttatggggcccttgtcattactagagtatattaatatttttaatacttg

SEQ ID NO: 43685 - DNA, 1080 bp, Homo sapiens
aaatctcaccttgagactacagtgaaaagtttccttatggatctctgcagtatgcttccaccacagattcttctaaagattagagcaatcttaatttaaaacagatttaatgcatataataaaagtttaattattgtaatatatactcattgaagaaaatctgaaaagttcacaatgcaaaatggagaagaaaacagacacaattctacaactcagaatgttctggtgtatttatctcctaatcatcctttctgtttacacacacaaacacatagcataatatattttaataaagctagaattacactgtagttacaatcatcattaaaacatctctatgtactatatgcagaactcaacattcctaataactcttcaggggtgcgtagttttccattgagtgggtgtaccatgctttctcaactggtccctggatgttccactgttgtagaggacaagatctttaggtgttgagaaaattcttataagaacagcagagaaccatatgggcttaagagaaataagaagttgatagccttaacaagacctccagaagtttatttttgttagcaccttagttcctgggtgttttctagggatcagcagcaccctcatcactggagacccagcccaggcccactgcctcaaggatctgcatgttaacaagatccccctggtaattccagcgcatgtgacagtgtgagaagctctggcttcatgcaacagaggaaagggtgtaactagaaaactctcagcaatatttcaaaatagtacaaaaagcagtctatgggtatgattcttgaaatcatttcaagtcataatattgttcacaaatacatcaggctaaatttaagaaatgggatttggggtttggaacaactcagagtaaagttaggttgaaatagaagcgataaccatcttggaagtagattttttatcagtcaaaccttcaaatctgtgttttgtgatttctttctttccatttagaaagacttctcctagccaggggtgagatatcctgtatatctcttgtatttaagttcccacctttttgtctagatatcttttgtgtttaatatg

SEQ ID NO: 43686 - DNA, 1018 bp, Homo sapiens
ctgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaagcttttggcttgcattctaaattgtcctcttgaaaaagtagttcctgtgtaaaactccatctgcactgaatcagagctatggcagcattgggcagtaggcagttttggtatttgttggcattctttttgcatttattcaaaaaactgaaggtagtgaacgtagagcaatgaacaacacaaatatccttggtctcgtggaggttatatttaagttctaatgttttctcttgtgaacagtgcaatttgaaatgacaaattgaaacacttttagttgttgaatttagacagtttgtgtatatagtttaaatttttattcttggtttgccttctgtttttatgttaaaagattgttgcaatttttagtttttccctttgtaatatgtgattgtctttcattagaattcattttttgttttgttttggttattttgaaacagtctcgctgtgttgcctaggctg

SEQ ID NO: 43687 - DNA, 1049 bp, Homo sapiens
attccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggcttt

SEQ ID NO: 43688 - DNA, 1047 bp, Homo sapiens
ctggctccagaccctgtgctcttaactcccgttttgcatcaagaacagaatcctatgaaaggcttgcacagtgcttggtactgagtaggcactccgtcagtattttagtagctattattccaaaggacactgtattctaggtactaagacaatgtgaatggaatggaaaacaattcctccctgcagaagccaactgtctaggaagacagataatgacattattaaaataatcagaacattggcaaaataaagaagattgaaatgcagttcatatgacagtgctaattaatcatactttttagatctaggaaaggccataaaggttaaattgacttggaaatggtaaacaagacaatggttgtgtcactgatcggtgatggccagtttttggttatccttatttgccatttaaatgattgaattgaaaggaagaagtaagacttggaagatgaatattgaaggaaaggtgaagatggaaaagagaagggggtttattctgagaacagtgactagaactctgaggtatggtagaaatttcaggataacagatgataaaggggaatgaagccatggagaggaagagaatgataatattaattgtgaaagtttgtgtcaagtgttttctgagtcacctttctttcagtttctcatttctagtattgtataaatgagtttaacatcaaaatggtatagtgaaaaaaaggatgaactgcttgacagaagaggtcagatctagttttgactctagcttatttagctttacagctttaaataaattacagtgtctttaaagctctggatcttaagttttctaattgttttttaaacaaagatttgtgaacacctacttacaatgtgacaaatgtctttgtaaggcattatgggagataaaagctgcattaaacctggctgttgtacttacaagtaatttggaaggcaaaatttcaaatacttgaacctaaagtagggtttcttggttttcatttaattgaaatactgttaggaaacaaaaatttttcataaatttttcttgtggatatgtaagta

SEQ ID NO: 43689 - DNA, 2275 bp, Homo sapiens
gatgaggagggtgtcttgcttagcttttgtgagccaggggaaggcagtgtgccacgcactgtcttttctgtggctgcttgcttcctgctgtgtgctgacatccccaccttactcgtgaggaaaatgaggctcatggctgtcagtggcttttcctgcaccgcactggggtgaggaacagaatctggggttgagcccagccttcccagcttccagccaaccttatatgcaaatacaggaattactgtcctagggaaagtgctgcatagacaatcctttttgttcttctactgcattatattattcacacagttataattcttttagctcaaaatataaaatgaaaagtgattgacattttaggctggatgagtaaattaaaaaaaaaaaagaaagaaagggggctttcgtggtaggcagagtgtgtaatgcccaaatcctacaagtaacaaaagaacagcaacttgggacttagggcattaggtgtgcagcctctgtgtgtgaaaactggctgtgggatgtgctgttagctctagcaatggttttagagttacgaagtggttccaagctcattaattagccaagccttaaggctgacctattccctgtgaacaacacgacctcctttcagcagtgttttgcactgtactacagtcatccaactgaaaactcactgagttaaaataggtgttaggaatatgattctctctgggagatactgtggcattcccctgctttaataaaaataactgccccatattcagggacctaggaacggaatttacctgcgtgagcttattaatccctcatagccacccaacagttgcttcatcatggagcagagtaaacccctggggcctcaggagttggctgaggtcgtatagtgaggacccaggtttgtgcagtcttctcggggcatgctgtgtgcagtgggtacttacaagttaactggtaaatgtaattctcatgagctgggtgaactgggggcaacttcgagcccttccccttgaccaccttagggagcaggggagctagctgtcctcagcagcctccgcagcccacccaaagtctgtccctcgctcagggacatggcagcccccagcacacatcctctgctcccgtctttcccgcccctggtgttttctagcctaccttgccctgtgtgtccctctggaatcaaatcatgggcagatgtagctgctgctggccgtgggccccgttctgttccctgaggtggcagcctctaacctggcaagtgttcttgtgtctctccagtgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgag

SEQ ID NO: 43690 - DNA, 1050 bp, Homo sapiens
gaaaactgctaggcagttaccatgaatattcacatatttaaggctctgagaagtcctgtagtaaaatatatttcttttaccttttcagcatgggattttccagtcttatttaactgctttccatcttcacattacaatctagacctggtgattttgctgatgattgtagtttggttttggatacatttaaagtgagttccttttcaggccatttcttctttgtagctttcattggatctttcttcgctttctgatgtataactatcttttcagctaactccagattttctcatgtaagagcaatgattttatgccttttttgtgctattctaatttaggattaaaaaaaaattttaaggttgtagaaaggttgtaatagtaataggatgaactatacacacttcgcccagatacccttattaagattatggcacatttgcctttgttcttagttactgttttttcttctgaaccgtttaggagtaagttgtggcatgatgtccctttagtctgaattattacagtgtaaaatttctaagaacaagaacttctataaccacagtaccttataaaaaccaggaagttaacattgacgacgcagttcattgtctaatctatacccttcttcctaattgcctcctttatagcaaaagaacatcttcatcctaaatcttctctcccagcatgtattcataatcttgacctgcgtttcgagtagaagccaattcttgtagagtgtgcctgggctcagcctaggctcctcactcatggtgagattcaggctatgcatttttggcgggagcacccccgaaaagtgatgttgtgtcatcttcagtacatcgtctccggaagccctcaaggtcaatttgtctcattgctagtggtggtaatttagacacttgatgaagaagatgctgtcggccggatttctccactgtaaagctattattttcccctttgtagtaaataagtattaacagtacaatactttgatgccatgaaaatactcttttttctcatccacctttcatctgctggtttcagcatttg

SEQ ID NO: 43691 - DNA, 1051 bp, Homo sapiens
caatctttagatctttttagtaaacagagctaggacatgggcttttttaaaacaaaaaataaatgttgggttcacgttgatattgctaattcaaatttgagattacaggattttttacttctttgattttgttgttttttttttcctctgatgatctctgttaatggcattaacttaattacttattactttatattacataatacaaaatacatacctgtaatatcttgaaaatattaatgctgatatttattcagtaagacacctgaattgcgatttctttacagtccttttaatccttaaggattaatccaggcaggttaccttaaaataccttgcccaaagtcacttaaagtaattcttctctatggttctgtcaccaaactgctgggtaaatcaggtttgtttgtttcagtttctctttagtgtttgcaagtggatctgatttattttctttttggttgaatgctgctttgtaaattgcataaaacattttcatggttccaaagtcagatctatgaaataaggcacatgccctgtcctctcaactctgcctcccaacccctacaccagataaacagcttttattagtgtttgtttatccttctgtcatttcattgtacaaatacgagtgaaaagattttgttttctgcctctcgttaagcaaatgtagcgtgctgcaagtactgcgctgcgcagttcccgcagtctctgcatcccaaggatcgctccacagcagcgcatcgcgatggcccacatttcttttccactcttgggttttcttttatgtacatggaacatcattttttaaaatgtcccctactgagggatgttcaccatgtttccaggcaaatgttatgagacacagtgctgcattgtttcataattttgccatgtatctttgccatgagtcctgagaagtggggctgtggggtggaagggcagggcctatgtaatattgtgaagtatcaccagagtccctcagcaggcttacttcttcatctgagagtcatgctgtcagccgcatctctcatgaaggaggctgaccctc

SEQ ID NO: 43692 - DNA, 1031 bp, Homo sapiens
tcctctctccaataaattgcatgttgtagtaaaaaaatgggctcatgtttctggagtatttttcgttgtgtgtagtgcaatacaggaactttaaagaacaccatgggacccatgtgaaatgccactagtgaagctggaagtgcgcccaagaacagagaaaagtcacgacatgacaagaaaaacttaaattgcttgatacatactagagattgaatggttgccctccacaccacacagataattcattgtgtcaacatgtagacttacagaatcgaatgcagtacagtcccataattgtattgtctcttatgattttcttaataacatttttttctctagcttccttataaaaatatggtgtagaatacatatacgaaatatatgttaattaactgtttatgttatcattaaggcttctggtcaacagtaggccactagtaggtaagttttgggggagtcaaaagctatactcggattttttatttcaaggggcgtcattgctcctaatccctgtgttgatcagggtcagcggcactcaggctcctggaggctggtacagggcatcactccctgttccgcactcaacattgccctttcctgctgtggcgtttgtcacatgccgggcctcggggctcccgggccggtgactaactgtggcttctcctctccagtatggaatgctcctttaccagaattaccgaatccctcagcagaggaaggccttgctgtccccgttctcgacgccagtggtaagtaaagccaggagcttcagaagtctagtgccttttcagcttctgcatcacatgtgttaaggacgcctcatttcacacagggtgggcaagagaagctctggagagtgtgtgtgcatttcagggaagccagtatgtcccacgatgacgtgggttttgtagtctcaacagtgcaacgacagggagtgaattcctctgccgttcttctcccgtccctgcatctcccctcagggttgtgtaagtaggtggctctctttaagtgctcaaaaatggcagcaacaa

SEQ ID NO: 43693 - DNA, 1540 bp, Homo sapiens
taaggaatatctcttataatcacaatgtaactattttactttgataatctttatcttttaaccaaaatatttactgtgatttaattgtattatttagtgtgataatcatatttgtatttgaacctgccatttgcagttttttccaggttgtcccacctctcttgtattccttttctcttaattttttagatttattaagtatatttatgtttttccctctgttaacccaatacgtacatgtacatttactattttctcctggttaccctagatatcacatctttttttttttttttttttgagtcagggtctcaccctgcctcccaggctggagtacggtggcatgagctcatctcactgtagcctcaacctcccgggctcaaaccatcttcccacctcagcctcctgagtagctgggactacaggcatgcacttccatgcccagctaatttttgtattttttatagagacagggttttgccatgttgcctaggctggtcacaaactcctggactcaagcaatctgcctgccttggcctcccaaagtactgggattacaggcgtgaaccaccgcgcccggcctaacatgccccttgaacttattaaaatcttttataatgtagtacatttactgactgctttcaggcaggcatgaggacctttcactccatttgctccattgtcccttttgaaggattcttgtcatatatataaaacctcttaagacataatgttattgttttatatactctttaatcacctacatctttgcactttaatatttcctaaatttgcattcttctctctgggactagaagacctcagcttagcggttcttttcatgtgggcctgagaaattttctcactttttgtttcactttcattcttgaaggaacgtttcactggttataggatgcaaggttagcggttattctcttctgcatcttcccactgcattgtcttctgaatcttataatttatgtaaaaacattagttgtctgtcttcccattgcttctgtgaaaataatgcacgttttcctctggttgtttttgacattttctttgtgtctgtttctcagcaatttttccatgatatatgctcggagcgggcttacttatcctacaccctgaatctgtagcttgacgtctttttgtcaactttggaaagtttttggcattatctcatcaaatatttcccctgacctgttcttgctcttctcttgctggagtgcagtcgttcctgtattagacctttgcatcatgttctaggtatttttatcttagaaatgagtatgtgccatgagacctagagccagaactgagcttagatcccatgaaagaagagctgtcccacttgatgacttcacttcctgtttctgactctttcttcttctccacatggttggaatgtgtgatttgggtgtgtaggttgggatgctggatgtgtatgagactttgcagggccctgagtcctcattgccaggatcagaaagtgcagactactgagccagttaggtggcaagcctcagctagggagggc

SEQ ID NO: 43694 - DNA, 1029 bp, Homo sapiens
ccactagattagaagaataggattcgaaaaatcaggaccagggagaaaggaaatagtacatgaggtgttaattattttcacgactgaaccaactctcaggttcccaaaaagccagggccatgaagtaaacatgatgaattatacagttgactgaagctcctcagcagagacagtacctcctgactgtaagttctaaaggaaatttatcacgtggtactgcatatagagtaatgcccttgacagcaatttcatgccagttgccagagtgatttcatagggctgtttactgtagtcactttggatttcccacagtgtttctgtgcacatataccatatcccacatgtctggaattaagtctacagagtccttgtgagttgtaagttagctggcccaggtgagcttggctaaagtccaggggtctccataggagatgttcgtttagtcaactggagccaatggatacaatggtctagggatttctttacaaaaactcccagccttcgttgaactgtagtggcctttgagctggtccagagactcaaggtgaagtcaattaaggagatggaggaactgaaggaagcatagctcaaaactttcctggaggtgctgcagatccaattctgaatgtagtcctgttgtcccatccacttggcaggtagcattttgcacccagtaatccacagattccagagacattaaggatacatcctagtgccatttttataggatgctggggcccaaaccaaaagttccacagattggcttcctgtatctctctcccagaaccttattttatgttttcactgattaaaaaaagaattatggaaatcaaaactttacaaattcataatggaagaggaaatgtccatgttaatacatcatagatcatagaccactcctgtgtaagccggttttcagtgtaagggtcatcagtgggaactggtcacataggtgacatccattgagggcagtattctgcatggacctccagaaagaatgagattgctctttgtgtcctgttgcggaaa

SEQ ID NO: 43695 - DNA, 1060 bp, Homo sapiens
tgtgctggcatgcacacacacgtgtgcacacacatctacatgcacatacccacacgtgcatacatacatgtatagacatacacctttgtgcatacacacaggtatagacatacacctttgtgcatacacatacattatacacacatgtacatagacacacatacacatgtgcacacacctataggcagagcccactccttttcccctgatgaggttgtggtggtattaataatcataatggtagatgatatttactgaatgcttactgtgcatgatatgttccactgacagttttacatccattatcttaatcttcacagccccttgtgggataggaagttggccacattgcccacatccagtagccagtgaatagttgtgcttggagtttgccctgtaggctgacttatgagccatagcccaagccacatcccgagaacacacaatacggggagcccctccttaggggaaaatttctttccaaaatatcacctcataccttgctcagggaatactctttcggttataagtaataggcgtctaattcacaccagctagaggcccaaggcagcctcaggcggggctggaggtatgagcagcagctggcactctcccttcccaccagcccacaccagccatgcttgcctgtctctgcaaacgcagtctctgcttctctcatagcaccagccgagcgcagggtagtcacacctgtccctcaacccctccagattcttgggagggagagctggggtgtgtccagcattgtttcttgagtctgaggtcgggggttcttctggagatgcaggtcagtttatgcctgcaacaattctcctccctcaccaaagggccctgcctctggaggggcacctgtcttctccccatggtgcctacttccccttctgtctcattctccagagccaacatcagtctccctctctggaccttctacttggggtctgatcttggggctgctcagacatcagaatccctgagctcctcaggggttgcccctcttggctaagccctgcagcagcccctcctctcagtggcctgggggcaa

SEQ ID NO: 43696 - DNA, 1038 bp, Homo sapiens
gtggaacaacaggggttggggagagagtttaaagaaaaatgcagcagggctgaaaaaaaaaatgagaaaaccattggcatggctgatttgaacaagaaaagtggcaaagagacttggagagagatgagacacacacttcaacataatttcactttcctagagaagatcatgtatcctcagtgcagataagctcattgagagactcagggaagaagagcattaggaaccctgatttgggtagcagaaggcatgcactggtcctgaagacattccctatgatggttagcatatttataaagcattgttggagctcagttatattttccaaattcctgtttttcttttatgttaatgcattttaataacattcctacctaggacccagagacatgttttcttcacttaaattgtatttctgtagacttattcagccatgtcagctgtatttgaatattttgcttgttagggggaagtatactttcattgagtgacacataaattctggaaaagagatggtggatttcttgaaaaataaataagagttgaaaacaagtctctgggtcctgatccagccccagccctgggatttctttgagttggagaagtggcccgtaggtggcaggcagggggcagtgaccctacctgagagtgcaggctcccctggctggtcccccgtctgctgggaggctaacctgccctcacagagaagggctcttccgctctcgctgagccccgcctctaccacccccaccacccccacctgggcactcaggcttgagtgacattgactccttcctgcccaccgggtgacagctgagggtagctagctgtaggagggtcaagagggtccctgtagaatggtgtggtcccagttcctgattaaggtgggggcctcccagcccttccctctgctgtcagactccacgccggccacagaaatcaaagttcagagcaagtaagcacccccttccaaacacaagaaaaggggccagagagagcggggagcctcggagggagtttgtcaggacaaactaacat

SEQ ID NO: 43697 - DNA, 1025 bp, Homo sapiens
taagactgtggcaggaagcaagagtgagggtctgtgctaagattgacagcaaggaggggcctgaatgactcccacacacacaacaaccccgtgggggccactgagacaaaaaaccaggtgccccagagtggagtttggggccgtggagatataatgatctaccttcaactccaattgttcttaaacttcttcctttaagtttgcaaaaaaaattaagctcttgcttttttgtctatgcagtgaatatgtaaaaagtgacaacagaaagtctgggaacagtggaaccttctattagcacttcagggcttttataacgggattcagtgccaagccagccagaggcctgggtagctttgcaaaccattcctcccccaactaactctaaaaagacagagtttcatgctgttgacataattatgccctctttaatattgccgttttatttttaaaaacaatttgctatttaggggcttttttgcagtagagagaaagaaattgaggatttgaggggtggcttttctgactgaattgttcctgctgcatcttaactggtcatgaggtttgctttctcagaactgaaatcctgagttggaagcagctttcagggtcctgcccctgcacccttcggtggttgtccacaggccttcagctggagcctgccttgttcccagatccacggtggatccaagcacgtcccagggagggcacgtgtcaggggccaggatcttttcaagagggtatctcattaatccatgtcatagcaacactatgaggctggtgctgcttacagatttccattttacagatgaggaaactgaggcacagagaggctggatagctcagccatgttcccacagctagttactgatgaagcatggttatggccaagtctgtttctaagttcctctttggaaccaccaccccaggccaagataggtcataactaatgtagaacttccatacattgattaagcagtgttttgcttacattactgattctcagagcagttccccacagcttggat

SEQ ID NO: 43698 - DNA, 1032 bp, Homo sapiens
ccagcctggccaacatggcaaaaccctgtctctactagaaaatacaaaaattagccaggtgtggtggcacgtgcctgtagtcccagccacttgggaggctgaggcagaagaatcacttgaacccaggaggcagaggttgcagtgagctgagattgcaccactgcactgcactccagcctgggagacagaatgagactctgtctcaaaaaaaaaaaaaaaaaaaaaaaaaaaaggaaaggaaaaaaaaaaaaaagctgtggatccatctggtcctgggcttttttttttttttattggaagatttttataattactgattccattttattacccctacttgtctatttaggatttctgtttcttcctgattcaatctcaggaagttgggtgtttccaggaatttatccatttcctctaggttttttagtttgtgtggatagagatgttcataataatctgtgatgatcttttgtatttctgtggtatcagttgtaatgtcacctttttcatttctgattgtgctcatgtgaatcttcttttgttcttaggtaaacttgctagctatcaattttatttatcctttcaaagaaccaacttttgatttcattgatcctttgtgggtttttttgttttgttttgttttttggggtctcaataacacttagttctgctctgatctttatttcatttcttctgctagctttgggttttgttcttgtttttttagttccttgaggtgtgacattgggttgttaatttgagaactttctgtctttttgatatagacatttaacactataaaacttatttcttagcactgcttttgctgtattccagaggtgttgatatgttgtgtctctattttcattaaaaaaatttctttttctgccttaagttcattgtttacccaaaagtcattcaggagcacgttttttagtttccacgtatttgtacagttttgagagttccttatggtattgatttttaattttattacactgtggtccaagaagatacttgatatggttttga

SEQ ID NO: 43699 - DNA, 1035 bp, Homo sapiens
tttttttgagacagagtctcgctctgtcgcccaggctgctggagtgcagtggcgcaatctcggctcactgcaagctctgcctcctgggttcacgccagtctcctgcctcagcctcctgagtagctgggactacaggcgcccgccaccacgcccggctaattttttgtatttttagtagagacggggtttcaccgtgttagccaggatggtctcgatctcctgtccttgtgatccgcccacctcggcctcccaaagtgctgggattacagatgtgagccactgcgcctggccctgcctctctcctttttaagtgactccttggtagctccgtaatgtgataagagatcagatgctggtgtccagagaccccaggtctgagagcaagcaactaccatgatgtggacctggcgctcctcacagcatgctgagccccctggcccgcgtgctgggacagggtgggagagtggcagtggtctcactgcagcatttgtgggccctcacggatctgagttccacctgcagctctggtgtgtctcctttctagacatgtaagatacaagctcagtgccctgtaaaggctacgggccaatgggacttgatgaaaggaaggaggggagggaaaattctgcatgggagtagtcatgggtagagaagagccctcagcctcctattcaacagcacgcgattcctccaatgccgcctccctctgagctctctgccttcgctcaccttgagcccctacaacgggccgggtgttttgccagaccctgagaccaagaggttgaccgcaaagtgggccctgctctcgtgagcttagcacgatggtgacagagtgaagagctatctgagaggaagcaggatggagtagttggtagtctaagacgtggcaggcatgtgccaaaagagagcagccattattctatctagaaggacagggaggtcttccccagctgccttgcgtcctctccctggggatcccagagcatgcagcagccccaggcaggcttaccaagttcttccacgatgactgcaccc

SEQ ID NO: 43700 - DNA, 1416 bp, Homo sapiens
gaaatctgtaactacactgtatctgacggcttgtgtgtgttcagagttctagagcaggcatatgtgcagttggtagagagggtatcaggcattggaagggaactgatgagctgggtgatgcctccgctttcaaaatgcaggtgacacaggtagtcactcttcactcggctgcaatagcttaatagacttgcggtttgaaacattttacttctttaagtgcatcctgtgtgaaatgacaaaccccatccctgttgcagttcacatgttcatctgcagactcagcgcccttgggtggactccagcaatgtgccccacccgtctcagctgatgtccctggctgggcaggaggggtttgggaaactgcctgcaggaaggccccagggagctctgggacccggatggtgggtcgtgtaggattgcgtcttctcctttgcaccaaaaatctgagggtagctgcaggagagggtttcagggggtgggggagggctgggagagccccttttaactgcaccctcaggagcagttctcatccactgttctcatctgttgctttttttttttttttaatttggttggctgtttttgcatacctgtaatgtttaaagttgatccctgttaagcctgtaggttatgatcgggcattctcccaggtggaagacatttcgaatccctgtcattctgctctctgtggcattggtctttgtttaccttagtggagttattaagtgtgccttctgtgccgttctccaggttctgaaaatattgtgcacagggcaggctgaggacacagccacgtgatacccactgtagagagagggagagagagacctcctatgcaagctgccggccctctgttccgtagtaaggtcagtgcccgctgtctaccgaacactcagtacctttagttgctgggcaagccctttatttatgttattttaatttgaacctcagaagtgacctatgaagtggtcgttctgcctcaggaaggtgtggagataccccgaaggtgaggcagttgccctgagtcccaagactaaccagcatgtgggggcctgggatctgagccagtgtccagcctgctgtgcagtccttccatttgtcacctgcagtgcccgccgcactgatgatggcactcctctcatccagttttcccgctgcccctccatccgtgtgttgcagttttagataagaaaactgcctgaatcgcccaatgaacaacataccctggttctctggggctggttcctcttgtgcatcttgtagtgtttagttggtacccagcagaggcaagagtgcatttgatgctctagttgaaacggaacgccaatgactggtggtaggggctgcttcctcgctgttttgtgcccaggctaccttgtgatgctttttgctgaagcctgggctttgaaaggtggg

SEQ ID NO: 43701 - DNA, 1035 bp, Homo sapiens
gatcttgccttgggaatcccctgtcccctctttgtcctggcacttagtcagtgggctggaattgtctgggccgactgagtccctggcctcctccctttgctgggcgcccagggccctttggactccctggagtgacagaggagtctctgcctggggggatcagaactgggcctgctgcatgttgagcagtctggagtggggtcaagcaaagcatggccatggccttgtggttgcgtctcgtaggtcccttcaggagctggtaccagcacagggtgaaccgatctgtgtatctgaccatcgctcctcaatgggtccagagaccccaagaacctcatttcagagaatgaggccttggctaagtggtgctaaaaagcaatttccatctaaacacctggttgataatatggacacaggagaagatacgctgtcttcagatctactgataatgaacgaggttcctaacttagggagaaagtgtttaggtaaagaaatgttttgtagcttcagtggtggataaggaggggcctgttgtcatatctgtagattacctgtatctgtgtacattttaagtttgtattacttgtgtttccacacatggttcaaatttcatatttatgtatatatacatatatatgtgactgtgacgcatgcgcatgcacacacacacacacactcttcaagcttctcatgtgagtgagtgtctctccttgcggtggcagcattaggagcacatggcctggcaactgcttcctgtggtggagcccagttgcccctgactcccttgctgtttgttgaagctggagcagtaaccagactattgtgcttataactgcttttcaagtacgtaagagtaggttcacctctgagtggaaggaatggtgaagactttctgtgtttctgtccttgatacccccttgcagttgttaggctgccacaaagtgggagactgtctccttggagtttgagaagggagctagcatgtgttttgtgacaggactttgtatacctcatctcactcagttttcctaccaaact

SEQ ID NO: 43702 - DNA, 1379 bp, Homo sapiens
ctaatttgtaagatgggaccaaacaacattagaacatttcgttctttggacaatgaggaaatgattggcagtttctttgtggttgcccattctgggaatacagaagtgtgtaagacatagccggggcttaaaggatgtacccaagtaatagaggaaggagaattgtacctgttgtttaatgactctaaataaggaaacacctgacccctctgtctgtggacacagagttggaatttgagtccttcactgccaaggacatcattgcttcactgcaacttttctctttttttaaagaaaaaaaagctacttggtattgtgaaaaaatagctataaggttatattttgctttacttgtcccttcagaacttcactaaaagaaaagtaaattttatataaatgtattttatttttcgacattgtgaaggtgttaattccaattaaattggtctttgaggtcaggttcttggcatttgcagggtacttatatggatttttcagctttctaaggcgtaaatgtggcctttgtagcttgtgcagtatgaggggtgagtgccagggcatctagagaaacaacttaatcctgagagcgctatctttacctaaggtgggtgaaatgggattaaaaataaccctacccaaggaggacattgagggcagcttctgaggagaggctttatggagaacaagctgtgtgtttggaggccaggtataagtaatgtcggggaaggagagggggcggtaccctgtcaccccacctcatcactctgtcaccttgtcaccctggcattctcccccatagtccatcccccatcatccggtcactctgggccctgtcaccctggctcgcatcactggttctgtcacctcttcaccctggactcccctttcttgagtgcttgtcacagggctttgaagctgttgctgcccatgtgcccccatcaactatgttctcctggcagatgggaatgtgctttctgtggctttgaaatcttcgaacacatggaatttcccaccttgctgcaagctcatgggactacagatgctctcagagctgctctgtctgtgccatccaacatctttgccctgacacttctttggtgccaggcggggttaccctggggccttccaggggacctttctatcaccttaggaagccgctttggatcttggaatgacccttgcaggaagtccttgaacgtaagtttatggccagtccttggcctcctgagtgggcatgagagtgggcagggcagaggggctgtggcgtggtgcaggttaagggttcggggctcagctggtgggggacagcctgggaagctgggagctactgggcccgtggtacaccctgcctctggggtgcaggagagacaggagaggag

SEQ ID NO: 43703 - DNA, 1033 bp, Homo sapiens
tgctttcattttcatgttcaacctacagaaaaacctaaatcatcccctttcaatcttagccagcttgctcacagaacttcacaagatcagcccttcacacaccctcagctctgtttctgcaaaaaaaaatatcattaggatattgatagggactgcattgaatttgtagattgctttaggtagtatttcatcttaacaatattagttcctccaacacagcatgtcttaccgtttatttatgtctttattcttttagcaatgttttagttttcagtgtacaagtagttcacctctttgattacatgtatttctaagtattttgttatttttgatgctattgtaaatggaattgttttcttaattatctattggattgttcttaatttataaacacaaatggtttttgcgtgttcactttgtatcctgtacctttgctgaactcatttactagctctgatagttttttattatggaatctttagggtttttacatataagattatgtcatatgtcatctctgaaccttgatgattttagttcctcctttccaatttggatcccttttatttctttttcttgtctcagtgctctggcgaggacttccaatactatgttgaatagaagtggtgaaagttggcgtctttgtcttgttcctgatctcaggggagaagcttttcatctttcaccattaagcatgatgttagctgtggattggttacattttattagagaccagagatagcccagccctcttactgtatctaactatagtttacttgtcccaaggaaactgttccactgggcttatgggacacacattttcctggcggagaagccatctcctttggcaaatactttcaaaggtgatatttaggtaataaaattggcatattaagtgatatttttgacagtcttaacacacattaagtttgaaacttcagggagaaaataagaacatatttctatatgtcaaacacatccaggaattccagaaggcatattagtgagggccagtgagtctccacggatgagc

SEQ ID NO: 43704 - DNA, 1107 bp, Homo sapiens
aaggaaatatgagagtggattgcatgggttcttagcatgcacttagtacgttgccatgtgtgatgagccacatgccatgcgggatagacaaggtgagcatggattggtcacggatgtgtcatttggtcatctgcttactggcattgggttagaagatgtctatttgactatcttttcagaagggagggtaaacgctctacagtttaaatccaccataaacataatttgcaattagctgcgaggtgagggcctaagagtatcatctacagtctgctagactctagagtttcagttaggaacacccaatgtacttttcagaaaaagtgttattgggtgcaacatttttgaagtttatgacagttgtatcattttaatttaactagtacaagttgccctaacatggaaaaacaaaaaacaacccatataatcggaaacacaaagacgttcaacttcagctgctggatccagaagtgtaaatattggcattgttaagaaaaatgttgactttagaatgagtaaacttttgactctgcttgaacgatttttctgaactatagtccaataaagaagtttaagctttatcatgaagattatttaaattttcattaattaaaataaacaaattttaatatattatttataatgataatcttgcaaaggagggtttaaccttcgacattaaaagaacaatgtgaaaccaccacagcaagccaaacttgttagtaggcccttttaatcaagggaagcaaaaagacaacagatattgatacaatttcttaatcatctgacaacggttaatgagaaagtctttagttattatagacagaaagctgctatctatctactggcttataaaactattcctcattatctgtgaatatgaatcacatattttgataaatcagctgatgatttagaatctgaactctttaaagtagcacagtagatgatccagttgtataactgtaggatgttcagaagtgagctttttatctgggcatggtggtgaactcctctagtcccataagtcccagctgcctgggaggctaaggattgcttgatcccatgaatttgaggctgcagcaagctttgatcacaccactgctc

SEQ ID NO: 43705 - DNA, 1079 bp, Homo sapiens
ttctccatgccaatattcccagggtgcataaaggtaggatgctttgatctctggagcacctgatactgctccctccctgccgtccttttctttgactccagcctgccggcctgtgatggttctacgcggtttcttttcttttccatgaagtcctgtggtcgtggtgttgcagcgcctgcgtcctaatctctacgattgaggcagtactctgacctgttccacagtgtgtctagacttcattgtgcacatgggttcctcttctctgcacatgcctaccacagagcaggggtatccactctcggtgaatgcggcttgagaaggctgcatgtggaggtggccttcatcaccccacctcttttcagggctagaaaattggtgttttcctctggtgaggcttttaggatggagggattcgaggacctcctgcctgtggatagcctaggctgttttctgtggttacctttgctcaagttttctgttgactttctgggtctcagatcagttggatcactgcattaacagtcctgccctgggcattcatgtctgtgtgtggaccacagcacggcaaaagggaagaccttctctctgacaccagtgctagtggtgagggtgcctagaaagtgaaaattagtttctggtgtcggcctctcctggttctcctgagtaggatcttgctgttggggttctgtgctgtccccttcaggactcaggctctggatttgcggagagcatatctcaaattaactatgcagctgtgcaacaggagtaactgctggccaagttacttggattctttctcatcggttgagtggggatgctgctagtgtgtctgcacaggtttcttgaggggacttgatgcttcccacaaatgacagtagggatgtggccaccgtaaagtggtgctgtgcttcgcagcactgcgtgatctgacccacgcttacgtttcaaagccattgaaacagattcaagatcatgtattgatttaaaaaatttactcttttctgtcgggaggctgaccagactactgaagtggaaggaactgtagatgcttgaatagaatatgccacacaagtcttttt

SEQ ID NO: 43706 - DNA, 1032 bp, Homo sapiens
agtctcataatcatgtatcacatatctccccttttggtcctaaaaagaccagcatcccctttaaacattagcaagcttcatagcttgcaggtggctggtgtgtttcacacctgaaaatgggagaattatttggcatgttgtagttaatgatgagtatacatttgtttaacgtttgctatacgttgaaccctgtcctaagcctttatatgcattagctcatttaatcctaataaaagctccgtgagagagatactattttcatgctgattttatagctgggaacactgaaccccaatgactcaataatttgcccagacatcagccgctaaggggtggcatctggagatgaaccaagactctctggtgcctggatttttagcaagcatgttcagcgggacctgtttcaaaaaacagccatttgactggtcttcttatatctgggcccaggacttcttgatgtcaggtaagaggcaggggcaggtttcattttcaccgtttaacaattaggaaaatttagcttctgactcttccatggagggatctgttgagatcacccacgttgcaggcaggggacctcctccagcccaacagcgataggaggctcctggatggcacccttgctgcatgccagtcacactgctaagccattctctgtgtatttcatttaaacatgttggaatccagtggcattccaatgcagtgtattaaaatcctcagtgaggtgggtttcatccccatgctctgcagtgggaccagagcctgggaagaccagtgagttgcccaggtcactataaagtctcctccggtaggggtttcaattggtctccaccctcttctccatgcctagaacccacctgtgaactgagggctctgcgccttgagctctcagttcataggacttgagtgatgaatcaaagatcagagccagaattggaaccccaggtctgcctgctctgcacccctctcgtggaacacatgtgctccatgcagagtgcccagcggaatctctgctgagaacagtaccaggcattg

SEQ ID NO: 43707 - DNA, 1626 bp, Homo sapiens
gggggaggtgccacacacttaaacaaccaggtctcttgagaactccatcacaacagcaccacgaggatggtgctaaaccattcatgaaggatccaccaccacagtccagtcaccttccaccaggctccacctccaacactgggggttacaatttgaaatgagatttggtagggacacagaaccaaaccatatcagacagttcttaaaaatctttttcaatttaacatttacacctcgtttctgtttcttcactgtgttttctagaaccctagaacagttacatctgatactgccattgtgagctttccggccctaatgttaatggggatgtcatttttgcttcttcattacctgtgccacttgcctgctggaagttttggatagatgctttttatcaggttaagggggttccttatttatacctcaccactaaaatctttcattcctggcatgcaggggattttaaaagaaattctgttatcttctatgctttggatttcaggctcactctagtagattttcttttccctaaaaggaaatgataaaatctgttccagcaagtgattgaaagaatcaaaatgaagagaaactttacaattattgtaaaagttttctatttttttccttatggtagaaatgatattttattaaaatcacaaaccgtgtggcagggattcatacatccaggtatctgttgacttgcatcttcgctctgccattgattaactgtgtggccttggcatataattaccgtctcctagccttggtttctgcatctgtaaaatgaggtaacagtgctgcctcaaaggattgatatctagttgttcttaattaaaacccacctatctttgcatgttgtgttttgtgtctcacatgcctttacttccttcaatttgatcttcaaaaagccctcccatgagagattgtaaagcatttggtaagattctgacaggtaataggttgtcaatcaagggtggctgccattgccctgagtacagttatcatagctgtcaccaccatcttgggtggcatcatctggagagtcaggaatggctgtgagccctgggattctagtcccagggatcctgtgtgctcgattgtggagtgaagacacgtgcccactcttgtttcagtgtagcttgtatagcacatggtgccatgataaaaatactcatgttcgtatttgcagatttgactcttctggatgaacagtagcatgtatttttgtgccaagtacacactattttaactacttttgctttagggtgcattttactagatgatgagtaattctcccttaatgctctatgattgaccatcttaccgcttattttattttgttagttttaggattattccactagttctaagaaaaaaactgcttgaatttagatagatacatactacatttcatttataaagttgttttggatatttatattacttttaagagaattaatccttatgatgtttaatctttccatttaggaacttagcgtgtttccattcatttaggtctttttatatctcctaagtgctatgatattttatggtttgtataggattattcttagggctaacctaaaatatgcatacctatgtatataaactattgtgagtgtggtc

SEQ ID NO: 43708 - DNA, 1662 bp, Homo sapiens
gctagttttttctttctttagttccgggatacatgtgtagaacgtgcaggtttgctacataggtatacgtgtaccatggtggtttgctacatctatcaacctgtcatctagattttaagccccccaagcattaactatttgtcctgatgttttccctcccctcagtccctctcccctccctgacaggccctggtgtgtgttattcccctccctgtgtccatgtgctctcattgtttagctcccacttatgagtgagaacatgcagtgtttggttttctgttcctgtgttagtttgttgaggatgatggcttccagcttcatccatgtccctgcaaaggacatgatctcattcctttttgtggctgcatagtattccacggtgtatatgtaccacattttctttatccagtctatcattaatgggcatttgggttggttccatgtctttgcttttgtaagtagtgctgcaataaacataggtgtgcatgtatctttatgggctagttttttcatacagtcctctcttaaaaaaaaaagctgtattgaggtataattcacataccatacaatttactcatttaaatttgaagtatataattcaattataattagtatatttacagatatgtgcaatggtgtgtgtgtgtgtgtgtgtgtgtgtgtgtatacagattgctgtggtctgaatgtatcacccaaaattcatgtgttgaaacctaatggccaacgtgatgttattaagaggtggggcctttaggaggtgtttaagtcataagagtggacatagatgggattagggcccttttaaaagggcctgagggggaatgggtttgctctcttctgctcttccaccatatgaggatacagcatttgttcccctctggagggtgtggcaacaaggcaccatcttggaagcagagagaggccctcaccagacactgaaccccagtgccttgatcttggacttcctctcttccagaaccatgagaagtaaatttctattatttataaattacctaacctgtggattttgttatagcagcacagacagaaattgatactgagagtgggtgttgttatagcaaatacttaaaagaaaagtggaattgggtaatgggtagaggatggaacagtttggaagtgtttgctagaaaaagcctaaatttctgtgaacagagcattaagaatgattctggtgagggcccagaagaagaggagagccgtagagataaccagtgtcttcttagaaacttctaagtggctgtgatcagaatgctggtagtattatagacagtaaagcccgttctgctgtggtcgtatatggaaatgaatatcttattggaaactggaggaaagacagtccttgctacaaaggcgcaaagaacttggctgaattgtgcccatactctagggctttggggaaggcagaatttaagagtgacaacctaggatatttggtggaagaaatccgtgagcatagtattcagtatgctgcatgacttctcttaattgcttacagtaaaatgtgagagaaatgaattgaaaatggaatttataatccaaagggaagcagaggctgggcactatggctcatgcctgtaatcccagcactttgagaggccaaggtgagaggattgcttaagctcaggagttcaagaccag

SEQ ID NO: 43709 - DNA, 1027 bp, Homo sapiens
atggtacagtccctgccagggtgctggggggacctcgtctgcggagccggcacacaggtggctatgggcgggggagactgcagtctaaacccgcaaagctctccttcctagcccagtgaggggaagcgtgggtgtctttcctcattgttctttttaagtctgaaaggcagcgactgcagggattatgacgtgctggcggccagggcctcgggtgctgcctggagtctcctgcgtgtctctgctcctttgatgtcagcatcgggggtgggagcagggcccacgcattccccctttggcctgggtgggaacaggggaggtggtgggcagggccagaagggcttactgggattttctttctctctgtcactccagagaaaggtggtaaagaacacttgtttcagtttgaggtgctcggcagccacgcgctgaaggacggtttttaattgtagggtggggtgtgagtgcagtgtggttcagtcccctccccatcttgtgctacctgccgttgtacctggacctgtgaatcagggataatagttactatcttgtaggactgagaatggtgcatactaactgctgaggaacatggtgaatggagttatggtaattgcacgattggcatgaaggggtgagagaagttccagattggtcgattaaaatgtgagttatttttagtgtctcctaaggatttccatcaccagttgctcctccagccatcatgtaattaccaccccagaactaggcttccaaacttcgagagaacactgcatctttcgaattttggaggttaggctccaaaatttgcatatttaggccacagcctaaattcactgacacttgtgttcccacaaaagccaggcagcttcttggagtatgtacttgtgacttagtaagaatgtcttaggaaactcgcttggactagaatggttttacctttctttcagacttgggaggctgcattctgataattctcaggaggaagaatgtataggagagaccagggtttttaaggtgtgacctctgaacc

SEQ ID NO: 43710 - DNA, 1035 bp, Homo sapiens
gttcactatgtgacatcttctctgaggggtgcgcagttagagtcaaaagcgctaacaccttcaatgtttcttgcagtagccaggccatatgtggtcagcccggactgtgagaaaagaaagccttgtgttaccctttgtgttgtgttgaaaactgctcttggctgctttcagaaccagccttaactctgcttttgtttgatcgacttaaacatattggaattttgtggtcatgaccaccgtggaacctctccttttggagtgcatatctgcactttttccagcctcctcctccagtgaccttcaggggcctgacctggcctccgagcagttggactagggtagcttttccactctttgaaccccagactgagatggggttttcccagcgccctgccccttaacgtgtgtgaatgcagtataggatctcagtttcagaatccattgtccactgttgactgttaggttcttactgctgtctacaatgtctagcttttcctaccatgttctctgctagaggggagtagaaaatctgcttactgcttactgtggccttgtaaacggcagtgaatatctccaaacgttctgttttgcttccatcattgcaggctcgtgtgtatgtctgtggtgtatgtgtgtgcgggggtgggggagtatgtgtgatgtgtgtgtgtggtgtatgtgtgtgtgtggtgtgtatgtatgtgtgtggtgtgtatgtatgtgagtgggtgggtgggatgtgtgtggtgtgtgtgtgaggtgtgtgtggggtgtgtgtgtgtgtgaagtgactagcacatagcagatgcttggtatgtataggatctgttctttccctcgctgactctcagtttaaatgggaccctactttgtcctcgttgttcagtaacgttatgcctgtggcttccagaaagagcctctcccttcctggttcttgctctgacattttggggagaagggtgagacgagagtgatcctggaagagtagaactggccggccctgcaggtggaaggttgctcgagcaggcggcatct

SEQ ID NO: 43711 - DNA, 1049 bp, Homo sapiens
agaccttgcatgtctgggaaaatgtccatctactctcacagtttacggtttgtctgaatatggatttctaaattaaagatagttttccctaaaacatttagaggcttccattgcctttaggcagaatggggttgagaaagaagctcttctgattcttgattctgtgtatgaaagagtaccagagtggttttttggtttgttttttgttttgttttgtcatgtctggacacttgtaggatattctctgtgcctttgttccgaagttccttgaagatgagtcttgttgggtctccactttgtgtgtggggtatgttgagggcccattgaagctggaatctcagatctttctggtcttggacatgtttttgaattaatcctttcatttcttttcttccattttcctcttctctctttctaggatggcagttatttggtttttagccacctggattggttctctgtattttttatctaatagtctgtgtctgttgtgttgtttttaggttttgggatatgtcctcaatttgaccttttaacttttctgttggattttgtttctattttcattttgaatttcttaggatctctctctatatatatatttatattctttttaaaaaacagactttagagcagtttcaggtttacagcaaaactgaatggaaggtccagagatttcctacatgccctctgccccacacacgcacagcctctcccactactgggaatcctgtacatttgttacagttgactattgacacattattgacattcaaagtgagtattctttttttaatggcataatattcttatttcatagatacgtctatctcatttgtagatattaatttttaaaaactttttgtgtatcgtttcttctctcccatttgtaaatgatttacttttaatttttctgtttgtttgtgtccagcttacccggaaagcagagcctatggcaaagccttctgtgcttctattgtaggagggtgtgccagcctggtggagggaggctggaaggagggaacctgggtgcagggtgaggcggggtg

SEQ ID NO: 43712 - DNA, 1049 bp, Homo sapiens
tttgtaagatttatccatgatgatatctgtgttgttcattcatttatttacctgttttcctgataatgaacacttagattgttctagtttttcagggctagaaacaatgagcaagaaacatatgtctctatttacatgtagagacttttctagaagaggaaagtgacaggaaagagactcatcttcagctttatgggatacctgaaatgcttatgcagttggcgggccccccagtgtctgcaaggtccccttgttgcacaccgatgccagtgattaaggtcagtagacatcttgagctttgccagcatgtaggcgtcagatggcatctcatgtagctttcatttacatttctctgattaggaaggatgagcatcttgtcatatattcattagcaatttgggccttatattggattaattgccgtttcatagcctttgctcttttaaaaaacatgccacgtttggcctggcatggtggctcatgcccgtaatcccaacattttgagaggctgaaacaggaggattgcttgagcccaggagttcaagaccagcatggtcaatatagtgagaccttttctctacaaaaaaaatttaaaaattagctgagtgtggtagcatgtgcctgtagtcccagctactctggaggctgagatgggaggattgcttgagcccaggaggtgaaggttgcagtgagttgagattgtaccactatactccatcctgggcaatagaacaagactcagtctcaaaaagaattgaattaaattaaacattgttatgtttactttttttgattattaaattctcctttgtcagttatttacacatggaacatttctaagcctgtggcttgaacttaattaatgttttcttttcttgtacaatgattgtctttacattctaatattatttaatttttcctttttctctcagatgtatataatctttgcctatttaagagatccttcccgtaccctaaaagactaaagatagtctgaatttcttgtaaaactgctctctcacatttgggccctcttgtacctggggttt

SEQ ID NO: 43713 - DNA, 1105 bp, Homo sapiens
accaaccatgagggaagtgatgcttatgatatggttcttacaggaggcagaatcatatctgttggatcaataggccctttccacagctggcatacaaaaagactaaatggaaaggaagaaaacaataacaatatgctttggctgatagaacgcttgctatgcagtgttaaatctccaggggctggaaaatgaatgataatggcagatatttatttcaccgcaagtgtgcgttcacattttgccatttattttccccccgcagtttattgctgtgcgtcattccctactcaggccaagcgcttctgatggacgggcctcttcctgacctcggacctttcccagtgtctcttctgccctggctctgattttcctgttgttcttcctcctttcaggataaaagggctcattgtatacccagaatttacttcctttggggtttacatataaatgcattaataacagagatttgtttgattgaggtttatatttttttgaaggaggtaaattatatgcaaattttaggttgataatattcacctgtctgaaattcactgatacttggaaatgttcctgtgaagaactctgctttattttaattcattattaattcatgtttttcttattggatattcagttccagaatttattgccaatttttcttaaaactagattgtatccataaattgaccagtatagtcaatttggatagaactgaaactttctgtctacctggtaaaactaagtgcctaaaaacatgaactataaatgtagttactaggaactcacaacttatatatactatccattcaatgatacataggacccaatgtctttgtgtttttgaggttttcctgttactgtgtactttgccattttacatagttcactaaaaagaaagaagtgggagaagaagggtgttctattcattattctatattatgattctcttcattattctgttctcttcattattctattcatttcttcacccatttattcactaaacagtgacatagtacttacttgatgctaggtattacaccagttttgtgggctataagagtgaataacaagcacgtgacctctggccttggattttactacc

SEQ ID NO: 43714 - DNA, 1193 bp, Homo sapiens
aactgtgtgctcagatgttcagtgccatgtatatgtggggcttctgaactcttttgaacaaatacatggtttgtatcaagagttcagaagaggtggagcaaccaccttccccgggtgtatgtggctctaagaggccacctctcggcagccggctctgcagctcacccagcccatgtgcagattgctctgagctgcgtgcctgctcaagccacagctgcacagggcaagttctctgtgcacaccctgtggccacctcaggtgcctgtctctggcaagcctctcactccctccagtgggaattcctcccactgccctctaggcatttatcctttactgtactcactataccatattacacacacctgttatgtgcctcctctactagtttaagctattaatacttggaggcttaactgttttattcatatttatatccgtccttcagataggtgcctgacacatagcataaatttaataaagaaatataccagaatttatctcaccatgtgaattacaagtatcaaattatagtggaatgtgctattctattcagcttcattaaacatgttttccaggctaaagagcatctagtacccagcattttaggtctgtctgtaggacatccctcaagagtcaacagtgcatcaaagacctgttgcagttatacttgagaaagatgtgaaaatctccgtggatttcagcatccagccttggcaccttctcgagtggtttcttggtctggccttgctgctggatgccttcagttgtgtgttggcctctctgaagtggctctcagtgatccccacctcctgtgttcaccccctagcctcttgtagcctcttgccacgaatgctgactgtacttagtgactcctatctaaggaatagaatatggcaaaggtagtgggatgtcacttcttacatccaagattagggttgaaaaggactgtggtctccatcttgggcaccctcgctcacttgctcactctgaggaaagccagccaccacgctgtgagctgctctacggagacccacatggcaaggagctgagggagacttcagccaactgccagcgaggcgctgaggccctttgtccactgatcatgagcctagaaacctgccaacagccacttgagtgaagttgggggcagatccttccccagtagagcctacagatgagaccatagtcctgat

SEQ ID NO: 43715 - DNA, 1097 bp, Homo sapiens
ttactttgcatttctcatatggttagcgatattgaacattttttcatatgtatgttggtcattcgtatctctcttttttttgcaaaatgtctgttcacattctttgcccactttttaattcagttatttagttttttgctattgagtttcagtttcttacatattttggttattagccttttatcagctatatggtttgcaaatattttctaacaaatccatggattgtctcttcactctgttcattgttttctttgctgtgcaggagctatttagtttaatgcattcctatttatgaatttttgtatgtgttaatttaaacaaggaggtgaaagatctgtacactgaaaactatatagcatgctgaaaaattggaaagggcacacaaaaatggaaagatgtttcatgttcatggattaaaataattaatattgttaaaatgtccgtactacccaaagtgatcctacacatttaatgcaatttttatcaaaattccaatgtcttttttcaaagaaatagaaaaaaacaattcttaaattactgtggaaccagaaaagaatccaaatcttgagcaaaaagaacaaaggtggaggcatcacactccctgatttcgaaatgtaaagctattgtagtcaatagctttgactacagcatggtactggctaaaaaacagacatatcaaccaatggaacagtacagaaagcccagaaataaacccaagtgtttatggtcaattgatttttgacaaaggtatcaagaacacacaatggggaaagaacagtctcttcagtaaatgatgttggtaaagtttgatatccacatatggaagaatgaaattggggccttatttcaggccatatacaaaaatctacttaaaatggtttttaaaaagttaaatgtaaggcctgcaactataaagctactagaagaaaacatagagggaagctctatgacattggcctcggcattgatttattgaatgagtcgacttcacttttgaaatatagttttgccagatgaagcagtagtccccaccctttgtggcaccagggaccagttttgtggaagacaatttttccacggaccagtggggcagg

SEQ ID NO: 43716 - DNA, 1096 bp, Homo sapiens
tgggataactattgcggatgcagtagctccttgctttgggaattggttttatgttatgctctttattaatataagagtgggctgcagttaaattcctgacccttgcttaaaatagatctacttgttttttgtcattgtggtttctcttctgtcttaaaaagtgggtttagtaaagaacatgcaaccttttcatagggtaagcaaggagtttgtaatttatagtcagccccttaactgtgttatttcctgacatgaaggattccacaaaggaaacacattagtaattggatgctgataatcccatatggaaaatcagtgaattttttttttttagcttcccttgaattaagaaacataaataaaagttgaagtctgttcttacagattaagacatgagaattggtgctctgagccgttcataggggaaatgttctggcctaccttaaggatggtattaccagcaccccacacagctgctggacagaggccacaatcccatcattttaattgaggcacaagaacagaagatcttttggtcaggtgcagtggctcatgcctgtaatcccagcactttgagaggctgaggtgggcggatcacctgaggtcaggagtttgagaccagcctggccaacctgtctctactaaaagtaaagaaaattagctgggtgtggtggtgcttccctgtaaccccagctactcggaaagttgaggcaggagaatcacttgaacctgggaggcagaggttacaatgagctgagattgtgcctgtgcactccggcctgggcaacagagttgagactccgtcaaaaaaaagaaaagatcttcaaagagccctttacaaaagggtgtcaggtatttagtgtgctaggctgtgtcattatgatatggtcagtgccttgtgtccaaactggtgttcaaggccaagggctagggcagaagaaggcaagccttccttttgcagaagagaggaaatctgcctcatattcagtcctgtgattctgcctttacaggccattgcatcccctttacaacagacaagcttagacctgtgcagggagttttaggtccctgtctgtgtgaaacagcacaggactct

SEQ ID NO: 43717 - DNA, 1076 bp, Homo sapiens
agcctgagagtggaatggtgggacccgggctcctgcagggaatttcatggcctgaccttttgtgcctcggctccagccctttatttagtgtgctacagtatatatagattgagaatgctaatttgttctttgccagctaaagtacccagggcaatatgatgaggagtcaatttaaaggactgctgtcttgggtgggccgcctggaaacactcctgcctttgtgcttgtgcttgatagtgcagctgctacgacagtgtgacatggaattcagggtctcagctgagccacacggcattccagaacacatttcagaaatcctttaagcatgggtgtgttagaacaaggagtaaaaatagagaccaagcttttggtggagagaaggctaggtgctggcccgggtccccaggcctctggttgtgagatctggccttgccctcaggagctgggcttctcaaactctgcacaatctaagggacaaagcaggggctgggctggagtctcatcggtcagctgagtggccgcatcaggtggggcaacattcagggcctgcattgctcctgcatcggcacaccaccttgatgtgaggtcatcggaacctcctgaggtgacaccactgagtgcctggctcactgcagccccgtgattcattgtgagtctctgctctctaccctaagccctgtggagcccttgtttttgccaggaggaagtgatctcggcagagaactttcctagtcgtgccactggtcattgctagagtatgctcagtccccttctttgttctcttccatgggtgaacccaggcctggccaaacttctgagcatgttcctccagaccctcaaatatgcagaccctccctcatgggatgaacacgatgcgggaatgaaagacaactggtctcactgcaagtgaaggaggccctggaggatactgttccacattgtttctctagtttggtccctaataattttataaagaggagatataggaagggctgcattgtggttgttgatgagtttcccagagaatgaatcttaagagtcacacaatgggttggatgttactgtctctgacagta

SEQ ID NO: 43718 - DNA, 1050 bp, Homo sapiens
agacagaggctgccgagggccagacagggcatccttccctgattcagaatgccctctgcttatttgttaatcctattgactttcttctatcaaaggcagacagcgggaggattagtggaaagaaaattgtctcaggaacaagaagctttggaccctggtgccagttgtccaaggtgaaattgctccttctccacgcagcctgcaggcccatcctgatggggcctctccagactttttcagcccagggctgtctgatgatgcttctgccaggtgccagtgttctctgccagtgctgccagacacaggtgcttctgaacacttgactggtgattattgcaactgggagctgagtctttcaccttttaaaattttaatccatttaaacttacatagctgtgtgcggctagttccagtggacagcgaggctccagcctttggatttgccactctttgtttgccaccgcagcttcccaggcctcacctggggtctcaggctttctctctcaccttggcctggagagctttcttgcccctttctcagaatgcctgttgtttaagctgcagctggggctcccccaggaggccttctgagagtatccctctcacaccccacgccctcccctgtccgaaaacctcctatgggattatgattgtccctttacttgcccctctgacccactgaattctgagcagctccttggagccaggactattactttgtaagcttttgtgtcattggtttgtggcctgtgatgcacagaacaacccctgcttccttcttgctggtggagggagttagataacatgatcttaagactcatgtgagctctaaaatcatatgattcagtgttcccagaatattctagagtcctctttcaaaaaaactgtttcttaaattgctgcttaaatcttgtttttgccagcctgtatgagaacagaccgatcaactggcactaacatatttggaactgatgtgcttggactcagcttgccagccatgcagcctagttcggtgcagatttgggaggtgttaagaggtcttattttgag

SEQ ID NO: 43719 - DNA, 1069 bp, Homo sapiens
ttcctgatgcattcagttctttccctcactcatatccagtgtctaatttacttgtccgaacatctttgtccaagaaatgtagacatattatttttaacttctattgttctcactttgtcatttgttaatactttcagtgaagaagcatcaagaaaatgttaatatccttatattttttcagacaagaattacgtgtttaataagcaattttgtgttcaaatctgaggagataaatggtgttaggtcttcgaatattttatataatttaggtgtatgcttgctaattataaaggttagatattgctgtgaaatttgtggctttagtacattattggtggcaggcagattctgttggctcttcactgagattactcctctgttccctgagattaaggcagtgtttgcagtgtgcttgagggaaatttgttttccatctgattctgcaaccgtttattataaaatcaaactttcagtaagcctctgtcttcccacatgataacaaactgatgtggtgaagctgttgctgttgctgaaactaccactcctccttgtgttgtatagaaacaagctagactgggtgcagtgaattaacgagatttcaccctgtggcctacaaacgctcttctagaagattactgaagggagataggttggtgaatgtaaactcactgactctgtgtctggctaaattattaacaggtagttattagttatctttgtgaaaaacacaaatatacgtttttacttggattgaaattgtatgttttttactaggaatttcattaaaacagtgatgtatgacttccttgactcctggggaaagtgttcttttaggaaagaggctgtgtgcaaaaactaacaagtcagacttgatgtgacttttagggagttttagagctcagttgaagtataagaattgacagaatactcagaacacaagtaaaggcaaattgccttttggtgaggttttgaagtatatttaactctctactttatctgtttactttgcgtttgtctgaatatttataggagccatcccagtagtcggctgttacagaacacagggcta

SEQ ID NO: 43720 - DNA, 1086 bp, Homo sapiens
taatttagtcaaatttcaaaaatcctttgcttataataactaaaaaagtgaaagtgtataaagcattttgataagcttccattgactcaaaactataaagattaatagtttaaagtaatgtcaaaagtctagtgtttttgaagcttgcaagaaaaaaatttcattattaatattctctaacatttccttctctcattcatacaatgaattcattactatgtttgaataataaataatttataatggcctttattaatagatttgcagttctttcctttgtaaattcttaaaatagtaaggtgaaaattattctctttgttgagaataggactttttatttaaaaatagattgcctaagtagaattgaataactaaaatttagagtttcaaaatattatctcatgtaatttttttatgctaaaatacaaaaccattttacaaacattgcaattatgattaatttaattgctacttttctgccttgtattgcttatgttttacacacattttgcttaaatatttagtattcttccataacttagttagctaatatcatgagaagaaaaggcttagcagctgaactactattcattttcttgctttgccagatgtaacatagccaagaaagatagaaaaaaggtgataggatatatcttcatgtaaacatattaacactctgtttggtaagtatacaaatagtatttgctagtaagagagttcttacttacggaatgttttcaaaggtatgtccttgagtgtctaggattgattataataaaccaacctggaatcgatggttttatggagaaagatcccctaataaaaatgccacgtaagttctgtaaatacctgagtatacaatggtgaaatttcatagctaagacagattcactttatgttagtaatgtggctgccaacattaccttttcaaataacctctttatttgaatcactgagaattaatcctagggcaacaggaaaggacctgggttgctatgccagctagatctctcctgcttcttctgtgcctgtgtttgcttctatcctggaaattattagcccagcttggtattggttgagatctta

SEQ ID NO: 43721 - DNA, 1051 bp, Homo sapiens
aagacactggcttctgcgtagtttaaaataaaatatggaaagtaattgttggatctcaacactgatggttccttaggagcggtgaggggactgtagaatgagaaatggatgggactgcagagtgagaaaaggaatggatgtgttaccaattgcgtaaccttttttaaccttttaatagagataggctttttatattgcgtgtgctgttctttgtcagtgaagatatcatgagtaagatctgtgcttttcttattgcctttgataattaactgaaatttccaaaaataatatcaatttaggctttggagtttgttttttgttttattttaggaggtggaattgacccatgttagacgtgaattcagtggctggtctcatttacatctttatataaatgagcaagtgcttattgtatgagaaccaataccagtgagtatcttttttgttttaaacaggcagtcatggatcaggtaatgcagtttgttgagccaagtcggcagtttgtaaaggactccattcggctggttaaaagatgcactaaacctgatagaaaaggtaattgcttgactatgagagaaaaaattaaatctttgcattttctaagccttttgtttgattaacatcttgattaatagcccttgcattactttgatcaacatttttattgattgatcctgcgcgacagctttttaacgttgtcacttcttcctaaattttttactcgtctaaatttttatgtattttcaaatggtgtaagattatttattacagccttatgttccatgtaacattttagttagtaacattttatgacttttagtatcttacatattttctctttggaaaagctttgaagtctccctactcagctcccaccccaacgaacaaaaccttaacatgaaaccaacaatatagtttttgccaaactagaaagttaattttgttatttatcatgattcatgtgttaaatttgtctacttttattcattcattgagttaggagctggtaatataatagagaatataacatgtatataatatagtatatagt

SEQ ID NO: 43722 - DNA, 1059 bp, Homo sapiens
tcaataaatgtgatgacatcagtggaatgaaggaaaaaactttatgattatctcaatagatgcagaaaattgtttgataaattcagtatcccttcatgataaaaaaaaactctcaacaaattagacatacaaggaacatacctcaacataataaaggccatatatgacagattcacagctgacatcatactaaatggggaaaagctgaaagaccttcttctaaaaactggaaccagagcaggatgcccacattcaccactcttattcaacatagcactagaagttctagccagagcaatcaggcaagagaaataaataaaaagcatctaaattggaaaagagtaagtcaaattgtctctttctgtagatagcatgatcttatatatagacaacctaaagactttaccaagaaaaacccttacaactgataaattcagtaaaatatcagaatataatattagtagtattttgatgcatcaatgatgaaaaagctgaaaaagaaatcaggaagacaatcccatttacaataattaaaagataaaatacctcggatctaaccaaaaaggtgaaaggtctctacaagggaaactacaaaacactaatgaaagaaataaacaaatggaaagacattccatgtgcatgaatcagaagaattaatatcattaaaatgtttacccaaagtaaacttgattcaaagcaatctctatcaaaatactattgtcatttgtcacagaaattgaaaacaaaaataccaaagttcatatgaaatcaaaaaagaatcagaatagccaaagcaaccctgagcaaaaaagaaaaagctggaagcatcacactacttaacttcaaaacattacagggctatggtaacccaaagagcatagtattgatataaacagacacacagaccaatggaacagaatagaaaacccagaaataaatacatatatttaccaccaactgattttcaccaaaggtgccaagaatgtgtatcagggaagggataccctcttcgataaagggtactgagaaaactgaatattcatctgcaaaataatgaaa

SEQ ID NO: 43723 - DNA, 1030 bp, Homo sapiens
tgccaggtttgaggcacaggacttgcacacggccagtgcagaagtcccataagaacataacctacccaaggccagctcacctctctgttacatatgctcatgagattagtgctatagactcagtgtgccacttccctgcacatgcgagggacgacagtgtcctgacacagcagtgaacccagtgtggtgccaaggagaaagttgtttttttggggccagccagcacacatggggtggcttgtccaataccctcaccggtccagatatttaatactcaaaaactgtcttctccaaagctgtcttctccactgtccatcaagttggggtcatgaagcatttttcttaaaggggaatgagtagaaattgcttagctatattctactccatccagtcttgctcaaggagaggtctgctgcaagcaagagacggcggctacacccctactggaagtgcttgacctgcaggaggcacagctgccctagagttaaccttgaggggtacgttatttttgatctctgaagcccactgtggtttctgctgccttggtggagaaggcagtgcaggtacaggagactcacatccagcccagctcgccctgctgctgggggcctcaggcggtggggatgcaggagaggctggcgggctgccattgcacactgctgccggcctggcctctggacacatggccagtgtgcagggtgctgtcccggggatggtgatggctgcacttcattcattccatccacaggtgtctgtggagggcccacgacgtgtcagttgtggtgcgttgtggtgtgcaggacagggaaggtacctatgcctcatgcagcagtggtatagtcatgtgagagtgactagtcatttctgaagcatcttcaacatcacattaaaaaaaaacttaaattaggccgggcacggttgctcatgctggtaatcccagcactctgggaggccgagtcgggctgatctcctgagctcaggagttcgagaccaccctgggcaacatggtgaaaccccgtctctactaaaa

SEQ ID NO: 43724 - DNA, 1101 bp, Homo sapiens
aatgccctaaccaaattttcccgaaagctctattatttttagtattgaattttgtaaaacctgagattcctcaggcatatatattgtagtctagcagaaacactatatattctagcatatagggtaattggataggagatatataataataggaaaacgcgttatttttttaatctgccagaacatacatttttcttacctgtcattattattattattatttgaggtggagtcctgctgtatcaccaggctggagtgcagtggtgcaatctcggctcactgcagtccctgcctcctgagttcaagcaattcttgtgcctcagcctccctagtagctgagattacaggcgtgtgccaccacgcccagctaatttttctatttctagtagatatggggtttcaccatgttggccaggctggtctcgaactcctatcctcaagcaatctgcctgccttggcctcccaaagtgctgggattagaggcgtgagtcacctcgcccagcctcttacctgtcattcttgaggagcccagtgtaggagggaagggctgtgtatctgtgagtgcgggtaaagcacacggaagctggccatgttcgtcatcttggtttcatactgacaagcaggagtcagtgtgccccatggcgtgggggccctggaaggaagcctctgcagctgcagaaagacagaccccacttggaaaataaaacagcagcataaggacttgggctctaattacagagttgtcaggttgaagagaagtggttgtgggataacaggaagagaaaatattttggttcttctcagcataatgaattttcatcagtacgcctatttccttgtttagctttttgcgcaaatgtggacctttcgcctcctcctgtgtgctcttccttaaaaccctatttctccaattgttttatagatcagctttgtcagagcttgggcgtcagaggtcattgctgttcttgtattgacttgttcatttgttctttatccattcacttgttccctgcatattttgaaagtgttttgcattgcattgaactggagacaggggatacaaaagacaagccctgcttttgtcactcagtcctgtggccc

SEQ ID NO: 43725 - DNA, 1020 bp, Homo sapiens
aaccgtgactcgcagcatcttgcagacgtaggtcggaatgcggctttagcatattctgaaatatacagctctagaaatgctaaatctattggagatgtctctctaaaacagaaattggggggcagtggcaatctttgcagtgctttatttctagcattcttttgtaatctgaagtatcataccaagtacattttaaacagtggattgtctttaatttacctttttaataaaatgctgacactcagtgtatatagagatatgaaaggctatgaaaaaatagaaaaatagatgttttaaagaaatagaaagtcatgagaaagggggcggctctccctgtaatgcattgtctgccccgatatcccagcttttcatgggttaagctgtgtcttctcatccttctttctgcctttgtgagagcttctcaacaacatgcagattcctgagtactgacaaactttttcttgcttctatttgcagtgcacagaagccaaaaagcattgctggtatttcgaaggactctatccaacctattatatgtaagtatttgcacctttctgtggtttcattctgtggccatacctttctctgggaattgtcttgctaaagttctgggtgtgggatggggaaagcccggcgtggcccagcctctgctgcggtgccaggcttgcctcactgggggatgagcaggtgacctcaccgtggtgtctggcccactcagaccagttacgttgaggacagcctgaaattctgtgccctgttctgtgatgcaggtgagctcacatgtgagggtttaaagggggcgagatgtctgtggaaggcaaaagttatgttggcttatacacattttcctagtcaaagagagaaaggatcataggagcagacttatgagcttgagcaggacaagaaacagtcctcagcggagccactgtgacagtgtgtgtgtgtctgtgcgtatgtgtaggaaatcacaatgatcgcctgtctctgaggcctcctcgccagagagctgctgtcacagcc

SEQ ID NO: 43726 - DNA, 1021 bp, Homo sapiens
ccctgcatggcgttgtatgctggtgttcttttgtgggcaggacacctgcaagagggctacagctggagaaatgggtggggaggagtggctgttgacagctccctgggcccagagagaattgagtcagaattggggaaattgcagagcgagctcaaaagcagaaacccagttgggggaaagtactgagcccagggctctaaatgactaatgcagaaatgatgttaagtttacctccagtcagagtgaaactttgggcagcccccgctccctacacgcagctgcccttcaggggaagtgagaattggcccaagccacaggtgaccatgacaggaccttgcactagctgagacccgagggtttaggaaattatatgagaaatgaagcaagagatgattatcttttgacagccaagtccccagatggaatttagatatttgaactaggcctaaggaatgtctgtctattaagtgtctgtagaaatttctgtcatctgcttgcacttgctgttttactctgctaccattcttttctctctccatctcgtaaaaaaaaaaaaaaagctacatgaaatgatttccttcacggattttaacaagccaggacacagtgacagctattagaaattatagctgacagggctgggagacagctgtacagtttgctggtgaccttgcacaaatgagttgttttgggtggaaaagctgttgcttatttacaacactgaggcagagttgttgcttttggatctgagttttgccatcctccttcctgtgggtgttttcactcatctacctccctacccacccaccacacactgggtacgagaaaaggtaagaagaaaagactgggaggatcagaggatatgaaggtcagtccccagacaacatcatcgaagttcaccccatcactatgttgatgactgaggagggaaagccaggtagggatttaggattaacctgagtgctgttctacattcagcctcccttgctagtctccctgatggggactttcctttggtggg

SEQ ID NO: 43727 - DNA, 1107 bp, Homo sapiens
gatggagtctcgctctgtctcccaggctggagtacaatggcacgatctcggttcactgcaacctctgcttctagggttcaagtgattctcctgcctaaagcttcccaagtagctgggattgtaggcatgcaccaccacgaccggctaactttgtatttttagtagagacgggccttcaccatgttggccaggctggtcttgaactcctgacctcaagtgatctgcccgcctcggcctcccaaagtgctgggatcacaggcatgagccaccatgccagcctgcctgttcttaatcatatgtggaagctaaaatatttgatctcatgaaggtaatgaaaagaagagtggttaccagaggctggaaagggtagtggggagacggggatggagaggagttaattgttggggatgaaaatacagttagaaggaataagatgtggtgttcggtagcacagtagagcaactgtagttaacaaaaattaattatatatttcaaaatagctggaagagaaaatttggaatgttcccaacacaggaagtgataaatatttgaggtggtagatatttctgttactctgatttgatcattacacattgtatgcttgtatcaaaatgtcatgtgtagcccataaatatgtacaactattaggaatccataaaatttgttaaaaaaaatacatgctggatttgtcttatgtttttaaacagctttgttgagatgtcgttcacatgccatcatctcgcccatctatattgtatgatttaatttttgatagagtcacagggtttttcatccatcatcacaatccaattttggaatattttgttcctcctagaagaaatcttgtacctttagcagtcactcctgattctggcccaccctacccaagccctgagcaaccattaatctactctctgtctctaaatttactctttctggacatgtcatataaatggaatcatgtaacgtggtcccttaggacgggcttctcttgtgttatagcatgaatcagtacttcattttcattgctaaataaccggatacaccacatttggttatccattcagcagttgatggacatttggattgtctccactttttggctat

SEQ ID NO: 43728 - DNA, 2015 bp, Homo sapiens
gttttcttgtctgtctgtacttgcaatgccccacagagtacttactaaaccgcatattgattagaacgtctttggccctcagtgataggaaacccaattcaagtagtgcagacttggaggaagttcattatctggcatggttaggagtcctcctgttggaggccccgggcctgagttgttcagaggctctacacaccctctcatttgctccaccttccattctgccattctctgcggacggtcctgcccttgtggttgtgtgtaggttgcagcagctccttacaaaatgcaaatcagtcagcatccagcatgtctttcttatgtatgtgttttgttctgttgtggctgggcagagttacttggccccttccttttcccatccccacaatattccagtattttctaatggggcactcattttgggtggggttggtgttagatgggtcctgaagaatcggaattttcagattggaagtcaagccaacgattgaaatataaacagacataagagccttcttgctagcatatggggtttttttaagtcctttttttttttttgaaacatcttatgtttgagtatttttttaaaactttccaaccttattttatttctccagatgatggtggcaatgtgataaccagcacttagcaggtgcttgttgtgtggcagcattgttttaagtaagcacatggtgtttcatctgtgcagccttcccacccctgccccaggctccgtgctgccctcctgtccattttgcagatgagtggactgtggctcaggagactggggctttctcaagattttctgcagtcggacctagcattcaaacctcagcagattgacttgccaacctaaaataatgaaaggggtcagaatatgatttaaagagcatttaaataagtacaaagtgtgaggtaggccacccagaaacaccaactccgaagaaatggagtcagttttccgaagtaggaagtgaaggcttcatttatgtgggctgagacagtggagtttttagcaggattacaacattattcatacaaggttggtgtgtatgttatagcaatttgattggctctaggtgatgtttctttttggggaggggatatttaacattttcttaacagagggtgtaatagtcctgggttttctttcacctggtctaagcgaagcagggcaatgaagggggagttaatctacaacaagggtcattaattcagagggcgggaggcttttgaccctgacatggtttccctttagtcaatgtacagagcaagaaaaagaagaaaatgagttatctataatctgagaaacataaattgtaaccatatgtgactcagatcacagtcacatttctctcaaagcttgaagtgttttgggggggggttccaacagcttttaggtttatttgttttcacagacttcagagtatgttcttaaagccccaatgtgtgaagtttatataatcatagcatttttctctttgaggttccatcatggcctgtcgtggagggagttcctgttgctggttcacgttatgcattttggttattaagagactgagaaactccatcatgttatcctaagtaatgtgtctttattataaatagaatgtggaaatttggaagatgagaattttggctcatggaatccagaagtggatgaacaggtttgcgaactggaggatggcttagaaaggaactggcaaggctcactgtggccttgagacctggtggaatgagtcagggtcattgtcctgctgggctgaacccctgtctctcccacctcctcctgccttgctaggtagcctgcactcacccagtcctttgtggcaggctgggctcagaaggtctcagaggaagctcagcaggtggctgggagagagcagaggctgcccttagggacactaggtgagtgcagcagctttctgtttcatacattgagtgcttggggcccctcataggtaagcagcagaggggcttccagcacatacccatgttctcattatcatatacag

SEQ ID NO: 43729 - DNA, 1498 bp, Homo sapiens
aacaaaatctgtatcgaaattaatttttaaaacatttcctcagatatacctccaaaaaatttaaaaagactaattgatttatcatttttattgcacatttgattgacactatacatgtattaccaattgaatattattaaacataaacagtaaaatttactggaaataaatttctgagtgagatggacgaggatatttcaagttagggcatgtataactgatggaaatggaaaaagtttcatgttgaacttccgagtgatgtgcccagaccgcatagtaatctacaattaggtcatctttcaatttaattgaaagcaaagaatttgaaaccagttgagatgcaaggcgtgcgttgacaaaaactctccccttgaccaaactttggttgggatcctctgagccctcttctcactaggcctccaccttgccctctgtgtctgtcctcagtggagctcagtttcagcaagagtcctgccaagtcatcccctcacgcttaatatctgatcaccttaggctgtcttcagcaagaattcctccttacttctacccatcatgcctctcctcttagcaattttgtatccgttgaccccctcactctgctccttggctgtgaattcacactgattttggttgtatttggagttgaggtcagtctgtcttgctgttgtgatagattgacccctattgcaatagtcttgaataaagccttaccatttttgacaagtgtcagaacaatttctctttaacagtgtcactaccagtattttcagtggccttagattggtacttgagagagttttttagttctggaccagcacatcccagtaagactagaaatgggagggaggtgtgcctttctttgtaaagggagagaagggtgactgtaaacggggaattagcactgtcacttgaccagcatccggaccagggcctgtgtctcaggcagtcagctttaggaaagcagacccatggaggttgaaggtttggaattcgagtcctttagcagtatggaggagcgcccttggaaagctttcagtatctacagagacctccttgccattctcagcgttggctgtacattagaatgaggtagggagtttcgaacaattacctgcacctggagcctagtcatctttattttttaacagatgcacattgcttctgatgcatagatgaggatcagaagtcttcatccagtacagcagactgaaccgactactgtgggtcctgaaggcaccatactttcacttcctgttttcccattcctttgactgccgtttcaactcccaccatacttgaagaccctcaggtggtgtcatggaaggctactctcattgtccacttgggtatgagttaagtccccgacttgggcaagctactccctaggcaagctactcccacgtgctctgagctcagatactgtaattgcttgtttgtttttttttttttttggaagaggggagcagtctgtgaattcttcttcttttttttttttttt

SEQ ID NO: 43730 - DNA, 1051 bp, Homo sapiens
acactttgggaggcccaggcaggaggattgcttgagcccaggagttggagaccagcttgggcaacataatgaaaccctgtgtctacagaaaatttaaaaattagccaggcatggtgcatgcactgtagtcgcagctactcaagaggctgaggtgggagggtcacttgagcctaggaggtcgaggctgcagtgagctgaggtcacgccattgcactccagcctgagtgacaaagcaagactgtctcaaaaacaaaacaaaacaactacttgatatcagcggaagcttgtcaggtaaacgtccaaagaaaaagaagaaaaaaaatatatatatattgttttagtcacctagaaatacaagccattctaaagattttacttacagaacactaaaagggcgagaaagtaactgattatcttgtggtatgggctgtcccagagggaggctactgcctagggacattgagttaaaaatcttcctcttttttttttttgagatgaaatcgcactctgtcccccaggctggagtgtagtggcatgatctcggctaactgcaacctctgcctcccaggttcaagcgattctcttgcctcagaatcccaagtggctagggttacaggtgcatgtcaccacacctaatttttgtattttcagtagagacagggttttgctttgttggcctggctggtctcgacttcctgacctcaggtgatccgccctccttggcctcccaaagttctgggattacaggtgtgagccactgcacctggcctatattaacacatttttgatgtggctcccatcccaagggttaagaggccaggctgggggcacgcactctcctaggcctcactaaccacagattgtgacacagcctccacctcctgggctcaaacgatcctcctaccttagtctcctgagtagctggggccacaggtgtgtaccaccacactggcaaattttttgatttttttttttttttttttttgtagagacaggatcttgctatgtcgcccaggctggtctggaacttctggtctcaagagatcctcct

SEQ ID NO: 43731 - DNA, 1019 bp, Homo sapiens
tcactctgtcacccagggtggagtggagtggcgcaatcttgcctcactgcaacctccgcctcctgggttcaagtgattctcctgccacagcctcctgagtagctgggattacaggcatgtgccaccacgcccagctaatttttttctgtatttttagtagagacggagtttcaccatgttggtcaagctggtctcgaactcctgacctcgtgatcctcccgcctcggcctcccaaagtgctgggattacaagtgtgagacaccacacccggccaagctattatcatttaagctataaactaaatgtctcccagttttgcttggtccaagcccagctatgattaagggcagtttgaaggctaaaggcaagattggggggtggttaaattacatctcacttgttagagtttttgcaaatgtggtttcatttgtgtgtgtgtgtctgggggttttgttttttttgttgttgttgttttttgagacacagtctcgctctgtcatccaggctgaagtgcagtggcacgatctcggctcactgcaacctccgcctcctgggttctcatttttctttgctggtccatctttcacaagcatgcaaaggtggtttcagagcccatccatggggctgtggcctgaacataaggtggacatgaatttggctcagagggatctgatcctccgagaaatactgatggccacatgggaccctttataagaggggctggtcccacaggctgcccagctctcagcaaactgcccaaaagctgccgtctcagacaatccctgctttgttgtgttagaggagtgagtttgaaatgatacaagaactgcctttcatacgttttgaattctggactcactggaaacagctacggaacagctctcccaggagttacgcacatgcctacactaggatggactcagaaaggcatggctgattgtccgtgtgacgccattgttcattctgattatgaacaccgcttacgtaaacagaaagagctaagaattgggatcatgaag

SEQ ID NO: 43732 - DNA, 1810 bp, Homo sapiens
gggaggctgaggcaggtggatcacctgaggccaggagtttgagaccggcctgggcaacacggtgaaaccccgtctctacaaaaatacaaaaaaattagagacagggtttcaccatgttggcgaggctagtgtcaaactcctgacctcaggtgatccacccacctcagcctcccaaagtgctggattacaggcatgagctaccacacccagccgcctttgagtctttttactgttagcttagataatttataaccaatgttggggttgtctaagtagtgaacattgggctactagtttaatgaggaatgcataaaagtaaaatgaagagatttctcagggagctcccaatctcattttcaagaaatgacaaaatcagccaggagcggtggctcacgcctgtgatcccagcactttgggaggctgaggcgggaggattgcttaagcacagaggttcaagaccagctgagcaacgtggcaaaactctgtctctaaaaatttattcagggattgtggtgtgcacctgtcatcccggctactcaggaggctgaggcaggatgatcacttgagcccagaagttcaaggctgcagtgagccatgacggtgccactgcactccagcctgggtgacagggtgagactctgtctcaagaaacaaaaaaggaatgacaaaattagatgggtgcagtggagcatacctgtaatcccagcactttggaagctgacgcaggaggaggttgagagcagcctggcaacatagcaagaccctacaaaaaataaaaaaaagtagccaggcgaggtggggcatacctggagtcacagctactcaggaggctgaggcatgagaatcacttgaacccaggaggcagaggttgcagtgagtggagattgtgtcactgcactccagcctgggtgacagagcgagactccaaaaaataaataaataaataaaaataaaaatcatttctctctcttttcttccttcttaggatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcacccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttca

SEQ ID NO: 43733 - DNA, 1063 bp, Homo sapiens
tctcggttcactgcaacctctgcctcccgggttcaagtgattctcctgcttcagcctcctcagtagctgagattacaggcgcctgccatcaggcctggctactttttgtatttttagttgagatggggtttcgccatgttggccaggctggtctcaaactcctgacctcaggtgatcctcccgcctcagcctccctaagtgctgggattacaggcatgagccactgtgcccggcctgatgaagcatattttaatctgtttcacagttttgccttgtctggcaagattacctcctggttgttacacttgtatgtgaccactcattagtgtcttctaggcaactatatatatatattttaatgtgatgtgctctagcaaaacaatgtctacaatacagccatctcatgctcacaagtatcaatataggtgtgagtatgaggtggattccaggaccatgaagaggtggcagattttaattaattaactaattaatttttcagagacaagggcttgctctgttacccagactggagtacagtggcatgatcacggctcactgtaacctcgaaatcctgggctcaaatgatcctcccgcctcagcctcccaagtagctgggactataggcatgcaccaccacacccagccagattttagtaaatataaatattttatctgaaatttttaagaatatttaatattttaaagaatacttaatattaaacatttatgaaatacaaataatagcataagttaactcttctagccttccacatttacttacttgagtttcttttcacctcaaacaaaataaattctgttaccacttagatacaaacatttggtgtttaacattttgtttcttttattatgctttttatttgtttatttgtgggtttttttgagatggattctcgctctgttgcccaggctggagtgcagtggcatgatctcagctcactgcaacctctgcctcccaggttcaaacgattcttctgcctcagcctcccgagtagctgggattatccatgcaccaccatgccaggctaatgtttatatttgtagt

SEQ ID NO: 43734 - DNA, 1068 bp, Homo sapiens
tttgtacagattaggtcttagtatgttgcccagggtggtcttgaactcctgggctcaagcgatcctcccacctaggcctcccaaagtgctaggattagaagcatgaggcaccacacccagcttactcatgcaagtttctcctgagtgtcttcctcaggtgggattgctgggtcatagaaattgcacgtgttcagtgttttttgtctgtttgttttttagacggagtctcgctttatcgcccaggctagagtgcagtggcgcgatctccgctcactgcaagctccgcctcttgggttcatgccattctcctccctcagcctcccaagtagctgggactgcaggcgcccaccactacgcccggctaattttttttttttttttttgtattttttgtatttttagtagagacggggtttcaccgtgttagccaggatggtttccatctcctgactttgtgatctgccctcctcggcctcccaaagtgctgggattacaggtgtgagccaccgcacctggccgcatgtgttcaatgttactgaataacaccatattgttttccggagggcttgttccaatttactatactttagaaggctattagcactgaatgacttataaaaagagtacatgattctaatataattagccatgagaaaatttgtggctgggcacggtggctcactcttgtaatcccagcactttgggaggccaaggcgagtggatcacctgaggccaggggttcaagaccagcctatccaacatggtgaaaccccgtctgtactaaaaatacaaaaattagccgggcatggtggtgcatgcttgtaatcccacctacttgggaggctgaggcaggagaatcacttgaacccaggaggcagaggttgcagagagccaagatcacgctactgcactccagcctgggtgacagagcaagactccatctcaaaaaaaaaaaaaaaaaaaaaaaatttgttagcttacaaaaatgtgatctatagaaaacctttcagagctgggtaaagtggatcacacttgggcttgagcccaggagttggagaccaatgagac

SEQ ID NO: 43735 - DNA, 1079 bp, Homo sapiens
atcatgggcatatttccatggtatgacttattttgaatgccaatgtttatattaaatcacatttcaaactgtgttcactgtgttctttcaagacatttatattattttaatgtattggtatttttttttttttgatggagtcttgctctgtcacccaggctggagtgcagtggcacgatctcagctcactgcaagctctgcctcccaggttcacgccattctcctgcctcagcctcccaagtagctgggactacaggcgcccgccaccacgcccagctaatttttttgtatttttagtagatacggggtttcaccatgttagcgaggatggtctcgatctcctgacctcgtgatccgcccacctcggcctcccaaagtgctgggattacaggcgtgagctactgcgcccagccatatattgtttttttttttttaatttttttttttttttttttgagacagagtctttctctgtcaccagggtggagtgcagtggtgcaatctcggcttactgcaacctccacttcctgggttcaagcgatttccctgcttcagcctcacaagtaggtgggactacaggcacgtactaccatgcccagctaattttttgtattttagtagagatgggctttcaccatgttggccaggatggtctcgatctcctgacatcgtgatctgcctgccttggcctcccaaagtgctgggattacaggtgtgagccaccgtgcccggccagcaatgtattggtatttaacgtattgataagaaatattacaattgttagcaaatattttatacacacagatataaaaagcatccgtatacctaccatcctacttaaaggaaaattattataatatcattgattaactacataccttttctcaatctcatttcctttcttactttcagaagtaactactgtcctgaattttatgttgtaaattatcatttatgacattaaatgatagtctctttttaaagtttccagtggctattggagcatcacagtaactgagaatgttcacagtactgctgtgagaattcttatatatgtgtcatttttttttttttttttt

SEQ ID NO: 43736 - DNA, 1065 bp, Homo sapiens
tcacatgatgtcagtttttctcattcctggtgatgttaactttgttcacttggttaatatttgccagattgctctactttaaagttagtagtttttctttgtatttaataagcatttaataagcatcttatgggaaaatatgtgactgttctgtttttcatcataacaatgcctactaatttaagcatccattttttctttttttttttttgagacagggtctcaccctgtcgcccaggctggagtgcagtagctcaatcacacagcttactgcagcctgaacctcctgggctcagcttcctatctcagcctcctgagtagctgagactacagacgtgcaccactatggctggctaatttaaaacttttttttttttttgtagagagaaggtcatgctatgttgtctgggtgagtttcaaacttctgggctcaagcagtcctcctgcctcagcctcccaaagtgctggggttacaggcgtgagccactgtacccagcccatcaataatttttgcctgaaacaattattactgtgatctttgtattgaaagtcctccatggatctgttgtgtgcttacatgtcttgctgtgtgtgccaagaatgcaaggcccaagaatgctctttatctggggcttttctcagggttgtttatacagttgctaatcttcagagacaagttaatgtttcttcctggacaaagagcaggcttgcccactcactacttggtatgaaaacaatagatttcagctgggtgtagtggctgatgtctataatcctagccctttttttttttttttttttgaggtggagtctcactctgctcattctcactctgttgcccaggctggagtgtagtggtgcgataccggctcactgcaacctccaccttctgggttcaagtgattctcctgcctcaacctcttgagtagctgggactacaggctcccgccaccatgcccagctaatttgtgtatgtttgtagagacagggcttcaccatgttggccaggctggtctcgaacccttgacttcaggtgatttgccccctcggcctcccaaagtcctg

SEQ ID NO: 43737 - DNA, 1044 bp, Homo sapiens
cctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaaggtaaatttccaaagagctccacaattgtttccagtatccagtgtcccgccaaataccagggattcagtaacacgtggtattttactttatttattttctttttgtaaacatagggtctcactatgttgcccagggtggtctcaaactcctgagctcaagtgatactcctgagttcaagtgatcctcccgcctcggccttccaaagtgttgggattacaggcgtgagccaccgcgcccggctgtattttatttttaataaataacggaaattgttctgaattcaaaaggcaccaaagggcatgtagtgaaaattaaatcttcctcccacttctagttcaacactagagacaagcaaagttacccctgggtactctatgaattttcggaatgctttctgaatttataaacttacatatgaatataatcatttccccacacaaatggcaattcataatacacactgcagggtgtgttatactttaagtgtcttggagattgtgccatatcaagactaatgggaagtcctcggtaacagcagcgtgatgttctttgtaagaatgactcaactaggggccagggctgggtggctcacgcctgtaatcccagcactttgggaggatgaggcgggggcatcacttgtgcccgggagttcaagaccagtctgggtaacatagcgagactccatctatacaacaaatacaaaaattagccaggcgtggtggtgcacgtctgtgatcccagctacttgggaggctgaggtgggaggattgctggaatctgggaggtggaggttgcagtcagctatgatcttgccactgcacttcagcctgggctacggag

SEQ ID NO: 43738 - DNA, 1060 bp, Homo sapiens
aggttgaagtgagccgagatcacgccgttgaactccagcctgggctacgagagcgaaactccatctcaaaaacaaaaacaaaacaaaacaaaaaaaaccccaaaactcttggcctcacgtgattctcccacctcggcctcccaaagtgctgggattacaggcataagccaccgtgcctggcacagtatagtgatataattgttctattttattattggttgttagtctctgactgtgcctaacttataaacttcatcttaggtatgtacatataggaaaaacatagtaagtataggcttcagtgctatccatggtttcaggcatccactgggggtcttggaacatatcctatgcagataaagagggatgactgtagacatatataaagtagaacaaggggttagcaagagacaggggcttccttagaccgagtggtcaggaaagcatgtccaggaagtgacccaagcagagggtggcaggatgtaaggtcggtcagcaccaaagaccaggtcctgcaggcattttagccatagtaaggagtttggagggtcaagactgggagggtgacatgatctgatttacttttttttttttttttgagacagagttttgctattgtcgcccaggctggagtatagtggtgcgatctcggctcactgcaacctccgtctcctgggttcaagtgattctcctgcctcagtctcccaagtagctgggattacaggcacccaccaccatgcccagcaaattttttatgtgtgtactgttttagtagagacagggttttgccatgttggccagtctggtctcgaactcctgacctcaagtgatccactcgcctcggcctcccaaagtgctgggattacaggcgtgagccactgcgcccaggctgacttccttttgaaaagatctcactgactatctagggacgactgtaatgaggcgggattggaaaaagggaggccagcagtattgaggagagaggcaggtggtagaggttgcatctggggtgtggtccaaagatcaatatcatcatcaccatcaccaccatcatcaccat

SEQ ID NO: 43739 - DNA, 1029 bp, Homo sapiens
ttttgtcgctgctttcataatttggaaggcttctgttttattgagtatacgaagctagcattcttctaacttaatcttttctgtttgcaggattggcctaatgaagaagttcaacctggagagatggaaaatcagctctcataactaagttaatttagtataaaaatagaattgatagtgagggtataaagtgtaaccatcagttaaacctctcctgtcattcctggcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaggtatggttcatttagtctatagtctctggttatgaaattagcatcctcccagatctgacagctccctgaggggttatataaggagtagctcacttgcaaacataacatgctgctcaattcaaaggttctagctgctgtgggtctggagttatgtaagctgagcagtagcaggaaactctgcttaaaatattgtttaaagctgtgcgtgctggcatgtgcctgtaatcccagctacttgggagactgaggcgggagaatcacttgaacccaggaggtggaggttgcagtgaactgagaccatgccactgcactcactgacagagcaagactctgtctcaaaaaaaaaaaaaaaatacattgttttaatcaggtgaatgataaaggaaacaggaataggtctatttggggtgggttccctgtggctaggtcagcactgcgtatcactattcctctactgtttccaagcaagcttgtgcaacccaccttttgttctgttttcttttgctttaggcttttagcagcctggagttatagtttgtctctagtgataagtggaaaagagcgatgaggaaggggttttactggcctaaccataaactgtaactaaacccatgactgcattctctcccttggacgcccctgattgaag

SEQ ID NO: 43740 - DNA, 1027 bp, Homo sapiens
ggaaacatgagtctaatttgatagctaagaaactgaggacaagatactctttgtagcatattttctaatgtcatttcattgtctcaccaagaagtacttgcataaagcaagttggattatagcatctgttgaatatttaaggttgggtaaaatgggtgagtttaacagatattttcccttatttcttttaggggaatctggattgggaaagtcgacattaatcaactcattattcctcacagatttgtattctccagagtacccaggtccttctcatagaactaaaaagactgtacaggtatggatattagtattgttaattgatgataagctggaataatattaatacatacaaagcacatgttgtaacttttattatccttccttagaggtaagatgcaaatttgcccttagccagtgtaagatggtaaatatgacttcataacattaaaaaaaagaagtacagttaatcagaagaattatcttgactagaactttccaaatttgtcctaaggactctcctagagatgaaactgtgacatagtaaccaattctcctggagttgtactatctagtatgatagtcatttgccaaatgtttacatcagttaaatgaattaaattaaaaatgcaatttctcttttgctccagatacatttcaagtgctcaacagccacatgtggcaagtggctgccattttgtgcagcacatatacgaagattttcatcatttcagaaaattgcattggacagtgtagagaaaacatgattcatagaaaagctattgttatttaaatacagtgttctatattagtcagtggggtaatgccatatcatagttgaatagcaatagcaattctgtaagactcccaaggtatatgtgatctaatttactgcttctcagtctttgctatgcattccaatcctgggcatcctgttaaatttagttcttctagtagttctgagatgggctgtgtttctacatttctaacaagatcccaggtgatgctgatgctgctggatggtaga

SEQ ID NO: 43741 - DNA, 1053 bp, Homo sapiens
gaggggagtatagactgcagatggtctgttgctcatctagaacaagagggagaaacaaagctttccttagttccttttctcccttttgtgtgacccagggtggagagcaagagagaaggggcatcctctttctcctccttctctctctcctttgggttcaggctaccatgataggtgctgcaacatggatacaagcgtgacctttacccatgttcctggagaagctagtcggcaggatttagttacacttacctgcttaaaattctagccttttgccctgctggatttctagacccactcagcccaaaaggctcccagggtaccccagatgttggaagaaagtatgtagtagttggatttgggcaagattttttaatgaagggaatgttttaatactatttttggctttccttgctatggccccagtgaagaattaaaaaagcacaaagtaagactgattaacttttatacataaaatttctgtctcgtttgaatgccaatgtaattgaatgcagaacagatgccttaaaagtgtaaaaattgaatggctgcctttctttgttggggacagtattgaagctaagatttgtcttattaggatggcttcctcctggctgttgaaagtggagtttttctgtttacacataggatgtggggcctgattactgatagacataaaagggaaaacaatggaagatgagaggttttgggcaaagggctgacaaggctccccatggagaaaaattctattccattatgtggcactgcaggattagaagtgttaggtaaaaactctgactccaaattctttttaggcaaaagttaggtttggggttggataggctattattatagtatgccccccagcataagaaaatcaactgttcaaactcattggacaatgctgaacttttacatggagggaagaaacaaatggagagggggagggtatttacatgaggtgaccttcccctatacagtgccataaatgtctattactggggacaaaacgcccttactagaaaatttagactgaaatcccaaagtccccct

SEQ ID NO: 43742 - DNA, 1035 bp, Homo sapiens
tgtgagtctgtctggtcttggacttcttttgttgttaattttttaaattacgattttaatctcactgcttgttattggtctgttcagggtttctgatttttcccgatttaagctaggagggttgtacatttgcaggaattaatttatctcctctagatttttgtgtttatgtgtgtaaaggtgttcatagtagccttgaatgatcttttgtatttctgtgatgtcagttgtaatatttcctgttttgtttctaattaagcttaattgaatattctctctttttttcttaatcttgctaatggtccatcaatgttatttatcctttaaaaaaccaggtttatgtttcatttgtctttttttctttttaatcttatttagttctgcactgagctaggttgtttcctttcttctgctgggtttgggtttggtttgttcttgtttctctagttccttgaggtgtgaccttagtatattgtgctctttcagactttttgatgtagacatttaaagctatggactttcctcttagcacggcctttgctgtatctcagaggttttgataggttttgtcactatatcattccattaaaatttttaaatattttttgtcttgattttattgctgacccaatgatcattcagaagcagtttatttaatttccatgtatttgaatggttttaaaggtttttgttgttaactttcaattttattccactgtggtcagagaaagtacttgatatcatttcaattttcttaaatttattgagacttgttttttggcctatcatatgttctgtcttggagaaagtttcacgtcctgattaataaaatgcatagtttgtggtttttggctagaatgttctgtaaacagctgttaagcccatttgttccagggtgtagtttaaatccgttttttctttattgactttctatcttgatgacctgtctagtactgtcagtggagtattgaagtcccccactattattatgtttctgtctatttaatttcttaggtctaatagttattgttttat

SEQ ID NO: 43743 - DNA, 1066 bp, Homo sapiens
tttctcttgtctgattgctctggctaggacttccagtgctatgttgaagaagagttgtgagagtgggtatccttgtcttgttccagttctcaaagggaatgctttcaacttttttcccattcagtattatgttggctgtgggtttgtcatagatgacttttattacgtggaggtatgtcccttgtatgccaattttgctgagagttttaatcataaagagatgctggattttgtcaaatgctttttctgcatctattgagatgatcatgtaagttttaactctgtttatgtggtgtatcacacttattgacttgcatatattaaaccatctctgcatccctggtatgaaactcacttgatcatgatggattatctttttgatatgttgttggattcagttagctggtattttgttaaggattttagcatctatgttcatcagggatataagtctgtagttttcttttttgatcatgtccttttctggttttgatattagcatgatgttggcttcatagaatgaattagggagggttccctcttactctgtcttctggaatagtgtcaataggattggtaccaattcttctttgagtgtctggtagaattctgctgtgaatctgtctggtcttggactttttttgttggtaattctaaaattaccattttaaaagctacttgcttttggtctgttcagggtaggagggttttatttttacaggaatttattcatctcttctaggttttcgagtttatgtgtgtaaaggtattcatcgtagccttgaatgatcttttgtattaatgtggtatcagttgtaatatctcccattttgtttcttattgaggttatttagattttctctcttcttttcttttttttttttgagatggagtctctctctgttgcccaggctggagtgcagtggtacgatctcggctcactgcaagctctgcctcccaggttcaggccattctcctgcctcagcctcccgagtagctgggacgacaggtgcccaccaccatgcccggctaattttttgtatttttagtagagatggggtttccc

SEQ ID NO: 43744 - DNA, 1051 bp, Homo sapiens
caggtgtgagccatggctcacataaatgcatttttgacagggatggctgataaattttcttgctgtgggatgataagcaaataaggaaccttttatttttccatcttactgatgtcactctccctatacatttttactttctattttctatttcaaatttttctgtactttaggttcagacatttaggacaatatgctagaatttacatgatatggttgatgttacttataaatttaagtttgcttcaggcaaacaggaattacaggattttcacccacttaagcatatatctaaataacaacataactaatttctaaatatttgttttatatataagaagtgctaaccatattctgcaaaatatataatttttaaatttagcaatgcaagactattgttttgcttctaaagttggattacagtagttttattttgtgtaagaatagcatatatttaaaacataaatactaatttcttgtaaatttttgtttattataaatttattgttagaatcttttatttataattatactgtttttttcctgaaattttattgcaacacagcgcatgccaatgatttgaaatacctgctttccatgagtacacatagtcaaatattgtaattatctagacaaattttttaatggcacataaatattgcaaagcagattttgtgagtaaacttctttagttattgttttgcagttccatattagtgttttatttagtgtactttttaaacatcagtttattgtgattttttgttttacttatatatttagacattttgcaattctgtttgtaaactttaagtcaacatggggtttaattaaaagataaatcagccgggctcagtggctcatgcctgtaatcccagcactttgggagcccgaggcaggtggatcagaaggtcaggagttcgagaccagcctggccaatatggtgaagccccatctctactaaaaatacaaaaattagcctggtgtggtagcgggtgcctgtagtcccagctacttgggaggctgaggcaggggaatctcttgaacctgg

SEQ ID NO: 43745 - DNA, 1318 bp, Homo sapiens
ccttatggtaaattttttttttttttgagacagtgtctcgctctgtcgcccagtctggagtgcagtggcgcgatcttggctcactgcaagctctacctcccaggttcatgccattctcctgcctcagcctccggagtagctgggactacaggtgactgccactacgcctggctaatttttttgtatttttagtagagacggggttttaccatgtttgccaggatggtctcaatctcctggcctcgtgatccgcccgccttggcctcccaaagtgctcggattacaggcgtgagccactgtacccgtcccgccttatggtaaaatttttaaaattccttacaaattttgaataatagacctttgtcagaagcatattttacaaatattttctttttattgtgtaggttgtttgtttactctattgatagtttgctttgctgtgaagaagctctttagtttctttaggtcccatttatcaagttttgcttttgttgcaattgcttttggcatcttcatcataaaatctttgccagttcctatgtcaataatattttctttatccaattgacataggtattttttagattttctttcagggttttttacaattgtatgttctacatttaggtctttaatcacctggagttgattttttttttatatggtgtaaggaaagcatccagtttcagtcttttacatagtgctagctggttattccagcaccatttattaaatagggaattcttcctgcattgctcttgtgacctttgtggaagatcagatggttgtaggtgtgtggcatgatttctgggctctcttattctgttccattgttctgtagtctgtgtttgtaccagtatcatgctgctttggttactctgttgtataatttgaagtcaggtaatgtaatgccacctgctttgttctttttgcttgtgattgccttggctattcaggtttttggttttttttcggtttcatataaattttaaaatacttttttttttttttttttttagttccgtgaagaatgttattggtagtttgatagaaatagcattaattctgtaaatttcatttggcagtatggccattttaatgatatcagtcttttctatccatgagcataaaatggctgcccattggcttgtgtcatctctgacttctttaagaagcattttgtaatttttgttttagagatttttcacctccctgattaggtgtattcctagacattttattatttttgtggttattgtgaatgggattttttttgatttggccttaggttgaatgttgttgatgttcagagatgtta

SEQ ID NO: 43746 - DNA, 1059 bp, Homo sapiens
atatcagactgttccagatcttctgaaaaaataatctgcattaacgagatctgaagtttatcatacacattaaaacttgcgaggtaccttttaactcaacatgtctttttcatctcaaaaatacacacaactcattctgtatgatgcagatatagcatttaaaaatagacatgttggcgtttatgccctaatttatactttattatccagaaaagtaccatatatacacagatgttgtggatcttcttataccactttcttttctcagggttagataatacattagaaaatatttctgtgttaaaaattcttttatggatagtttcattcactcctataagtcagaaccagttttctttactgttttattttaccttgaaatttaaaattatgcccatggccacttggtaaatgtatgtgattttgtgtatgtgtgtgtttttgtgtttttcagggaccattgacatttatggatgtggccatagaattctctttggaggagtggcaatgcctggacactgcacagcagaatttatataggcatgtgatgtgagagaactacagaaacctggttttcttgggtgaaggtaacttcaatacacattttctaatataccctaaaggttttaattctcttttttgtagaatgtttttggtgatttatgctttgcataaattgagtttcagatccctgttttcaaaaaaatcttttagatttgtcattgtagaaaatagtttattcaagatgtttcatctttaccataactttccacattcctgagatgatctttatcattcagtcttgattagtggtaattttagaaatttattggcataaaatattgttgcccacaccttaaaatctaactcccaacaacaattgttttgattcagtagtaccaggtagtgaaattaagaaactacaaatttaaaatattttctaaatctttagaaatttttgttataaattagcatttggggattaatttactagaatattctattgcattctctttactgagcacattaccaagttggtaattggagaatatgtgcaag

SEQ ID NO: 43747 - DNA, 1103 bp, Homo sapiens
ttgatgggaaaccttaggcaaatttcttaatctgagattcaatttcttttcttttttctttttttttttgtgacgggatctcactctgtcacccaggctggagtgcagtcatgcagtcttggctcactacagcctctgcccccgtgggctcaagcagtcctcccacctcagcctcctaagagctgggaccacaagtgtgcaccaccacgcctggctaatttttgtattttttgtagagatggggttttgttatgttgcccaggctggtctcaaactcctgagatcaagtgatccttccacctcagcctcccaaagtgctgggattacaggtgtgagccaacacgcccggctgagattcaatttcttcatctgaaaaatgaggatacctatggacaactgtagcttgttcataaaagaaaaaaaaaataagtatgaaaaatggggatactatctcactatctcttaggtagtagctgtatcaattaaagtaacatggaaccaggttcaatggctcagagacagggtgcagaagcgaaggcaggaggattgcttgagcccaggagttcaaggttgcggtaagctatgatcatgtcactgcactccagcctgggtgacagagtgagatcctgtctcaaaaaataaaaaataaaaagatagtaataaaatagcatgggtgaaatgttgcgcacatgatagatttgcacttacctctttcttcctctacacaaacccttgccccaactaggcgaatttagacactctaccctaaaatacatctagcactttctacccatccttctgctcatgctgtttctctgcctcttcctctccatttactgaactcttacagttcttggtgattctcaccattatatgctccagaagggaagtatataatacatatatatttttgacagtatatacctggtccctgccataaatgcgcaatgattatcgccaaatagttaaatgagcacctttagacttgtttgaatgcctcagaaatatcatagaattaaaaaggaccggccaggcatggtggctcacgtctggaatcccagcactttgggaggcagaggtgggcaaatcacctgaggtcaaga

SEQ ID NO: 43748 - DNA, 1047 bp, Homo sapiens
attaaatgtggtgaatctgtgggggcgcccaacccctcttcatctacttttacaggtgcccaccgccacccccagctaacttttgtattttaaatagagacagggatttatcgtgttggccaggctggtctcgaactcctgacctcaggtgatccacccgcctcagcctcccaaagtgctgggattacaggtgtgaaccactgtgcctggcctctgctttaagaatttgtaaggattttgtttgctagtaaatcatcaactcttctgaaagtatctgtttgggtccactatttcatttccagtttgaaaaggtgtacacacacacacacacacacacacacacacacacataggcacgcataaatacattttttcttctatatatctcttataactaaagtttatctttagcttaatatattggtatatttcatgtaatgtaaatcaaaccaaaaaaaattatgtgttcaattggctcagaaataaaaaatatgcaaagaaaagtattggatacaattttataactaatgattcagaattcagaaaccatggcttctaattctacttctacataatctttattgtaactatcataatgtcccagtagttgtagcagggagaaaacaatataaaatatatctcttgagaacattagtctccaaatgatttagggtttcaattctcttttaaaaagaaaattactaaagaagtaattccattgtgttacctaatagtatattgttattatctgttacctccaatgttaagtaaagtagaataggttaccatggaaaagataacatttgattcattgcacttcagtgttaaaacatgagaaaccatttagttttcatagttaaattaagctcacacattgtctaaataagacattttaaaattcactatatgctacttggtcaagcacacaagaagcattaggttttttctgatttagtgatcttagagattttgttttcttttctttttttttttttcttttttttgagacggagtttcactcttgttgcccaggctggagtgtaatgg

SEQ ID NO: 43749 - DNA, 1019 bp, Homo sapiens
acaaatgtcataagaagagcctacacttttaccttggccgatccctcccctcagtgcaagctctgcgcaagagtgaacttgaacttcactcagtgcaagagtgaacatacactttgtgcaggctttaaagaacccagcacaaagccagtctgcatggcctagagacatattttgctggctaatgattacttgtttttctttttgtttttgttgtatttgcctgtttgcttagttcctgacatacaagaaaatcactgtcaaaacattagcttaacatttattaaggaaacaaaaagacttcggtgaccacaccttataaagcaaacagttttgtaaatcactttggaaaatttcactaaaaataaaaactttaacaatgtaataagtaaataaaatttaaaaccacaaaacattagtgtgtttgtaggggggggtctgatttacagagtaaccacatagtaattataattattataatgtgcagttttcaaaaaaagttacaaggcatacaaagaatgggaaagtatggctcattcaaaggaacaaaataaattgacagaaaatatctttaaggaaacccagacatcaaacttactagacaaagacttttaaacaactctcttaattatactcaaatgtcaaaaggaaaacataaacaaagaaagaaaggaatcagaaaaaagtattaaaaagtaggaatatcaacaaagataacaaattctggagtggaaaactacaatgataaaaattaaaaaatcaacagagggatttaagagtatatttgcccacgcagaagaaatcatgaagataagaaaatggaaaatactgactctgagaaacagaaagaataaaaaataaaaaatgagcagagactaaggaatctgtgggacaccatcaaatagaccaacattcatattccagaaggataaattatgttaaaaactttaccattctttctttccacctttctttcttcctccctccccctcctctttttacttttcttcctcttcctttct

SEQ ID NO: 43750 - DNA, 1082 bp, Homo sapiens
caagcttctcaatgcaaacgaaggttttcagctgccacagtcagactgtgtcattcaatgtggctcttggtagtttttgtgtagttctgcctcctttgctgtgtactattttttgttttgttttatttttgttattttttctttgcactgttctaaactggccctgtagggcttcgcctcccagtccagtactccctagcatcaccaccaatcactgcacatagggcacacagcccctgtgtttctggtgagctcttcatctaccttttttttttttttgagacagtctctctgttgcccaggctgaagtgcagtggcacgatctcagctcactgcaacctccacctccagggttcaagggattcttgtgcctcagcctcccgagtagctgggattacagtcgtgagccagcatgtctagccttttttggtatttttttgcagagatggggttttgctatgccacccaggctggtctcaaattcctggactcaagcaatccacctgccttggcctcccaaagtgctgggattacaggcgcgagtggctgtctctctctctctctctctctctctctctctctcaagtgatagagtcttagggccaggcacagtggctcacgcctgtaataccagcactttgggaggccaagatgggcagatgatgaagtcaggagttcaagaccagcctgaccagcatgatgaaaccccgtctctactacaaatacaaaaattagctgggcttggtggtgtgcacctgtaatcccagctactcaggaggctgaggcaggaaaattgcttgaacctgggaggctgaggttgcagtaagccgagatcgtgccactgcgctccagtctgggccacagagtaagactctatctcaaaaaaaaaaaaaaagattcttgttatgatgaccaggctcgtctcaaattcctaggctcaagcaatcctcttgccttagcctcccaaagtggttggattataggcatgagctaccgtgctggccaaaatagaatgttagtgacacaccctacattgaatttacttggaaggctgattcttttcccatgccctccctaggaga

SEQ ID NO: 43751 - DNA, 1060 bp, Homo sapiens
agctactcgagaggctgaggtgggaggatcgccagaatctaggaggcggaggttgcagtcagctatgtcagctatgatattgccactgcactgcagcctgtctcaaaaagaatgatacaactaaccagtcacctactgactgatgtttaagttgttcccaatctgctattcaggctgcagtgaatatcggtatatgatgcttttaggaggatttgtgtatttgagaatcacaaaaacatctatatatgtgactagaagcactgcacaatagaagactagttattagttccataggcattacatggtgtgcatgcagatttattataactgctgttaaaaatgttatgaggagaccagtcgtggtggcccacacttgtaatcccagcacttggggaggccaaggccggcggatcacttgaggtcaggaggtcaagatcatcctggccaacatggtgaaaccctgtctctgtaaaaatacaaacattagcaagaccaacaaggtgaaacactgtctctgtaaaaatacaaaaattagcctggcatggtggtgtgcatctgtgatccaagctactcggaggctgaggcatgagaattgcatgaacttgggaaggagaggttgcagtgagccaagatcatgccactgcactctagcctgggtgacagagctagactgtgtctcaaaaaaaaaaaaaaaaaggccgggcccagtggctcacatctgtaatcccagcactttgcgaggctgaggcaggcagatgatttgatttgaggtcaggagttcaagaccagcctggccaacatggtgaaacctcgtctctaccaaaaatataaaaagttagctgggtgtggtggcgcacgcctgtaatcccagctacttgggaggctgaggcaggagaatcgtttgaattctggagacagaggttgcagtgagccaagatcatgtttctgcactccagcctgggtgacagagcgagactctttctcaaaaaaaaaaaaaaaaaaaaaaaaaaaaaaaaaaaagctgggcatggtggttcacacctataatcccagcactttg

SEQ ID NO: 43752 - DNA, 1313 bp, Homo sapiens
ggcccgccaggtgcgcagcggcgcgcggtgcccacccagccctcccgccagccccaccttacatctttatggtccctttgggccccaggttggtcctcagcacgtcctgcagaccccgcgccccgctaatgttgaacgccagcgccgcctgcgctccggccaccttggccttggggttcagggtcttcgccgccgccataactgctccagaggaagaaaagaaagcgacgcggcacgcggagagcccagagcaggcgcgccgtggccgggatgcactatccggatcttccggaaaagtcggcgcgcccagcccgcccctagcgtgcccgcgccgccgctattgggccacgggctgtccggcccccgctcattggtccgcggctgcacggtgcctgcagtcccacccctcgcccagcggccgcgacgctatggcgcactggagtaccctgttcctggcagtaagtgcttctgggttctggcgttgctgctcagtggggcccaagtttgcggacccgggatctcaggatgcaggcagggcttatgccccgcgccggacagggcgtagggtgggcctcctcctgcccctactcgcgcggtttgctcctcagtctccttcccttgctgctttcacgactttcattggagctttctggaccctgtgcttgacggtgctgtaggtgccgtggggacacacaggctagtctgataagcaccctccgccggaatcatgcggtgctgtaaggactaacgaagatgaagatagaatgcaaggtagaaagtgctggatgcctttagaaagctgcaggactggtgcgatgggagttgagtcataacctgtccgtcattaggactcaggatgctgctgaggccctaggcttctatggtagatttgaaaactcacccttgtagagtgatggtgtccagcctttgagaggactcccttttaaggtaaatttccaaagagctccacaattgtttacagtatccggtgcccgccaaattccagggattcagttacacgtgatattttacttcattttttctttttatagacacacggcctcaccatgttgcccagggtggtctcaaattcctgagctcaagtgatactgctgagctcaagtgatcctcccgtctcggcctcccaaagtgctgggattacaggcatgagccaccgtgcccggccagtattttatttttaatagataacggaaattgttctgaattcaaaaggcaccaaagggcatgtggtggaaattaaatcttcctcccgccactagttcaacactagagacaagcacagttaccccgga

SEQ ID NO: 43753 - DNA, 1105 bp, Homo sapiens
aagtgcagagattacaagcatgagccatcatgccctgcctgcaatttttctgtcatgaactattaataatttactttttgcttaatattctatgactatatatatttatgtaaatatagatactttaaatttttctttgataccaatttttccggttttttttttttttttttttttttgaggctgggtactgcttcgtcattcaggatggagtgcagtggtgtgatctcggctcactgcaaactctgcttttttggcttaagtgatcctcccacctcagcctcctgaataaatgggaccccaggtatgagccgccatgcccaggtaatttttatatttgttctagacaggaagtctcaccatgtttcccaggctggtttcaaactcctgggctcaagcgatcctctcacatcagcttcccacagtgctgggattacaggtgggatccacacctggcctgccattttcttttcatagatcattaagaatttactttatgccgggcacggtggctcacgcctgtaatcccagcactttgaggggacgaggtgggtggatcacgaggtcaggagttcaagaccagcctagtcaagacagtgaaaccctgtatctgctaaaaatacaaaagttagccatgtgtgatataatcgcagctactcaggaggctgaagcaggagaatcgcttgaacccggggagaggaggtggcagtgagccaacatcgtgtcactgcactccagcctgggtgacagagtgagactgtccaaaagaaaaaaaaagaacttgctttttgattagtatactgtaaatatatatatgtatatgtgttatatatttgtatatgaatatatgtgtgtgtatattttcatagcgcacacacacacacatatatattgtgaaagagatatctgaatacctagaaactgataagcttcttccaggttttgaaaccacccttagaacaaagacaaaagaagtacaaagtatcattattaatgaccatggaccaagatgaccatgagtcaatagtactttgcacctcaaccaccttccagcagagcatcttaaagggctggatgtatctgaacatcacaccctttcacaggg

SEQ ID NO: 43754 - DNA, 1114 bp, Homo sapiens
catggtttacttgactatcgctatcagtattttgcatctctcatcatttttgtcaacttcctcatctgctaacttctctccaaggtatgtcatattgtgacatactgctgctgcacgaacatggccagtgtcatcctattaaacatgtagaatccttccctaatttgtttttttaccctctgtctctttgttttgcatttttcttacccttattgtcagaaactccagaaagtcaatcgtagtgatttatcaccaattgctccattaatttatactttgcttacatggaattttgcccaacagacatcattacaatttctaaccttttttttttttttttttttttttcctgagacagggtcttgctctgttgtccaggctggagtgcggtagtgctatcacagctgactgcatcctcaacctctcaggctcaagcagtcctcccacctcagcctcccaggtggctgagactgtacgtgcttgccacaatgcccaactaataatttggacttttcctatacatgggttccaaagggctgactgcgaaacgtgagtatgcatggattttggtatatgcagagatggggggctggaacgaatcctttctgtatactgacggacgaccatatatgtttttacacttatgctgtacgacacatattgttccatagccttgaaaatagtaatttttaatgacaaataattttgaatttagtggtataatataaaagcagctgaccaggtgtggtggctcacaccggtaatcacaacactttgggaggttgaagcaggaggatggctcaaggccaagagtttgagacaggtctcagaaatcaagggaatcaccatccctacagaaatatacatgaattagcctagtgtggtggcatgttcttgtagtcccagctacttgggaggctgaggtgggaggatcacttgagcccagggaggcttagactgcagtgagtcatgatcaggcctctgcactccagcctgagtgacagagtgaccccatctcaaaacaacaaaaaagtagcagctaacattaactgtccttctaccaggtgcctataaataccatagatagtttaatttctttttttttttttttttt

SEQ ID NO: 43755 - DNA, 1050 bp, Homo sapiens
aaaaaaaaaaaaaattaaccctttatgaagttcccagtaattctttgcttcctaagtgttccccataagcctctgaattttgtttgcttttcatataccatttaaaacgtttaagaacttgtgtctgtctgtgtcatcctttttttttaaagaatatctttttgtcacttccagctggatctaccatgaaagacttcagagtccaggaagagagactgactgggcaacatgttattcagttacaaaaagacttggactatgactcaaaaatgatcaaataatagttcatgcatcaaatgcaataggaagtacttctggagggtgagagaagcatccagttaaggtgacattgaagctgggtcctgaaagatgaggaagaattgtatgagagtgggcagagaagggggaggtggagggatggggaatgggctgggatggagtgagctgctcaagtagggagaccagcactgtaaagacctggacgataaagacggcacattttattcagggaatggtgaattaagtgtggcaggaatgctttggagagatagtaatttgcttgtatggaattttgcccaagaggcctcattacagtttctaatcttttgatgttatcatctatcactgtccttgccaaatagtttggaataggtataatgatcacaataacatcaagcataatatttcattaattctcacaaaatcacaggtaggtgccacagttatccccattttgtgaatgaagtgatgaagacttaggaataatgagtgatttgcccaagctcacctggatattaagactgagtcaaatgtggggtctggtctgactttaatgtttgctttgttcatgagcaccacgtattgcctctcctatgcagttaagcaggtagacaggtgaaagaaaagcccatgttagtctctactcacacacttccgactgaatgtgtgtgtggaatttctacaccaagttctccaatgctctggatattaactgggtatcctacaattttattctgacacttcctggagttggcgtagaccccacaggtt

SEQ ID NO: 43756 - DNA, 1075 bp, Homo sapiens
aggaaagcttacttaataacataaactcttggttatgaattagatgtttctcctatgaaagcttgtggggatctttgagcaacttaatacctgattatttctgttcaaaaatgccgagaactaaaaatccattcaaacctttacttttctccttttggaaaagtgcatgaggtgttccttttggtaaaaagacacactgtgcgaccacagagacctgagcctgaacccatgaagatgtgaacaaggtgaacaatgagactatgtaaaggggaggttaattccaaggtgacaggaactttatggagaagattatgatttctacactttgtatccccttctaactctagtatgaagttacattgtatacgttggtgctctaatctcagtctgtggatattagatattaagattggggagaaaataaaacagccagttaatgtgcaccatttttataggcactgtcagtagcatataagaaatagcatgtttctcaaaagtaaattagttcatagtagtcagttggcacatttggcaggtacttctgtgaacttttttttgctatctttaaactcttcattcattgatcccgttaatccaaagcttatttaataacataagcttttggttgtcaattagatgtcaggaaaaacagagaaatgaacagctaatataatgagttaaaaggattgaggctgtaggaataatgttaccaagaataacttgaggattgtttgctactatagctagctgtgattatcaaaatagggagatgcctgtttttctcacataaaagtaattgtgcaggtaggctgaggctgacattggttcagttgctcaaacatggtaagactggcttccctgtgcctctcttcactctcctttctggtgcacaatgaccaagagagctcctgtcgtcatgtctccatccatcatgtctccatccaattataagtaaagaaaatgcagcatgagccctgcctgcacccacagtcaggaaaagcaagaggctttttttgaatcctagcagaattttgcataagcctcttggttttaaaaaaggtgaattttaaaataa

SEQ ID NO: 43757 - DNA, 1922 bp, Homo sapiens
ccgtaattccagctacttgggaggctgaggcagacgaatcacttgaactcgggaggtggagatcgcagtgagccaagatcgtgccattgcactccagcctgggcaacaagaagcgaaactccatcttaaaacaaacaaaacaaaacaaaaacaaaaaagcataatctctttcagaatttttaccttcttggtgtggttctgttaggaaaggcttccatgggaaccttcaataagtgacctaaaaaaaaatctcagagcaattcctttttttttttttttttttttcagacagcatcatgctctgtcacccaggctggagtgcagttgcacaatctcagctcactgcaacctccacctcctgggctcaagccttcctcctgctttggcctcctgagtagctgagactacaggtgcatgccaccgtgcccggctaatttttaaattttttgtagaaacggggtcttgttatgttgcccaggctgacctcaaactcttggcctcaagcgatcctcctaccttgtcctcccaaagtgctgggattacaggggtgaaccactgttcctggtttagagccattctttttttttttttttttttttttgctttgtggttttgagacggagtttcactcttgttgcccaggctggagtgcaacggcatgatctcggctcactgcaacctccgacttccagtttcaagcgattctcctgcctcagcctcccgagtagctgggattacaggcatccgccatcatgcccagctaatttttttgtatttttagtagagacggggtttcaccatgttgggcaggccggtctcgaactcctgatctcgtgatctgcccgcctcggcctcccaaagtgctgggattataggcatgagctaccacgtccggccctagagccattcttaacagggtttgtctccctggaaacttcccgaagcctcaccctcccaggaattccctgctaagtgccacagtcatctcttcaccactcggtttccactctcccatccttgcaccgagatcccactgttaggcctttttcaagcacagaccttctcatgctcagtctctctgtggtgtggaagtgtctactgggtgggcctcacagaaggttccaggccctggtacaagcccaagggaaatgatgatccaaaatggactccgataaagtttctgccactctgcattgggggcttttggtaggagtccagttcaattttataaaaataaaaatacatgtctcgcacttctgagtttgcagactcaggtccattctgtatttgcaaacgaggacaaaaagaaaggtggctgggtgcggtggctcacgcccacctgtaatcccagcactttgggaggtcaagatgggtggatcacttgaggctggccaggagttggagaccagcctggccaggagttggagaccagcctggccaaccagcctggcctttcaccatgttagggtgcctaaaaatacaaaaattagctggatgctgtggcacacgcctataatcccaaatactcaggaggctgaggcaggagaatcatttaaacttgggaggtggaggttgcagtgagctgagatcatgccattgcactctagcctggacaataagagctaaactccatctcaaaaaaaaaaaaaaaaaaggcaattgggggaaaacagtccttccagctcacctagcactgcccatctttttccatattcagatcacatggcgaggcaggtatgcttgtccatcttggcggtaaggaagcgaaggctcagattcccatggctagtcaggcaggtacagggacttgaacaagatggcactttcccatggcccacatgctgcctaagaccctgaaggctgactcctggacactgtccccagccatctgcctctctgcaactatctgccacccctccacc

SEQ ID NO: 43758 - DNA, 1021 bp, Homo sapiens
aggtggaggttgcagtgagcagagatcatgtcactgcactgcagcctgggagacagagacctgtctcaaataaaaatgaaaacaacaacaaaaaaaatgggctctgaaaaggcaggtaggagtttgtgaaggatggagtggcagtgtgaagacaccggggcagaaggaccagccatgcacaggcactcaagggtgaaagatcctatgctggccaggtgtggcggctcacgcctgtaatcccagcactgtgggaggctgagacgggcagatcaccctggccaacatggcaaaaccccatctctactaaaaatacagcaattagccgagtgtggtggcgggcacctgtaatcccaactactcaagaggttgagacaggagaactgcttgaacccggaaggcagaggttgcagtgagccgaaatcacgccattacactccagcctgggtgacgagcgaaactccgtctccaaaaaacaaaaaaaagaaaagaaaaaaaaagaaagatcccttgtcctggaagtggctgaacttgggggtggtacaggggagacaactgatgggcctagcggggtccgtgcacaggggccggtgtcactgtgctgggctgttggaaatcccctgactgctcgctggccaaggtctgtgaatgggaaacagactgtgtctgggagtgtgggggctatgcattctccctgctcactgccctggcaactgtcacggcttatctgctgcttgagccccggcgtgctccgctctcccctccctgtagcctagagttgctgctggggtcagttagccctggagacggggcctgagctgggctgtaaggctgaggggtggttgggctggagatggggtctggggcagagctctgcagcagcctgtgggtttgtgccagggttgaggatggggctgggattgcaggaaggctggtttgcatgtccaacaggaaatctctctgagaagcatgggttcacatgggctgggcctctggggcaggcaggttgggtaagggtgagatg

SEQ ID NO: 43759 - DNA, 1024 bp, Homo sapiens
tttcatcttagtgatgattgctaaaaagtttagttagagacagatagatgtatgggctgactcttgactaatttagacatcttccaggaaaacatttctgtcttgtcatctgtggctctgcctgtggggtttctccatgtttcttttgtttgtttgtttttgtttacttattaaattattattattttttgagacaaagtctctctcttgtcccccaggctggagtgcaatggcgcgatctcggctcactgcaacctccacctattgggttcaagtgattctcctgcctcagcctcccaatagctgggattacaggtacgtgccaccatgcctggctaatttttgtatttttagtagagacagagtttcaccatgttggccaggctggtctacgaactcctgacctcaggtgatctgcctgcctcagcctcccaaagtgctgggattacagggtgagccaccgtgcctggcctattgtttataatttttaaaaaattgtttaatgcctatctatctatatttactagagatggggtctcactatgttgcccaggctggtctcgagttcctaggctcaatcgatattctccctcatcctcccagagcattggtattacagttgttattctttttattttctagtctgttatgctgaattgcatttatcttttaaatagactttaaatattctttggcagaaagtgaggaataaatacatatattacacctataaaatcagtaaaacgaaatgaaaattatcaagcccaatgttgtaagggccatagggaaataagcgcgtacacgtggttaatgacagtgtgcaccgagtttctgaggagtgtggctagcaatagacacttagtgctataacattgattcttttttgttttttgtttttttttgttttttgagatagagtctcgctctgtcacccaggctggaatgcagtggtgcgatctcggcacaccgcaagctccacctcccaggttcacaccattctcctgcctcagcctccggagtagct

SEQ ID NO: 43760 - DNA, 1028 bp, Homo sapiens
gagtaattgggactacaggcgcataccaccatgcccggctaatttttgtatttttaatagagacggagtttcactgtgttggccaggctggtctcaaactcctgaccttgtgatctgcccaccttggcctcccaaagttctgggattagaggcgtgagtcaccgtgcccatccagcatgtataattttaacgtaatggctaatcactcatgaggggaagaaatggctaatcactcatgaggggaagagatttttgaacatttttaaataatagagacagggtcttgctatgttgcccaggctggtcttgaacgcttggtttcaagccatcctcccaccttcgcctcccaaagtgctgggattataggcgtgaaccattgcacctggccccggggaagggatttttgtatttattaagcagttaagtatcattgctttttagccatgttattctatagtctttacaataaccttattcattcagttattgttcttgcaacaaagatttgagaacctatgatatgcccatttgtgcagggaaaaaactcctcaaactgtatttttcctctgctcatgccacagcagtcatcaacacagaagacttccatgaccatatgtgtggggattcttcccctacacaacacaccagctgggtgtcttctagttcactttctgcactgggtgtcttttagttcagttcctgcactatttaccaggagatagggtcagatcgcacagggtgaggactcagtcaccatgactgcccctcctaacccccatcagttgcaactccgggcctttaggacttctaactgaccagcttcaagttggggttcccatggctgcctttttaggttcaataatttgctgaggtggtttacagaactgagggagatgcttatgtttaccggtttattacaacagatattgcaaaggatccaggtgaaggagatgctgggggcgaggaatgggggaaggtgcagaacttccatgccctccctgggcgtacaccctccaggaacctccact

SEQ ID NO: 43761 - DNA, 1044 bp, Homo sapiens
aaaataacaaaatgatagacctaaatccaagtacatcaacaataacaatgaatgtaaatggtctattcacaccaactaaaagacaatgacagaagagttttttttaaaaaaagacatgactatacattttgttgctgctgttttatttatttatttatttattctgagacagagtcttgctctttcactcagcctggagtgcagtggtgccatcttggctcactgcaacctctgcctcccaggttcaagcgatcctcatgcctcagcctcctgagtagctaggactacaggcacatgccgccacacctagctaattttttgcatttttggtagagacaggttttcgtcacgttgcccaggctggtctcaaactcctggcctcaagtgatctgcttgcctcggcctcccaaagtgctgggattacacgcatgagccgctgcacctggcctgactatatattttaatataggtagattataagtttaaaaatggaaaaagatatgttacgtaaatgctggtcaaaggaaaactgaactgattatatttacataagacaaactatacctcaaagcaaggaaatttacaatagattaagagggacattacataatggtaaagacccaacaccatttaaaatgtgtacacatctaaaaacagacctcaaatatatacagcaaaactgacagaacttgaggagaaatagacaaactcaaaattatagttggactcttcaagaatggacagaacagatagaaaatcagctaggatatggaactaaacacaatcataaaccaactaatattgataaaacactccatccacaactgtagtctttttgaaggcacatagccaggcatgatggcacatgcctgcaatcccagctattcaggaggcggaggcacaaggagcacctgaacccaggagttggagactgtagtgcactatgattgtgctgggaatagccactgcactccagcttaggtaacacagccgagacccatctctaaaaaaaaaagcatatagaacattcactaagattatgtc

SEQ ID NO: 43762 - DNA, 1048 bp, Homo sapiens
ctatctcaaaaaaaaataaattaacatacacatggtgtctacataagtcttcacattgctttttctccttcatacgtggaggtgactttactgagctataaaatgtaatgctaaattttagtatgagaagaatcagagttttctagtttgtcccttccatttacagctgaagaatcagaataagtgtttaaacatagggattaatgccttgtcacagggggctacatggacacttgagggcagaggctaaactggaacccagtgtgccgccctacccattgtcttatctattgcaccatagaactgtggtattattagagatctggacagcattgtgcttgcctcaaaggaagttaaagctgagtttattctgtgtcttgctcatcctcatgtggtaatctgctacgttaaatgtttcaggtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaac

SEQ ID NO: 43763 - DNA, 1050 bp, Homo sapiens
cccagctacgcaggaggctgaggtgggaggactgcttgggcccaggagatttgaggctgcagtgagccgtgattgtgctactgcactccggcttcagcaacagagcaagaccctgttgccaaaaaaaaaaaaaaaaaaaaaaaagaaaagtgtccagttttcaactgggtaggtagattatatatctatgaattttaattcagcatagaatagaggatagagttacaaaaggtgggtctaacagggtttagaactgcaggactggccgggcgtggtggctcatgcctgtaatcctagcactttgggaagctgaggcaggaggatcacctgaggtcaggagttcaagaccagcctggccaacatggtgaaatcccatctctactaaaaatgcaaaaattaattagccaggcatggtggtgcatgcctgtaatcccagctattcgggaggctgaggcaggagaatcaattgaacccgggaggcagaagtgacagtgagccaagattacaccactgcactccagtctgggtgacagtaagactctgtctcaaaataaataaataaataaaaataaaaaataactaaaagagtataattggattggttttagcacaaaggataaatgctcgtggggatggagaccccattctccatgatgtgattattacgcatgcatgcttgtatgaaaacatcccatgtaccccatatatacacctaatatgtagccacaataattagaaaattttaaaaaactcatgctgcaagtctttacaaaagattattttattaattcaatttttgcataaaagactgttaaaagaacttgctaacttgaaaacaattttgagtatttatgatctttccaacttgaaaacacctgaaccttatagaacagattgtgtaaagcagccagggccacaggagtgaaagaagatggagacccgccgtctggtcatgatatgagaggcctggacagtgacctcacgaacaaaaagaaatgatcctcttcagtccaaagtgtgtttgtgagactaatgactccatgccctcac

SEQ ID NO: 43764 - DNA, 1133 bp, Homo sapiens
actgtgagactcccaagccagatcacagaacccaacacagcttcctcctaggcctcttggtatgtttgttcttggaactcaccaacatgccatgaggatgcccaagcatttgtggaaagagccacaaggaatgaaattcaggaccccagctgaaagccagggctgagctcccagctgacagtcagtgttaactaccagccacgggactacaccgtcttgaaagtggatccttcattctcagtgaattccacatgggacagagaggggctgaccctgctcagccctgcccaaattgcacattcaagggcagaagaaaggattactattgttttaagacattgaattttgtcatgatttgctactaggcaatagataactgatacaggagggagaatggaagcagaggcattcattagagaacataattactcaggcaaaggatgatgagggcttagctaaggcattcattaattgaacaaaattatgacatgtcaggcatggtgctatgacatgggactataatgtgaactaggtagacaaggtctcgtctctgaagaaattgactggctattgggcagaaaggatggaatacagaatatagccactgagctactttattatgttaacctaaagatgcgtgatcttgtcatgtaatgttaagaggcatttaaaaaatagaataaaataactagaaacatgcattattatatgggtaaaacttttggcatccagatagcataaaaatggcattggctttactctctaagccctattgaacatgttaggaagcgggtttttttgtctttgtctccattagagaaaaccttcatgtgggcacttttgatgctcccctgccattgtgtgattttcagttcaaagcacttgctatttgcatcagtgcttgttgctttttttttttttttgaggcggagagtgggaggattacacagtgttcttttcaagtgctctcagtccctgatcaaaggaagggttttagagccttagtttgttggagattccatataagactattcttggtttggggttttgagtaaatcacttttgcttaaacaccagagagaaagagtactaacccatgcattgtcaactacaaagtcctatccaagtgccaa

SEQ ID NO: 43765 - DNA, 1081 bp, Homo sapiens
ttcagacacattggtggctttcaaccttacctcactatcaaatttctgtggactttttcaaaacatacttcttctagtaatagtaagctatcatgatggtgattttcaatgaggaaagaggtgctcatactagactttctagatgcaaggagatgggggtacattgtagtttagtttttttttttcttcctgagataggatcttggtctgttgtccaggctggaatgtggtggtgccttcactgctcactgtagctttaacctctcaggttcaagcgaccctcccacctcagcctcccaatggcacaggtgcgtgccattacacctggctaattttgttttgttttttatttttggagagatagggcctcactgtgtttcccaggctggtctggaactcctaggctcaaatgatcctccctccttggcctcccaaaatgctgggattacaggtatgagccactgcgcccagcctttgtagtttagaaagccttcccaacaggtgatctaaatactggctttagaaaaatgtgtcctaggttcttatttctaagaaccctgcatgagatagcaagcagagggtggtatcttgttatgcaaaagaacctgctgcatcttaaagcatgactttgacttgagctatttgaggaacaggagtaaccacgtgtttatctcagtcataaaatcacctgtatcttgttcctggggaacctttcattttcaacagaaatgcattgtaacagatctagtaagctaattaagccccatcgtgctcccccagataactaaatgagttaacctgttgagtagagttgttgaacattatccatctggatgctgaagggagtttgccaaaacccatcattccgatgttggcttcactgacactattgtttctccttgcagtaattggccagcagcaggttcaactgttccctgggactactcaagaatttgatattagcaacatgttctagcagcaatgactcactggtcttctctcttcacagtggcatccagggcatctaaacgttgctccactcatcgcaggtgatgagttaggacacacccatttaaaatac

SEQ ID NO: 43766 - DNA, 1050 bp, Homo sapiens
gaacgcggtcggggaggaggaaggtgccaagagtgactctgacatggtctggcttctaaaatagagcgttatgctaattagcaaagtaaaatccacagataaagggtatgagatctagtgcagggttcctagaaaatggggaggaatagtatcctacgaagcacagcggagggcctggcctttggcaggaagagatgcagggcctcttcatggggaagaagaaaaaaggatgcactgtgatgaggtggcaggtttgtggtgttggtagcacccaatgtaatttttttttttttttgaggtagagtctcaccttgtcagccaggctggagctggagtgcagtgacacgacctcacctcactgcaacctccgcctcctgggttcaaacgattctcctgcctcagcctaccgagtagctgggattacaggcattataggtgcccgccaccatgcccagctaatttttgtatttttagtagagacggagtttcaccatgttggccacgcttgtctcgaactcctaacctcgtgatctgcttgcctccgcctcccaaagtgctggaattacaggtgtgagccaccgcgcctggccgccaatgttatttttacatctatctttgttgactttgccccgatgggcttgaggggaattcacaaattgcgcttttcttctctctccgaagttggggtcaggttgacggggatcacagtgccagttctggtatgttgcacccagaattaggacatgtaccacttggccagccacagggagtgatggctaagtacaatgtcaaagtcagtgctctctgcgggaagggagagctgaggagagagaacaagaggattgtatctaacagtccttttcctttctccatttactaatcagagaagtgagcgaggaaatatagagatccagagtgttacactagtggatatcactccacgtgaaaatttgtgatccaaggctaggcgtggtagtggctcacacctataatcctagcactttgggaggccaaggctcaagggtcacgtgaggccaggcatttgagacc

SEQ ID NO: 43767 - DNA, 1039 bp, Homo sapiens
acatttctagaagaaaacataagagaaaacctttgtgaccttatgttaagcaaaatttcttaaaaacaaaaagcatgataaaaaactacaaatagacaaattagagttcatcaaaataaaaaatcatctgtctataggatactgttaaaggaatgaaaagacaaggcatataaatatatttgtgggaaataacttgtaaatcttgttatagaagtcttgaatccagaatatataaagaactttccaaacttgataagaagaaaacaaacaacccattaaaacagatgaaatatacgtacacacacttcaaccaagaagtggttcatggtcccggcgcagtggctcacgcctgtaatctcagcactttgggaggttgaggtgggcggatcacgaggtcaggagatcgagaccagcctggctaacacggtgaaaccccatctctactaaaaatacaaaaattagtcaagtgtggtggcacccgcctgtagtcccagctactcaggaggctgaggcaggcaaatcacttgaacccgggaggtggagtttgcaatgagccaagatctcgccaatgcactccagccttggtgacagaacaagacttcatctcaaaaaaaaaaaagaagtggttcgtatgcatggcaaataaacctgtgaagaaacaatcaataccttagtttttagggacacgcaaattaaaactacagtatacgccctataatttattattttaatcacattgtttgcaaatgttgactttattttgggtacccggttatttatgatacactcacagttcatttctgcataacagagtgtcaggacatggaggcagcaggggaagcaatcaggtacagactgatacaccttactaggccctgagatctcaggggccttctctgggcttcatatcctcattgggatgaatattttaggaagactgggatgtttgtggcatgtcctggtcacccaggctggagtgcagtggtgtgatcatagcttactgcagccttgacctcctggagtcaaagaatcctcctgt

SEQ ID NO: 43768 - DNA, 1051 bp, Homo sapiens
gggcttcaccatcttggccaggctggtctcgaactcctgaccttgtgatccgcccacgtcaacctcccaaagtgttgggattataggtgtgagccccagccccctacctactgttgattttttataaatactccaccatactgaagaaatttccttttattcctagctttatgtgactatctattatcaatggctattgggtttttatcatatcatttttttgcgtctattgagattatatgatttcctttattctgctaatatggtgaattgcgttgattttcaaataacaaaccaaattctattcatgcagtaaactcatcttggttactatgtattatcttttttgtgtatcttgggattcttttgtatactattatttaaaagatgtttccatttctgttcatgagagatgctgaactgtcattttctttcttttaatgactttaagtttcaatatcagtattatggtgacctcataaaatgagtaaggagaatagggcctctttttctgttctctggaagagtttagtatttcaaatcaaacaccataaataattgtaggaccatttagattttctgtttatcaattttattaagttgtgttttctttaagactttgtacatttcatttaaattttcaaaatgactttgtgtaactgcccctaatattcaaatgccaaatatcaaatatcaaatgccaatttgataagcccaaatagtacctcattcctaataatagtatgcatatttttatttcttattcttttttttttctttttttcttttaagatggagtctggctctgttgcccaggctggagtgcagtgttgcgatcttggctgactgccacctccgcctcccaggttcaagcggttctcctgcctcagcctcccgagtagctgggactacaggcatgcaacaccatgcctggctaatttttgaatttttagtaaagacgaggtttcacagtgttgatcaggctggtctcgaactcctgaccttaggtgatccgcccacatcggcctcccaaactgctgggattacagcc

SEQ ID NO: 43769 - DNA, 1034 bp, Homo sapiens
gacagaagaatcgctcaaacccgggaggcggaggttgcagtgagccgagatcgccccactgcactccagtctgggcgacagagagtctgtcttaaaagaaaaaaaagtacttgttgaagtcattttcataaaaagcagttttggaatgtagctgattgcagttgttttcagagaataattcagaacagtaacagtggttcacaacaacaacttaggaaagccatggttaagatccgatgaaatttcccagttgacaaggaatttagttatttcttacatgcagtattttaagataacaacaccaggatcatagggccatcagacttctataaatttcatataatcttttgaatattcacattaataacatatccccatacaaatataactttaaaaaagaatcaattatgactgataacatattttaatgaatttatatactttttagaatatttatatcaataacatacccacagaaataactgaaagaagatctaatatcacttaccatttgtcaatgcattccatataattttccaagtaagacaaataatttaatatctctgtaagatgtgacatacattctttgaagcttttcaggggcctaactggacaatgccaaagttaattttaggtcagaaacaattttggattttgattctgtggaaacctgccagagatgccaaaaggttcaaaacacttgatcaaaacagaatcataggtcactcataaatagtagttactcatttaatcagagtgataattaaaatacttcaaaagcaatatggaaattcacatagatagaaaaaccttaatctggcagggtgtggtggcttacgcctgtaatcccagtgctttgggaggccgaggcgggtggatcacaaggtcaggagtttgagaccagcctggccaacatggtgaaacctcatctctactaaaaatacaaaaaattagccgagtgtggtggtgggcgcctgtaatcccagctactcaggaggctgaggcaggagaatcgcttgaacccaggaggcgga

SEQ ID NO: 43770 - DNA, 1035 bp, Homo sapiens
attttttcagctccatccagtaatgtgtaattaagaaccctattactggaagcaaaaatgttcatttgccttgcattttgattatatttagtaatttggaatgctgacttttaggacagataggacttaatgcggctttttttttttttttctcatttggtacatttgattctctaaagtacttttttcactgatctcctatttcagagcaagtccctgaagtaacagagaatgtagagatattgactccaaatttcacttactttctgtgagtgttaatttttttttttttttttttttttttttgaggcagagtctctgtcgcccaggctggagtgcagtggcacagtcttggctcaccgtaacctccgcctcccgggttcaagcgattttcctgcctcagcctccctggtagctgggattataggtgcctgccaccatgcctgactaatttttgtatttttagtagagacagggtttcaccatgttagccaggctggtctcaaactcctgacctcaggtgatccagttgcctcagcctcccatagtgctcggattacaggcgtgagccaacgtgcccggccacgtgttaaaatttttaatctgttttatatatgggagacatcaaatgttctcaaaagtacacagagtgatatagtgaattcttattacctattgcctggcctcatcaaccagcaacttatgggccatcctcccctaggtaccctttgtatacccctttctgttttagtttgaagcaaatgtcagacctcatctgtgagatattctcatgttaaagtagaaatggtgttacagtgagtccattcacttattcacctgggggctggatggctggacatttaaaatagacagggaccaagggtgggctggggcttggtggtagggccactgcctggatgagttattgtgaatttctgcagctgtcagtaagatttgatgagtatctcccctaaagtgtaacacagatctcgtgtgttgtctctgaaattattactcagcactctgccattccca

SEQ ID NO: 43771 - DNA, 1046 bp, Homo sapiens
gcccctgtgttctgcctgccaggccagctgtctcccagccatgctgctggacccccgccaggctcccatgtcatggatgcctgtgccaccccaggcaataaagaccagtcacttggctgctcttctgaagaaccaagggtgagtgccacaggaggaggaggaggacatggggtttgattttgtgcctttcagtgggtaatgaaggctgaaaggatgactttcgcttaactctttcctgctgcaccaaagtagttcacggtatttgccccaagctaagctttccccactgcaggtgtgagatgtggatcccttagcccttggggcagagaccccaggccagttacctctgaccctgggccctttaaatataggctgtttcaatattgtgtgtcctggcttaacctgcatgttctggttgtctgtgtcagctgtgacaggcccttagctgctccatgcatgctcagctcacccctgctctgccctctgccctaggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcagaggtccacagcagcttagacctggagtcatctgttttggtcttagttctgacactttaatgggcttgggaccctggagcaaaagttctcctctgtgaagcgaggatttcaggagcgaggatttcaggactgaggcagcctgtgaagctgtgtaaccgagacacgcttttccttaggtatgccgagcagacagctggaggagcccggggcagggacacctagcccggtgcgtctgcatgccctggcagggttccagcagcgagccctgtgccacgcgctcactttcccttccctgcagcggctcgtctactccatgtgctccctctgccaggaggagaatg

SEQ ID NO: 43772 - DNA, 1050 bp, Homo sapiens
gtgagtggactactgggaagatgcctgccacctgggccgagggtgctccctgacttgaatatcagaaggtttcagcacctctgcgccaaggaaatagttgaactctcttccttttttgagcagatacacttattttctgccctgtccattcttcctcctgtcttgaatctgtaataacattgttctttctttcctgccaggtgcttcagaccaagcggagctcccggaggcaaagcctggagctgcagaagtgtgaagagatcctccacaagatcgtgaagtaccgcttcagctggcccttcaggtgagtgctgtgttctcaggtgcaggggagaggagtggcctggctggttctaaaagcttccagagcccctgaggggctctcagccaagcccttgcttttcaggacgtgtctcagtggcaggggcactgccgtcaaggctgtgcagattctccatttggttcttctccacagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccata

SEQ ID NO: 43773 - DNA, 1029 bp, Homo sapiens
ccagccatgcttgctctagatattttttaaattttggtaaaaatatgcataacatacaaatttacttttttttttttttttggagaaagagtcccactcttgcctaggctggagtgtagtggcataatctcagctcactgcaacctctacctcccaggttcaagcaattcccctgcctcagcctcccaagtagctggaattgcaggtgcatgccaccatgcctggctgatttttgtattttttgtagagacggggtttcaccatgttggctaggttggtctcgaactcctgacttcaggtcatctgcccacctcagcctcccaaagtactaggattacaggtgtgaaccaccacgtccagcccaaatttaccatttttatgtgttcgattctgtggcattaagtatattcacgttgttttgcaaccatcaccaccatcagccttcaaaactttttcatacacttctgacaccaaatacatgggtttttaccacactaagcaactctctagttctctgctgataccaactactcttaaaattcagtttaattctgactctttctacttggagtttgtgtcagatcctgcaagttaaagtgctctgtcccacgagactattctcacttcagatgccagtcgcaagccccacgttgccacctgtaccatctatacattgaggattctcatgaccctctccttaagtatgataatttgctagaatgcctgacagaacccgggaaagcattttacttaggttaaccgggtcattttgaaggatactactcaggaacagccagatggatgagacgtgtggaacaaggaaggtggcggagcaggggtacgtggggctttcacgtgttctctgaacactccttccttccagcttctgagtgtgttacctgaagctgatcagatcttgttccagtatcttcgtagagcttaatctccgaagtctcccctcctcttgcctttcaggagcttgtgggtagggctgaacattccagtcttctaatcatctggtctttctgg

SEQ ID NO: 43774 - DNA, 1021 bp, Homo sapiens
ttgagcccaggaggcggaggttgcattgagccaagatcatgcccctgcactctggcctgggtgagagagcgagatgctgtctcatacaaaatgaaacaaaaaacccccaaaatttagtatattcaaatagtggaatattatttagccacaaaaagaaatgaagtactgttctgtgctacaacatgaatgaacctagaaaacatgctaagcaaaagaagtcagacatcaaaggccatgtggtgtatgattccattcaaatgaaacatcttagaataggcaaatctatttcaaacagaaagtggattagtggttgccagaggataggggaaggggagaataggagtgatgattgctaacaggtaagagattcctgcttggggtgatgaaaatgttttggaattacatgtgtggttctacaacaaaaaactgaagtacatgcttcaagttggtgaatttcatgtcatatgaattaaaaagaatcaaaaaaccctgttctgtctacaaagtagcatcaaatttgcgactgccatatttgttgtagacattatttctatcaaagccaggacaagattttggcttaatgcctcctctcattgctgactctgtgctcaatttcacggttgaatttaggtttgatggaagagagaaggaaaatatgattcagtacatactctacaccattgccagacttttgcgaaggacaataggtacattatattgatgttagcccactgcttaatgtgtaaattaagtaaaactgtattcagaattgtgttgtctgaatacagatgtgtctaggcaaattaagaaagacagaggagggccggccgcggtggctcacgcctgtaatcccagcattttgggaggcagaggcaggcggatcacaaggtcaggagttcgagaccagcctggccaacatggcaaaatcctgtctctactaaaagtacaaaaattagccaggcatggtggcgggtgcctgtagtcccagctactaggtaggctgaggcaggagaattgcttg

SEQ ID NO: 43775 - DNA, 1030 bp, Homo sapiens
gctttgatataaagatatttagtcattcttcattctaagttgcagtacccctaaactttggaactgtgtaacgattccacttcagagagcaaatatctgagataacatgctgtgtttaagatatttaagagaaattagcatcttttatacatgaagatatatttgatatatttcacaggaagtatctgtgttgttacaaattgttgagtttggcactgtgtactgcttagatttgaaactagcaattgggtatttactaaagtcaacctaatgtctcaatttttcttaggtaagaaagcaaacttaggtaaaaatgcaagcatgaacacacaacatggaacagcaacagaagttgctgtagagacaaccacacccaaacaaggacagaacctatggtaatgtgagcattcatctggttgctctttctttttccttttaattgttaaggaagaaagtatttagtatagtgatgccagtgagttaataattatttgcgcaggatactttgtgtgactgatattttggatatcaaaacttcttgcattagcagacctgattttttgttaagaagatacttgtttttttaagggttggaattttgattttttcccccctgtaatataactttgtatattatgtgatagatcttatatagcagtagaaatgtagcttaaatttggttgggaatagaagtatttaagattttccttaaattttattaattaacaaattgtatgcatagctattcgtttcctttatgcgcatttctgcttttaggcagcgagctaggttttagaggatccattctacggctttaactgtgatcacctgtgatttaatgacctttcatttttgaattttgggtataggtttactctctggagggaaagggacaagtatgccaattaactttataaaatttcatataatattttaataggaaccatattggctctggtgtcctagtacagaattaacattaggcatcatgaaaatagtaaattacttattctacttctagatagtagat

SEQ ID NO: 43776 - DNA, 1803 bp, Homo sapiens
aattgtatgcatagtttttgtctactatttctgctggaggggttcacagattttgtttaaatatttaagaatcattaatatacataaacagaactagttacatagcaaaaatgtctagtattaagtctggatgtcaagggaattttgtgttgacatgacaaaaacattagctaacattcatgtctttgttttttcagggacaaagtatctatgaagagatatgaatatgtagctttacctgaatagctggggaagagggcctttaagatgcttaaatgttgcttaagttagttttagattttaaaattaattttgctcctattcttaaattctagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaag

SEQ ID NO: 43777 - DNA, 1034 bp, Homo sapiens
tggcaatgaatttaaagtgagaccactcactttttttttttttttttgaggcagagtcttgctccatcgcccaagctggagtgcagtggcgtgatctcggctcactgcaagctccaccttgcgggttcacgcctcagtctcccaagtagctgggactacaggcacccgccaccatgcctggctaatttttttgatttttagtagagactgggtttcaccgtgttagccaggatggtctcgatctcctgaccttgtgatcagcccgccttggcctccgaaagtgctgggattacaggtgtgagcctccacacccagctgagaccacccacttttatttatcttttattttagccgtgtttcagctgaacatatgcagggcaggagtaaatagagtgagttaatcagggttatggtttttccaagtagatacaatagaataagagagacaagggaactataggtttatgtgagattaattatcatgattgactaaaatttaatctgggtaaagcaagacatgggggttaggatggtgaaaatgtaatagaattaatggatttaaggttctggtgagattgaaggattgtagagttgtgggactggagggagtggatttggaacataagagggtatgttcaaagagaggatggtgtgaaattagttgtgggaatgagttctttttttttttttttttttgagacgggggtcttgctctgtcctccaggctggagtgcagtggtgtgatcctggctcactgcaccctcctcctcccgggttcaagcaatttcgagcctcagcctcccgagtagctggggtgacaggcatgtgccaccatgcctggctaatttttgcatttttagtagagacggggtttcaccatgttggccaggctggtctccaactcctgacctcaagtgatctgcctgcctcggcctcccaaagttctgggattgcaggggtgagccactgcgcctggccagaatgagttcttaaaagtgttgggtgaggacaaaggggagtttgaggcccaggtc

SEQ ID NO: 43778 - DNA, 1030 bp, Homo sapiens
gaacaacacattccagtttctttttgtttgtttgtttgtttttttgagacagagtctcgctctttctcccaggccagagtgcagtggcgggatctcggctcactgcgagctccgcctcccgggttcacgccattctcctgcctcagcttcccgagtaactgggactacaggcgcccgccaccgcgccaggctaattttttttgtatttttagtagagatggtgtttcactgtgttagccaggatggtctcgatctcttgacctcgtgatctgcccgcctcagccttccaaagtgctgggattacaggcgtgagccaccccgcccggcaacacattacagttttaatcaggcaacaaaaagggcagaggaacaataacctgcagttgcctggaactcttcaaaggccagttggcctttgaagttagatagcttagccaaaagagggatttgttaagtatatcctactcagtgtaggccatatttttttcctctgcgtgtagccatggttctgtgggctcgtttctctcattgtatctttaatgtttaaatctttttttttttttttttgagatggagtctcgctctgttccccaggctggagtgcagtggcgccatctcggctcgctgctagctccacctcccaggttcaggccattctcctgcctcagcctcccgagtagctgggactacaggcgcccgccaccgcacctggctaaaattttttgtatttttactagagatggggtttcactgtggtctcaatctcctgacctcatgatccgcctgcctcggcctcccagagtgctgggattacaggcgtgaaccaccacgcccagcccctaatgtttaaatcttaattggggtctggctgggtggctcatgcctgtaatcccagcactttgggaggcggaggtgggcagatcacctgtttgagttagagaccaggctggccaacatagtgaaaccctgtctgtactaaaaatacaaaagttagccaggtatggtggcgcacacctgtaatcacagatac

SEQ ID NO: 43779 - DNA, 1077 bp, Homo sapiens
ccatgcctggctaatttttctatttttggtagacatggggtttcaccatgttggccaggatggtctcaatccctggaccttgtgatccaccagcctcggcctcccaaagtgctgggattacaggcatgagccaccacacccggcctgatttttctttaaagtctcgctcttaaagtttgtttgttgtgtatggctgggcgtagtggctcttgcttgtaatttcagcagtttgaggggctgaggtgggaggattgcttgagcccatgagtttgagaccagcctgggtaacatggcgagaccctgtttctacatacacaaaaaattaactgggtgtggtggcgtgtgcctctagtccaagctactttggagatggaggcagggtgatcccttgagcccaggaggtcaaggttgcagtgagctgtgatcatgccactgcactccagcctgtgtgacagacagagtgagaccctgttttgggtggaggaaaaaaaaaagtttgtgagttaggggttagaacagaagtactttaaaaggtaaattatattgttgaaggaatggttgctagaagaaaaaaaatgaaaagtaagttatattattttgagaacactttaaatatattttatagtaacaaattttgcaaacttgctaataaaggcatgtggaaattgagaaaagcccactatttgagtgttgtcctcagagttctaacatgttgccctgggtgaatgagaacagtgagataagaatcaatatggattgccaaggtttgctaattcagggttttgctgcctagattatattgcttattattaagttgtgtgcagcatctgaatgagctgctacaagtaatttctttaatttttatcctttttttaatcaagaaacaggagttgcagacagatatttgtggttgtggtgagtttcaagtgacaggaacaaatgtaaaattgtggacgctctctttttctttcaaccttccatgttgccgagacagtcataaatatttttttctgtttagcaattaggaagggcctttggcaaaaattatactgctggtaatccaggtgtcctttcttc

SEQ ID NO: 43780 - DNA, 1052 bp, Homo sapiens
aatgttatgaaatttggctataatttaggttaagactaggaaatggaagcttgcttaaagtgctggaagatggcagtgattttactcagaaaacttaagactcatgtaaaatactggtctacaaagttaaaggcatatactcaggtttattatttgttttccctaccttaaacaataatttcttatttcctaatactatctgacatgtcactgattgttttctgtatataagctgtgtttttcctatttataaaattaggactttggcttctcagccagggcaaaacatagtaacacagatgataagtagaacctaaaacattgctttgttttctttctttttctagaagaaatttaaaataatctgttgaggattaaagttgatcacataggacccatccatccaaaggcatgggatgttttctctctctgtatactctttggtttttgtagaatgtaatgttctgtcaggctctgagtacatttactgtagagtgagaccaggtgtaaagagagtgagttctgagcaatagttttagcaggccaggcgcagtggctcacgcctgtaatcctagcactttgggaggccgagttgggcggatcacgaggtcaggagatcgagaccatcctggctgacatggtgaaaccccgtctctactaaaaatacaaaaaattagccgggcgtggtggcgggcacctgtagtcccagctactcgggaggctgaggcaggagaatggcatgaacctgggaggctgagcttgtagtgagccgagatcacgccactgcactccagcctgggcaacaaagtgagactctgtctcaaataaataaataaataaaatagttttaccaaaggacccatagtgagggcttacgtgggagagaggaaaattatgtaaagatacaggaattttggattgttacctgagtacctaatatgatgatgagggtgtgtttgtggttttctaaaatctttgtagaatataaattacttgagaataagaactaccttgcttattttatatcttgtaacgtttagcatagtatgttg

SEQ ID NO: 43781 - DNA, 2081 bp, Homo sapiens
ttacgtttttcactaattttctatgatttgactagatgacagagcacgtagatcgccacgaaaacttcctacttcattaaaaaaaggagaaaggaaatgggctcctccaaaatttctgcctcacaaatatgatgtgaaactacaaaatgaagataaggttagttgacactttactttttacatgtgatagatgttctttaagaaaatatcatagggttgcttttgttggagaaaatgtgctgaagaaaaatgtaaatgaatgtacagcagattctgagtggttttgtagttacagtaattaatgacttcaagttaatgtaaattatattttctttcctagaagataccatgcttttcctctttcttataggaattagtagagtgtaagtaatttacatttgagcttgaaattcagtttgaaaattaagaatctgttcccagcagttatggactttccaaggaaatcactcttcccagttaaaagtagagcagtcaggccgggcgtggtggctcacgcctgtaatcccagtactttgggaggccgaggtgggcggatcatgaggtcaggagatcgagaccatcccggctaacatggtgaaaccacatctctactaaaaatacaaaaaattagccgggcgtggtggcgggcgcatgtagtcccagctactcaggaggctgaggcaggagaatggcatgaacctgggaggcggagcttgcagtgagtggagatcacgccactgcactccagcctgggcgatagagcaagattccttctcaaaaaacaaaacaaaaaaaaatttgccaggtgtggtggcgcacgcctataatcccagctactcaggaggctgaggcaggagactcgcttgaacctgggaggcggaggttgcagtgagttgagattgcgcccctgcactccagcctgggcaacatagagcgagactccgtctcaaaaaaaaaaaaaaaaaaaaaagcgttttgctgattggaactaagattctaagaaatatggaatgttacttttcaggtattcctacaccacctgtatgtgcagaatcttagaaaggtggattaggagactgggtgtggaaggcaatgcacatttgtcttcaggtataaccattttacagaagaaacagctaagacctgagaagtttaataactgtcaaaattcttgattcagtaaatgaaaatgggaaggattgtaacccaaatcttttgcttctttatttacattgttttgttcctgcctcagaatgctgacaagtccgattccattctgactgttggtgttatggttcgtgatcagaagccttggctgggttgttaggattttttttttcttttcttttctttttttgagatggagttttgctcttgttgcccaggctggagtgcaatggcgcaatctcggctcactgcatcctctgcctcctgggttcaagtgattctccagcctcagcctcccaagtagctaggattacaggcatgcatcaccatgcctgactaattttgtgttttttgtagagacagagtttcaccacgttggtcaggctgatctcgaactcctgacctcaggtggtctaccaccccttggcctcccaaagtgctgggattacaagcgtgatccaccacgcccggcctaggttgttgttttgtttttttgtcttttttgagacggagtcttgttctgtcgctcaggcgggagtacaatggcacggtcttggctcactacagcctctgcctctcggattcaagcgattctcctgcctcagcctcacaagtagctgggattacaggtgcccgccaccgtgcccggctaagttttgtatttttagtagatacgggatttcactatgttggccaggctggtcttgaactcctgaccttgtgatccgcctgcctcggcttcccaaagtactgggattacaggcatgagccactgcacctggccaggatttttttatatttgaatattggatattgttaaatacaatttttcacagagtttcttctcattcagcaaggtagctgattaagacatgcctagttttaggccaggcacggtggctcatgcctgtaat

SEQ ID NO: 43782 - DNA, 1026 bp, Homo sapiens
tgactttttccataggattctattctttgccttctgtttttcagtttgcatagtgtaatgttatatgctattcatggcacagtttgaattcttaactgtttgtagcctggtgatttccaagcctgggtcagacttttaactgtagacttgatctttacttgcctgtcctatatgcaatttatttatttatttatttatttttgagacggagtctcgctctgtcacccaggctggagcgcagtggcacgatcttggctcactgcaaccttcgcctcatgggttcaagtgattctcctgcttcagcctccccagtaactgggactatgggagcacgctaccacaaccagctaattttgtatttttagtagagacggggtttcaccatgctggccaggctggtctcgaactctggacctcaggtgatctgcccaccttggcctcccaaagtgctggaattacaggcgtgagtcaccacgcctggcccctcctttatgcagtttagattcaacatgtgtaaagctgaattgacttcactcttcttgtatcccaaggcaggtaaacaagaattgttctctcattcttttacttggctcaccgtccatccacctagtgtctaaggcagaaaagttaaaatacctttaacattctcacgtctagttggtcacgaactggaagaattttgactctctttccttctgtattacagttacattagttcagatgtttgtttatttttgagacagggtcttgctctgttgtctaggctggtgtgcagtggtgtgatcatagctcattgcagcctcaacctcccaggctcaagtgatcctcctgcctcagcctcctgagtagctgggaccacacgtgtgcatcacaacacctttctaattttttttgtttgtttgtttagagacagggtctcaccatgtggctaaggcttgatttaaactcctgggctcaagcagtctccccacctcagcctcccagagttctgggattacctgtgtgagcctgtgtgcccagcctaat

SEQ ID NO: 43783 - DNA, 1029 bp, Homo sapiens
agcttcccaagtagctgggaccgtaggcatgcaccaccacacccagctaatttttgtaggttttttttttttttttttgtagaggtcagttctcacgatgttgttcaggctggtcttgtactcgtgagttcaagcgatcctcctgccttgacctcttttttttgaaacagggtcttactctgttgcccccaggctggagtggagtgttgtgatgacagcttagtgcagcctggacctccttgtggcctcggcctcatgctgaattacaggtatgacgcactgtgcctggctgtatacacaggtttttgactgcgagaggaggagaggtcagagccctaacccccatgctgttcaagggtcagttgcacttttttctctccataatctgtaatctaagtccctctcacacgggagcaggtaaaatcctgaaactatgatgtcctagggacctggagactctaacaataatgtttttaaatttgaacaattgagatttggctcactgggaagaccgttcagcctctgaggccttcattaataaagaatttgactggacttgattattgttgtctccaaaaatgtaggtgcaccaagtgtttggtgtgtattggtctccctccgcatgagtattagaggatcaaatgttagcttactatttaactggtacaaactttgcattagaatgtgatgttgtctgtctcccattctattttgtgtgtctagatgttttggatctgtgcagatggtttttgaggtactttcttaatgtagttcgaagcaaacttctgagagtgtcattgtagttggtccatcccaagttgttgatacttcagtttgttttctcctgtattgtgaatgctaacgtctgtattttccagtttccctcttctttttgatactgaagttttgtaataagggcattacttgcaattccttgaggttgagaagtgttttggttaggaatattctctctgctttccgaacatcagttttattgtggtcttacttctgcctctatattcctgaaat

SEQ ID NO: 43784 - DNA, 1023 bp, Homo sapiens
aaactaaacagttgttaaatatctatctgtatgtacttgacactgggctaattgctttacataatgtcttgcagaatttgcacggaaatcttgaagtggtaggtagccttgtacatttaaatgacatgttgaggttgatacatactagttatgagtgctttcagccgttatgtagcgaaattgtaataatagtccgtagttctcaaactttggtgtgatacttaagctactgaaaatgcgttcttggctgggcatggtggctcaggcctgtagtaccagcactttgggagaccaaggtgggcagatcacctgaggtcaggagtttgagaccagcctggccaacatggcgataccctatctctccaaaaaatacaaaaattagccaggtatggtggtgcatgcctgtagtcccagctactcgggaggccgaagtgggagaattgcttgaactgttttttttttttccctctcaggacaaatgtttaatttgcttctccatcatgcttgaactgttcttcagcccattccttgagagttcagaaggtctaggatagacctaacatttttcagttctaacagtctgcagggtggtagtgatgctgttacatgaggtacaacactttagtagtactggcttaaacaagacagacgtgattatctcatgtagtaagtcttagatagttccaagtttggtatagaggctgaatactattgtcaagacctagactttctctgtctttctgttctgttcttctcagtgtgttgagttctggtccttagctttgctgtcccctgagttgtgaaaaaatgtgactgtattcagagtgagggaatacttatcaaagcaggctaagaaaatctttccagaagcatatctggaaaaatctttcttgaagcataaaatagaaagctccaccctttatctttacatgttattggctagaccttggcttacataaccacccagagctgcagcgggggctgagaaagagagtatcttcctttgtatttaagtctcaaaag

SEQ ID NO: 43785 - DNA, 1309 bp, Homo sapiens
atgcgtggctagttttttagtagagacagggtttcaccatcttggccaggctggtcttgaactcctaacctcgtgatccacccacttcagcctcccaaagtgctgggattacaggcgtgacccaccatgcccgggctaatcttctttttttagacagtctccctctgttgctctccatcacagctcactgcaacctccacctcctgggctcaagtgatcctcccacctcagatccctgagtagctggaactacaggcctgtgccaccacattcaactaatttttttttaatagagatggggttttgctatgttgcccaggctgctcttgaactcctgggcttgagcgatgttcgtgcctgggcctcataaactgccactatgcagtttttttttttttttttgagactgagtttcactcttgttgcccaggctacagtgcaatggcatgatctcagctcactgcgacctccgtctccaaggttcaagcagttctcctgcatcagcctcccgagtagctgggattacagccgcacgccaccacgcctggctaattttttgtatttttagtagagacgggggtttcaccatgttggccacgctggtctcgaactcctgacctcaggtgatccacctgccttggcctcccaaaatgccaggattataggcatgagccactgtgcctggccggcccctacttttttttgttttgtttttttctggcccctgctttttaaagtaacaactctaggttgaacatcccaaatccataaatcagaaatgctccaaaatctgaaagtttttgagccccaacatgatcgtcaaaggaagagctcattggagcattttggatatttggatttgggatgctgaactagtaagtataatgcaaatactccaaaatctgaaagaaattcaaaatccaaaatactcccggttctaagcattttggataagggatcctcaacctgtaataataaaaacttactgttctctctttaagacatatttgttaatgtatttctcttacattctctctgatgacacagtgagtttttttttttcttttaatagttttttgtaaagtcgctatgttcaggctggttttgaacccctgggctcaagatccccccactttgtcctcccaaatgctgggattgcatgtgtaagctaccatgcctgttggagcttcttaaatatggctaaataatgtgttagaatgttatcaagctttttgaaagcttaaataagtccacttactgattcctcctctgtccttattttactacccatcccttccactcccctagt

SEQ ID NO: 43786 - DNA, 1033 bp, Homo sapiens
atgtagtgagaccaccatctccaaaaacataaataaataataaaaaagaaaaccacatttttctctttgcttttgagtggagtctcgctctgtagcccaggctggagtacagtggtgccatctcggctcactgcaacctccacctcctgggttcaagtgattctcctgcctcagcctcccgagtagctgggactacaggcacgtgcaccacacctggctccttttttgcactttttaagtagagacggggtttcaccgtgttggccaggctagtctcgaacacctggcctcaagtgatccgttcccctctgcctcccaaagtgctgggattacaggcgtgagccaccacacccttccacatttttctcattttaagaccaaggctgacacctggtatggttgttcatgccagcactttgggaggctgaggcaggtgaattgcttgagcccaggaatttgaggtcagcctggacaacagtgaatgaaaccctgtctctacaaaaaaaatagaaaaattagctggacatgctggcgtttgcctgtggtcccaattacttgggaggctgaggtgggaggatcacttgagtccaggaggcaaaggttgcagtgaagcgagatggtgctattgcactccagcttgggtgacagagcaagaccctgcttcaaaaaaaaaaaaaaaaaaaaaaaaggaacaaggctggaggggcagaccctgtgtgtgacatgtcttgcttgctagtttgctagtggcacaaagaaagagctagaagacatcatgactttaagcctcttccgggaagtgacatatattacatctgctcacatctattggtcgaaaccagtcacggggtcaagcttgatgttaatgaagaggggaggtacattcctcttcagggaccttgtagacaagccacatggcagtgggtggagatgtaaaaatcctcttatggaaaggaggtgaatagttagaaactaatacaatctatcatatttgaaggttcaatgaatgttttctgggaaaagttatttttga

SEQ ID NO: 43787 - DNA, 1034 bp, Homo sapiens
tttcaattaatttaaatattacctcacttttttgtcattatggtataaggtaaggcactttaaagtggaggggtggtgatctggtttttttcttgtcctgtgaagacttggaatgttctggagaagttccactagctctaccaaatactgcattataccgaagtaccccacttttttttttttttttttttgagacggagtttccctcttgttaacccaggtggcagtgcagtggcacgatctgggctcactgccatctccgcctccagggttcaagtgattctcctgcctcagcctcctgagtagctaggattacaggcgcgtgccaccacgcccggctaactttttgtgtttttagtagagatggggttttaccatgttggccaggctggtctcaaactcctgacctcaggtgatccgcccatctcggcctcccaaagtactgggattaacaggcgtgagccaccgcgcctggccagtaccctactttttaatacattcgaatcggcagtggagtagcaacttgtgagaatccgacatatacttttccaatgtcattaatgttttgagccgttgatggatgctcacacactttcagatgatactttctcaggtctggttctagcagagtataagaaacatgccatagagaagagacaatttctaagtatatttcaggtactgagctatgtaaaaaatggctgtaggaagttaatttaggactggcaacgcaggctttttcatattattgaatgaatgaaattgaaatatatatatgaagagttttgatggtaacaatttaaaactgaaaccggaaacattttaagtggtatgtatttaataaacattcttcattttttaatttcccataacagcatttaaaactgttttaacaaaagaagtcttaaaacatattatatattggggggaaattgctctttcgggaatttctgcaagtggaagcactttgaggatggtttttaaacaattgtactgtatggttggcagattggcatatttctttattaggctat

SEQ ID NO: 43788 - DNA, 1043 bp, Homo sapiens
gtttttttggtttaaggcagggtctcgctgttgcccagactagagtgcagtggtgcgatcctggctcactacaacctccactgcctcctgggttcaagcaattctcctgtttcagcctcctgagtagctgggattacaggcgcccactaccacacctggctaatttttgtatttttagtagagatggggtttcactatgttggccaggctagtctcgaactcctgagcccaagtgatccacccatctcagcctcccaatgtgctgggattataggtgtgagccactgtgcccggccaggcttcccagtttctaagtcaaaaaaccaggaaagactgtggatgtggggttggatctgcagcgccggaaatgagtcccagggttgtaggcaggggaggatgtttgatcatctgctggaaggagcagagtggacatcccattataattcgggtgggtgggaaggttctggttgggaggggtggccctggcattccatgctctgcctgctcctaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggcc

SEQ ID NO: 43789 - DNA, 1028 bp, Homo sapiens
aggctggtcttgaactcctggccacaagtgatctgcccacctcggcctcccaaagtgctgggattacaggcatgagccaccgcgcccggccaataggtcctatttctgaggttcactgagttttcagtgagatcatctgtatctcactgtcatagtcatagcagcacgtgacacacatacaacaaatgtcaagacccctcctcctccctaaacgccaaaggtttgaaggtgggcttcacgggagtggggaggagaagggcttacttggcttgacgccactaatgtcgggccttagggctcaagcaggaagggctctgccaccccctgcaggctcctatcctctaagattcttcctttcctgatccaacagtcatactcccacactctgaaatcgtcttggtgtcctgggagctccctggcactttgcaccgctcctggggcaagaaggactttccactttgcattgtctcgggttgtttgtttactttccttatctctcccgctaagctgtgggcaccctgcctgattcatccatgtgtcctgtcccagtatctgtctcagcataggtgcaaagggttccgcggctgagtgaagggaagaacttatcagtgttaaacaaagcctgccccagcccccaggaagccacatggttacagcctttccatgagaaacagtccagaggatggggtctctgggctggggaggggggcttcacttggccctgactttctgagagccctggacaaactttttttttttttttttgagatgggggtctcactctgttgctcaggctggagtgcaatggtgtgctctcgactcactgcagcctcctcctccggggttcaagcgattctcctgcctcaccctcctgagtagctgggactacaggtgcgcaccaccacgcccggctaattttttgtattttcggtagagacagggtttctccatgttggtcaggctggtctcgaactcccgacctcaggtgatccgcccacctcggcctcccaaagtgctgggattacagg

SEQ ID NO: 43790 - DNA, 1058 bp, Homo sapiens
caagctgctctgcagagacaagatccgcctgaacaacgccatctggagggcctggtatatccagtgtgagtggctaccaccagcctcccaagccgggagggactgccccctccaaccctcctgccagagggttctacatggtggctgcccaggaaaatccccggggtcctcaaggccagcactagcagagttctgccaaccttttttttttttttttttttttgagacacagtcttgctctgttgcccaagctggagtgcagtggtgccatctcggctcactgcaacttccgcctcccaggttcaagccattctcctgcctcagcctcccaagtagctgggactgcaggcacccaccaccactcccagctaatttttgtatttttagtagagacggtttcaccatgttggccaggctggtcttgaactcctgacctcaagtgatctgcccaccttggcctcccaaagtgctgggattacaggcgtgagccaccacgcctgaccctgacagccttttagggggagaccaggcccccagcaccaggactcctgaatagctcctgacctccagcgggtctcggggaataggtcccaaagggtgtttccactgtgaagctgggcacagcagaggtcacccctcagtagcactagggtaggctgagatttgaggtacagttcaaagcccattttgcatcccattagcatagttgggtgccttgaatgcgagggtaaaaagggccattagacactagcggggccaactgcatcactttgtaaatggagaaactgaggatcccgcatgggtctccaccagcctttcattgaagtccttcctgaatatccagtaggtgcccaccatggccaattgggcagaggggatccagagaggccatgccatctcgtggaaggaactctggacttagagttgcccagagctagttcctccaccccgtctctgccccttgctggctgtgtgacttcaggctagttgcctagcctctctgaacttgtttccttatctataaaaacgaggccacggtggctcacacctgtaatccc

SEQ ID NO: 43791 - DNA, 1030 bp, Homo sapiens
gagcctgcagtgagccgagatcacgccactgcactccagcctgggcgacacagcgagactccgtctcaaaaaaaaaaaaaaaaaaaaaaaagccaggtgcggtggctcacgcctgtaatcccagcactttgggaggccaaggcgggcagatcacctgaggtcaggagtttgagaccagcctgaccaacatggagaaaccccgtctctactaaaaatacaaaattagccgggcttggtgacacatgcctgtaataccagctactcgggagtgtgaggcaggagaatggcttaaacgtgggaggcagaggttccagtgagccgagatcgctccattgcactccagcctgggtgagaaaagcgaaactccatctcaaaaaaaaacaaaaagcaaaaaaaaacaaaaaacagcagggaaccatgcattttcagaaaaatgggacaaaggtactttttcgtgggaatggactgctttgcaccctggaagcttggaccaggaatgggaagccagggcaggaggggcccatcctgccccagactgtgctgagaaggagagcatgggggagaggtcttccaaggctgctcagtctttggtcatatcagcaggaactcagcggttctggtgtcccttggcctccagcagctgaagtgccagcagtgaagagagtagaaccaagaccaaggtgggatggaggttctaaagtgggcactctcagtgcttaaactgtgcctgtactagggggacactctgactgtctaggcctgaggctctaaagctcccacagcccaatccctctagctacagccgacatctctaaaaagcccatcaagcagttgctgcccccacatcgtcagggatggggaccatccacctcacagaacacccctaactttttttttgggtggggggacggagtttcacttttgtcgcccaggctggagtgcagtggcgtgatcttggcccactgcaacctctgcctcccgggttcaagcaattctcctgcctcagcctcctgagtagctgggattacaa

SEQ ID NO: 43792 - DNA, 1030 bp, Homo sapiens
gttcaagcgattctcctgcctcagcctcctgtgtaactgggattacaggctcccaccacacctggctagtgttttgtatttttagtagatacggggtttcaccatgctggccagactgaggtctcgaactgccgacctcaggctgtctgcccgtccagcctcccaaagtgctgggattgcaggcatgagccactgctcccggccctattatccatagttctaatccacagggattacagcataatgctagcagggccaggttcatccttgagacagtgtggctggctgtcacctggtcctccctttaccagccagccccattgcacactgtgcagcccatcccctcccagaaatagagtgacaaactctgcacttaagtcccctgtttctgtttaacttgcagtgcttatcacaggcccttccttaattttttaaacaaggctgcttgaggctggggtaaattttggggctttgggagtacacaggactactgagggacggggagttggtggcttggtgttcatggtggagacttggttctttacgcagagcaggctaaaggcgtgttttttctgctctgtttctaattcatgttaagtagttggtcatcactttggtcagagctgctgctgaagctctcttaactgtgagtcactggacgttggcagggagttggctgtgagattgtaggtgctcaagtgtttctgttcgggactgagtgtgaatctgtaaaaggggaaaatcctcgcaagaggtctacgagaaggatgagggcccaagtctagggtctaaacaaagccaggagtggtttggtatattactgagtgcaatcattgcgtgccattcctgcactcaatgtattgtgtaaaatccttaggtaaaatgggataaacccacagctggtcctacttggcctcttgaaaaccattccatcattgtgccaatctagcctgaaaaggaaaaaaaaaaagggaaaccattgattgtctcttgcctcggaggttgggggtatgcccctactccaggcttt

SEQ ID NO: 43793 - DNA, 1029 bp, Homo sapiens
agactagattgagtctcatctggtcatctggtcccctggctggccacctggctggcagccctgcctgctgatccctgggagcaccccccaccccgctccctgggctaggaactagaaccctaaggtcccctcctatggaaaatgtcaagtgtcctttgggcatttgaccccacggcttgtcttctccacccagaggctccctgagttggagcctgtctgccccattatgtcatggttgcctcctgggcatcctggagccgggacctgggctcccctgccttcatgtcccccacttgctctggcaccacggcctccactttgcctccagacctgttattcctggccgagcgcccagcccctggtgtaaaccccatgaggtttcaaaggaagaagatggtccctcaagtcgcatatgggctctaaacacttcccccgcggcccctgtggttgccctcaagtttcctgagctccgttgagtcagaatgagtgttttcctggtgacggatggctgtgtggtgtaatgtgctgatgtttaggcgcctggtaggttacctgagggtgtgtgtgggaaccaagtggtcaggggaaccatgggcccctacataggataatagcctctggcatgtcagccttcatccccctagctgaaggggaaactgaggcacaaaagaaacacggcttgcctgctagagggaggggtggtagaaaagggctttgcctcatccctgaagatagtcagactcaggcctggctgacactgggggacagccagtggagctggggttgtgaagcgtttgaacccagatctttttgctctgatgtctgtctctgttactacctcctcgccccctgattagatggtgaagccaggctttgctttgaatggtctgaggcttccgctccagacacccccaccctccccacacaaggcattcagagcccagggaggctgtacccattgctgggtggccctgcccagggagggctttctagcagacaggtggacggctggcaggcaggagcccaccc

SEQ ID NO: 43794 - DNA, 1035 bp, Homo sapiens
ccttcaggcttcaaagtgggggcggcctttgagcagtggggagtgcaggggcacctggccaaggaggcctgctgctcccagccccagcctgcctctggctgggcagcctcacctgtctctgtggttttctgcttgcaaatgagcacattctcgtaggaattggcatcatcatctgcaggagagagaggagtgggcacgggggtgtgggcagaccctgcaaagcctggctcatcctcccgctctgtcctgccttccctttgcaggggacctcttccgccaagccctagccctctgggtcccccgggacctcaagccttcttctggatgagcttcctaatgggtgctggcctggtgcccctgcatgctcttccctgagccctgagctcctctgtcttctttgtttcttgttgagacggtcttgctctgtcacccaggctggagagcactggcaaagtcagctcactgtagcctccaactcccggctcaaacgatcttcctaccccgcagcctcctgagtagctggaactacaggcatgcaccaccacgcccagctaacttttaaaattgtttgtagagaggatctcgctgtgttgcccaggctggtcttgaacccctaagcttaggcaatcttcccaaaatgttgggattacaggcgtgagtcactgtgtccagcctctgtcttctgagatcccctccatatgcactctggagggggtactctgcgggggctgcaattcaggcccatgccgggtggctggagagagggagggaggcaggggcagcctcaggggttcatctctataatcaggagctctccctagagccactgccgggaaggggctggactcttccagatagggcagggcaggctgaggatgctttgctcggggacccaggctgagtatggcacctcagcgcctggcaccccatcttggccttgtaatggggaagctgggctctgactgatgccccacccaaaatccatcagtgatgttgggggtcctaagaaatgagcactgccagcctggcggggtg

SEQ ID NO: 43795 - DNA, 1046 bp, Homo sapiens
tcacattgtgggtgatgacgtgggcccaggggatcccctggcccctaaagggcaggcaggagcactgtgctgttccccagtagccttcagaccccacaccctgggttttttctgcaatgctgtgccctgctccccacttctgcccctggagggtgggtagtaaccctcaaagccaggctgaggaaaaggtttctcacttactctcccatgtcagcaaaacatttttctcttgggaattcttttgaaaactgcttccgcatcctgataactccgcgtctaaatgccatttgagagattcacttcccccttatttgggggaagaaactgggaagggctgtccaagctttcagcctatagctgtttcttaccaggtttgtggacaacagacaagcgatttttgaagcatctgggtagatctgggcagtgaatgcattttcgaggccacttaggaaggggaggcccgctcagaaacaggggtgatggttcgggccctgttttgtcttggagggtcactgagggctcaggaaaccatggcttccaccgggaaaaggcaagggcaggtgtgggtgacctctggagccatcaggaggctttcattgggaagatgtaggggtcgacattgtaccagaggcagagcctcatgccactgcggagaatgctgcagggaggacggagtccccagcaccatgcacctgcctgctggagtagcctgaccccttgtttagggtgtcaggctgaggctgggggaccttttgtagggaaggccagttcctactccggggtggaggtgggaattggcccaaaagacctcccagttctaaagtgaattccaagtggttctgggcaactgaccccccaagtgatctaagacagatgacttgtgactttaaagctgtccccaagtgagcatccttcacaggcccttggttgctctcttgttcatctgtcttatgtttgggaaatttatcttcctggtgccggaagcacttctctttgatggtgagaggagcattccccaaactcatcctggttgctggagaatttga

SEQ ID NO: 43796 - DNA, 1037 bp, Homo sapiens
ctgtgcctggcgaaataaattttttttagggccaggtgcggtggctcacacctgtaatcccagcactttgggaggccgaggcgggcagattgcttgaggtcaggagttcgaaaccagcctggccaacgtggaaaccccgtctctactaaaagtataaaaattagccggacatggtggcgcccaggctggaatgcaatggtgcttgtaatcccaggtactaaggagtccaaggcaggagaatcgcttgtacccgggagacagaggttgcagtgaactgagatggtgccagtgcacaccagcctgggcaacagagcaagactctgtttcaaaaaaaaaattttttttttttaatgtggcagtaattcatgttctttgaagaaaatttagaatatattaatagtttgctgcctttttatttatttatttttttgaggtggagcctcactctgttgcccaggctggagtgcagtggcatgatcttggctcactgcaacctctgcctcctggattcaagtgattctcctgcctcagcctcacgagtagctgggactacagacgtgcgccaccacgcccagacaattttttttttttttttttttttgtatttttagtagagttgacgttttgctgtgttggccaggctggtcttgaactcctgacctcaagagagccacctgcctcggcctcccaatgtgctgggattacaggcatgagccactatgcctggccattaataacttgctttttttcttctctttttatatactatcaatgtttacacagttgagatcataatatatataatttttgtatcctggtttttccttttaatgttgtaggcattgctctacattatgataatctggtaaacaggcttttttgtattttttaaaattttttgtagaaatagaggtcttactttgttgcccaggctggtctcgaactcctggtctcaagcggtcctcccgcatcagccttttgagatgggaggattgcttgagcccaggagttcgaggctgcagtgagctatgattcca

SEQ ID NO: 43797 - DNA, 1045 bp, Homo sapiens
tcccagctactcgaggccaaggcaggaggatcccttgagcccaggagtttgacgctgcagtgagctatgatcacgccactgcactctagcctaggtgacagagtggacacccttactttgagaaacaaaaagagtttgggcttcatagtgagggcagggaggagtcaaggatttcagttagggaaaaatgttttaatagggccgggtgtggtggctcacacctgtaatcccagcactttgggaggccaaggcgagtggatcacctaaggtcaggagttcacgaccagcctggccaacatggcaaaaccccgtctctactaaaaataaaaattaggcaggcatggtggtgggcgtctgtaatcccagctactcaggaggctgaggcaggagaatcgcttgaacccgggaggcggaggttgcagtgagccgagattgtgccattgtactccagcctgggcaacaagagcaaagctccatctcaaaaaaaaaaatgttttaataggtgtgtactttaggaaagtggtcgtggttacaggatgggaaatggatttgaatgggagcatggagaccacttaatggcccattgatagcaatcagacgagataatgggcttaagaaagtggtagccgggatggagagaagggatggagagaagtaaaggacgctggagacgaaggaggaggatggtgaagccctggttattgaagtactcagggtgaggatgaggccaaaccaagatgatggcaacctcaacttcatggcatagacagtccatggtgggaaacatgggtggggcctcaggtttgtacaggagaatgaagtgttcagttttgaagatgccgaggtgagtacctgtagtcccagctactcgggaggccaaagcaggaggatcacttgagcctgggaattggaggctgcggtgagccttgatcacaccactgcactccagcctgggtgacagccagagtgcatctctaaaagaataaaaagaacttgaggtgagagttccatggggcatccagtccatgtggataaatttgtagcc

SEQ ID NO: 43798 - DNA, 1088 bp, Homo sapiens
tctttgattctatgtttttgatcctcctggcactccagacctgggtgatatgcaggagagcacactgatagaaatccttgtgtccagtgcccagcaactcctgcctcagcctcccgagcagctgggactacaggtgcccgccaccacgcccggctaacttttttgtatttttagtagagacgggttttcaccgtgttagccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcacgcacacgcacacacacacacacacactccattcactgtctccatgactctggagtaaactaacgtctcgagttgccattggaagccccattgtcctcattttgttttgttttgtttgtttgagacggggtctcgctctgtcccccaggctggagtgcagtggtgcgatctcagcccactgcagcctctgcctcctaggttcaagcgattctcctgcctcaccctcctgagaagctgtgatcataggtgcccgccaccacacccgactaatttttgtgttttttagtagagacagggtttcactatgttggccaggctggtctcgaactcctgacctcaggtgatccgcccaccttggcctcccaaagtgctgggattacaggagtgagccaccacgcccagcctccgttgtcctcatttagactttcctgggttataggcacttttgacttcctggggtccttcttcagttaaaaaaaaaaattagaaaattaggccgggcgtggtggcacatgcctgt

SEQ ID NO: 43799 - DNA, 1038 bp, Homo sapiens
tcagcctcccaagtagctgggattacaggcgcttgctaccacgcctgactaattttttgtatttttagtagagatggggtttcaccatgttggccaggccagcctcaaactcctgacctcaagtgatccagctggcttggcctcccagagtgctgagattaccggcgttagccaccacgcccagccttcccgttttttctgattggcctgacttcttctttttctctttggtagcctccacctccccagcttggctattcgatcactgccgaggacctagacttagagaagaaggcttcattacagtggttcaaccaggccttggaggacaagagtggtaaggagcacagatcgttgcactctcgagaggtttcaggtgtctgttttctttggttttattttggtgtttggaaaaatgggtttctctgggaaaatccgaagtagagttccatgttttcttgtggtctttctcacctgagatatccgtgttggtcttcacgggaactggacagcagggaccactgcaatttagggcagacattcctccatgagctgtgctgagagcctgctctccgacaggcatgtggaaagaagtcccagacaagccaggactgcttcacctttctttctttcttagatgctgcctcgaactctgtcactgagaccccacctaccactcagccttcatttacctttaccctgcctgctgctgcaactgcctccccacccacctccctcctggccccaagcaccaacccactgttagagagcttgaagaagatgcagactcccccgagcctgccaccctgcccaggtgagctggagtggggccgtggatccagccttctgagcagcatccccggcttgggttggaataagggcgtcgtgcctgtcagtcgctggagattgctctgcaggccgaacgcaccctggctcagcacaccggagcgggcctacgtttaacagcgccggagcccacatcaggaagtgttagagaaggggtgctgcgacgctcaggatctgaagcctggcttagct

SEQ ID NO: 43800 - DNA, 1059 bp, Homo sapiens
gcccaggagttcaaaaccagcctgggcaatatagtgagaccttgtctgtacaaaagaatctttaaagaaatttttttaaataaagtaattggttagcaaaagtttactaatcaccttctatctgttggacattaggattgtctctaactaatagaaaatacagatcattgagtgatcaatataggccagcagaacggagtagaaagcccggaatgtaaagcagtgcatgtgtgcgagctgattcgagacagagctgtgatgtagataaacggacagagggtgattcgaaaggtagactgagtccagcttgtattgggtcataaaagagatttataggcatttagaattgagcgcagggtttttaaacaagtggtcatgattttttggaaaggggattattgcatagtataaggaacagagcaggctttgctgctggacagacttagattcaaatcttggctctgaggctgggcgggatggctcatgcctgtaatcccatcactttgggagatcaaggtgggagaacctcttgagcccaggagttcaagactagcctgtgcaacagagcgagactgtgtctcaaagaaaaggaaaaaaatgcttggctctgacatctagtagctataaggtcttgggcagacaatcacataacatctctttttcttatctctgaagtgctgttgcaatgattgagggtaatatttaaaaagcacctattacagtggctgtcagtaagtgggtatccagtatacagcagccagacaaaaagatgtaaagcatgtaaggagaaacgtttttgagacaaggaaaattttgagatgagttcatcagcccagaaggctctgagtcatataaatgaacattaataaccataataccattacccctcttaaattattaaccttaatattatttaatatctagttattatttttgataagcaaacttttccagctttggactatgggagccaaactggctcctgtatcctttattttgatcccagcagtcttcgacagatagcttcattgctttttgcccaccttcccaaagtccatt

SEQ ID NO: 43801 - DNA, 1080 bp, Homo sapiens
aaaatgctttgagaataaggtctgctctgctgccttcaataccagaaaccacactgggaatgtgggctgccatcttcaaggttcccactgaaccatggaaggttgtggggcaagggcaagtaaaataacccagttttcctaccattttgaagttgcttttttcttgattcagtgttcatttggagtattagtcagttttcacactgctggaaagaactgcctgagcctgggtaatttataaagaaaggaggtttaattgactcacagttccacttggctggggaggcctcaggagacttacaatcatggtggaaagctaacaagaagcaagtaccctcttcactggctggcaggagagaggggagagtgcaggggaaactgccacttaaaaaccatcagatctcgtgagaactccctcactatcacgagaacagcatagggcgaaccgcgcccgtgatccagtcaccttccaccaggtccctccttgacccctggggattacaattcaggatgagatgtgcttggggacaaagagccacatcagatgatctggttattgtaaacctttgattatttttctacagttctcatgaagttgattcagacagttttgcttggtttatcaatgtttctgtggggggatggggacttggagatacctactctgccatttttgctgataccagtcaacatgttatattttcacttttacataattcaatatgttttccagtttcccttgcgactcactctttgacccatgaattatttagaagtgtatttaatttccatgtgtttagagattttctggtttctttttaaaattgatttagtttaattattttacagtcacagaacgtattttgtatgatttcagttattttacatttcttaagatttgttttggccgggcatggtggctcacacctgtaatcccatcactttgggaggccgaggcaggtagatcacctgaggtcaggagtttgagaccagcctggccaacatggcaaaaccctgtctgaaaaacacaaaaattagccaggcgtggtggtgcatgcctgtaatcccagctacttggaa

SEQ ID NO: 43802 - DNA, 1054 bp, Homo sapiens
tgtgccaggccggactcaggctacttttttatttttttttttgtagagatgggatctcactgtgttgccagactggtcttgaactccaggtctcaagcgatcctcctacctcagcctcccaaggtgctgggattataggcatgagccaccacacccagtccacataccattttaaagtgttacaattcaggctgggcacggtgtctcacgcttataatcccagcactttgggaggccaaggcgagcagatcacctgaggtcaggagttcaagaccagtctggccaacatggtgaaaccccaatctctactaaaaatacaaaaatagccgggcatggtggcgcatgcctgtaatcccagctacttgggaggctgaggcaggagaattgcttgaacccggtaggcagaggtttcaatgagccgagatcacgccattgcaccccagcttagacaacaagagtgaaactccatccaaaaaaaaaaaaaagaactgtagacaggatagtttcatctacctgtcttcatgtgttcaatgactctctcttccatctgctctaatgaattcgaaatagtctggtgaatttttcatttccatttctatacttttttttttttttgtttttttttttgagatggagtttcgttcttgtcacccaggctggagtgcaatggtgcgatcttggctcactgcaacctctgtctcctgggttcaagcaattctcctgtctcagcctctcgagtagctgggattacaggtgcccgccaccatgcctggctaatttttgtatacttttcagcttcagactttgattcctttcaataatttctatttttttcctttctttttttctctaagctttagtttgtctataataaattcttttattgagacagggtctcactctgtcacccaggctggagtgcagtggtgcaatcttggctcactgcagccttgacttctcatgctcaggcaattctcccacctcagcctcccaagtggctgggactacaggcgcatgccaccacacttggctgattgtttgcattttttgtaga

SEQ ID NO: 43803 - DNA, 1035 bp, Homo sapiens
caccacgcccggtgctttacattaaatttaaacatacttgagcaccagattttttgattttctctacagtcgtcatatgagtgaaggtggtaatatgggacactgcattttctaaaactggccaagcaagagaaccatctgttgagcttttggcattttcagaatattaggcatcactccaaaacctactgaatcagaatctcaggggttgtgccctggagaattattttttaaaagctcactaggtgcttctgatttagctcgttctctgatggcatttggataatcagtcctaaggccccaggccctgctctgtcattgactgtcattttgagtgagtcatttgatctctgggtctttttcccacttataaaaaatgagggtgagagctgggtgcctagatttgtttgtaatatttaatctcattttgatgcatgcagggtctgtgctaatagcctcccttttattcctgatgctggtcatttgcatcctctctctttgctttttttttttctttgattagtctggctagggatttcttatttttaattgatcttttcgaagagccaacatttggtttaattgattttttaaatgtttctattttaacttcactgatttctactcttacatttttttttttttaatttttattttttgagatggagtcttgctctgtcacccaggctggagtgcagtggcacaatcttggctcactgcaacctccacctcctgggttcaagcgattctcctacctcagcttgggagtaactaggattataggcacatgcaatcacgcctggctaatttttgtatttttagtagagatggaggtttaccatgttggccaggctggtgttgaactcctggccttaagagatctgcccacctcagcctcccaaagtgttgggactagaggtgtgagccacccctcccagcctgctcttatattaattctatttccttctttctgcttgttttgtggttattttgctcttctttttctagtttcttaaaatggaagctcagattctt

SEQ ID NO: 43804 - DNA, 1054 bp, Homo sapiens
gttttgaagaaactgggttggttatcctcagtttggattatgttacccttgtttcacctttagcacattttttaaaaatatcttgtatgtcttggtaaaattggtagtttgatctggaagtctaatcaggtttatgttcagttcttttcacacaactataccatacgtggcatttgtctacttctggaggcacgtgttaccttctttgtttttgtgaagttaagaactattgacttgattattgctgtgatttactattgctgtgatttgccttcattaggggaggcaaaatggtgatctgctaattctaccatttcttctttatttactagccaaaatacttttcttttctttttttggagacagagtctcactctgtcgcctaggctggcacgtttatggctcactgcagcctcaaactcctgtgctcaagtgatcctcccacttcagcctcccaagtagctgggagtatagtcatatgccacaatgcccagctgattttttaatttttagtagagacaggtttctctatgttgcccaggctggtcttgaactgggctcaagtgatcctcttctttaacctcccagtgttgggattataggcatgagccaccacggctggcctagaatacttttctaaagataaatttctattctctatttgtttatgtaattcatgcaggaaagacagtttctaaaatattgagtaggcttttaagcaggagggtattttgttttgttaccatcatgagctcatgggtttaaacagatagtaaatatttcagtacatagaagttgtgattctttttgaaaattaagtggttccatctttggccagacggaatccctttaagttggtttctgagtccttttgaaatatatttgatatatatgatagcaaatatatacatataatatatgtttgatagcaaatatatacatatatatttgatagcattattttctatttagcattttattttgaaatcatttcagattttcagaaaaattgcaaggattttacaaagaaatcccagatacttccttttgttca

SEQ ID NO: 43805 - DNA, 1050 bp, Homo sapiens
cattgattataaggagaaaccaattttgttacttgtggatttaaaagattttctaggacttggaaaaatttcttcattcaagttgatataattgtggatagctttcctaacaacaaccattaaattactgacttatggcttattattggtgcttatgtaagcagagggcctgctgcccaaggagaacttggtgcatataatttttccagggacggaaatatcgtgatccaagtaaacagaattctgtttttactgttgagtcctagatcatggggggaatgaatgacatgatcatccttcagatatttgttcgtctttttgtttgggttgcacagcaaacaatacaaacagttactctcttgtgaagatttcctcatttctgtttctcatttcagttctcagtgttttcgttttgtccttttcactttgctgagtcagtcagtaaagatgaccagtgatttaattgcagtcaaatccagcgggcaattcctagccccttcctcacaggaccctttgtctgcctttgacatccgttacttcgaaactgatattttctccatggagtctctcttttcttggctcttaaaaagattcatctgtaagtatttctgtttgtctttaaatggtgaagtcttttgttttgtttctttttttctttttttgagatagggtcttgctgtgtcatccaggctggagtgtagatgtgatcaaaactcactgcagcctcaatctcctgggctcatgcgatcctcctgcctcagcctcccacgtagctgggactacagatgcacgctgccacacctggctaattttttttgtattttagtagagactggctttcactgtgtcacacaggctggtgtcgaactcctgagctcaggcagtctgcctgcctcggcctcccaaagtgctaggattacaggcgtgagccactgctcctggcctagagatgtattctcactgtattgctcaggctggtctcaaactcctggcctcaagttatcctttcactttggcctcccaaagtgctaggattacaggtgtaagcca

SEQ ID NO: 43806 - DNA, 1057 bp, Homo sapiens
cttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaat

SEQ ID NO: 43807 - DNA, 1031 bp, Homo sapiens
tgaccctgaacagggccaggcaggtttatggaagaagtcgggtgttcaggtttatggaaagggcttttgttgttgctgttgttgttgaggcagagttttgctcgttgcccaggctggagtgcaatggcatgatctcggctcactgcaatctctgcctcccgggttcaagcaattctcctgcctcagcctcctgagtagctgggattacaggcatgcgccaccacactgggctaattttgtatttttagtagagacggggtttcaccacattggtcaggctgatctcaaactctgacctcaggtgatccgcccgcctcagcctcccaaagtgctgggattggaggtgtgagccaccgcgctccaccctgatggacatttattacatgcaaactgacgactatctgcagggagtgggtgtgtttggaattaggcctggggagaagcggttccaggattccatatatggggaatttaaggtgtggagagattgaaggtgcccctgaacagggccaggtgggtttacggaagaagtggggtgttgaggtttacagaaagggcattttaaacaaagattgctgctgtcaaggcaagcaaaaggctggctaaatggaaaggggctgggagatgctgcctggaggaggagccaaggggtcaaggtgcaggactccctgcagggaccaaggtccttgatgaggagcagaagcacactctcactttttttttttttttttttttgagatggagtcttgctctgtcacccaggctggagtgcagtggcgtgatcctggctcactgcaacctccacctcccggattcaagcaattctcttgcctcagcctcctgagaagctgggattacaggcgcccaccgccacgcccagctaattttgtatttttagtagagatggagtttcgccgtgttggtcaggctgatcttaaactcctgagctcaggtgatccacccaccttggccccccaaagtgctgggattataggcgtgagtctctgcacctggcttgcacacccttactt

SEQ ID NO: 43808 - DNA, 1114 bp, Homo sapiens
ggctggagtccagtggcgcaatcttggctctctgcaacctctgcctcccaggctcaagcgattctcctgcctcagcctcccgagtagctgggattacaggcgtgcgccaccatacctggctaatttttgtattttttgtagagacggggttttgccaggttggccaggctgatctcgatcaagtgatctacacaccttggcctcccgaagtgctgggattacaggtgtaagccaccatggccggccctgcttatgtttctaataacagtagttgccacaaagcattgtgaatattaaagataaggatgcatgtctggcaatgggcattccctccccttactgagctgggaaggagctagaagaaggggagtcttataggcaccagcgtgggggatgctaggacacctagtgagcccaaggccaaacatttttgcaggcttcaggatttgggggaaagccatttgcaagattgctctggtttgccataaagctttcaaccctgggactggccagaagtaggacgagacaaaatgacccaaagcagtgtgtgaggacacgtcaatgtcacttgatgtgtttccacctggtgaatgactggcgagtcattggaatttcactgtacttggtaggccctggcccttttcacattcacatagtcctgccttagtttgctttcttcctgttttttctttgtttgtttgtttttgtgtgtatgtgtgtggtttttttgagatggcgtctcactctgtcacccacactggaatgcagtggcacaatcatagctcactgcagcctccccaggctcagatgatcctcccacctcagcctcctgaatagctaggattacaggtgattttttttttaatcttttctagagacagggttttgccgcgttgccaggctggtctggaactcctaggctcaagtgatcctgctacctcggcctcccaaagtgttgggattacaggcatgagccacggcgcctggcctcctgctgttttaacagcctttttcctgcctctttttctcccttggccgccactgcacacatgccaatacccaaacccagcgacctctgtgcctcctttcctgcccgcaaaattcagctgctggg

SEQ ID NO: 43809 - DNA, 1047 bp, Homo sapiens
ggagcagaggggagggaaggggaggggaggggaggcgaggggaagggaggggaggggaagggaagggaggggaggggaagggaggggaggggaggagaagggaagggagaaagaaggaaaggaaaggaaggaaaggaaggaagagaaagggctttagctaaagtagcagaatggctacacaccttcccaagattagctgcatgcataatagtaaagaaataagaatgagaaagacccacaaggacaaagaaaatgagagagggatcattatcaaatagggtattttaacacattttggaaagaaaagaagaaatgataggccaggcatggtggctcacacctgtaatcccagcactttgggaagccgaagtgggtggatagctttagcccaggagttcgagaccagcctgggcaacatagtgagaacccatccctacaaaaaatgcaaacattagccgggcatggtggctcacacctgtcccatctactcgggaggctgagtgaggcaggaggattgcttgagcctgggaggtcaacactgcagtgagccatgatcacaccactgcactccagcctgggtgacacagcggaaccgtgtctaaaaagaaaagaaaagagatgctgacaggaggaaagcaaatgccaagagagacttgaactgggagacatcatactggaggcacgggggcagaactgaaggcaggtggagaggatgtctaagaaccagtaccagccaggcacggtggctcatgcctgtaatcccagcactttgggaggccaaggcaggtggatcccttggggtcaggagttcgagaccagcctggccaacatagtgaaaccccgtctctactaaaaatacaaaaattagctgggtgtggtggtgcatgcctgtaatctgagctacttgggaggctgaggcaggaaaatcgcttgaatccaggaggcagaggttgcagtgagccaaaattgtgccaccgcactccagcctgggtgatagagtgagactccatctaaaaaacagacaacaacaaaaaaaactggtaccgc

SEQ ID NO: 43810 - DNA, 1033 bp, Homo sapiens
ccactgtgcctgaccttggtagcatttttatgagaatgaaatgtgaatattctcatcccatccggagaggctacagcagtcattcttgtttaggggttaaaagttttcaccgggtcaggggccgggtgtggtggctcacgcctgtagtcccagcactttaggaggccgagacgggcggatcacgaggtcaggagatcgagaccatcctggctaacacggtgaaaccccgtctctactaaaaatacaaaaaattagccgggtgtggtggcgggtgcctgtagtcccagctactcaagaggctgaggcaggagaatggcgtgaacccgggaggcggagtttgcagtgagccgagatcgcgccactgcactccagcctgggcgacagagcaagactccgtctcaaaaaaaaaaaaaagtgttcacctggtcactgtaaccccaggagacgtttctgtccccttctcgttggttttcctcaggtgttgtcttttgtctctgccgtggctgtgttttgagtgactgtagatggtaagctccatgtcagttaaccagcaaatatgtttttcaggactcactgtaagtaccaggtgtgaaaaaacagatcccaccctcatggagactctgcttggtcccttgaggacaggagacctgtcatcttcttctgctttctctgcaaaggcccatcagggttctgggtgagcaggttagctggaatgtcagtctgccctcaacagtgcccttcatgccacagaaaaggtttcccaagtgcctacagggccaggcgccacaagtcagggctgaacctggcttgattgctgggttcgagttgctcttggaccccaggaagagctgacgggctcatggtcaccgcagtcactttcataaccacagtagcagaggatgtgaaaagggtgggatgagcccaggaagccagcatgaactgtctcaagctgtttattcaagaactcggtgccggccaggcacggtggctcatgcttgtaatcccaacactttgagaggccgatgcgggcgga

SEQ ID NO: 43811 - DNA, 1075 bp, Homo sapiens
ggctgaggcgggcagatcatctgaggtcaggagaccagcctgcccaacatggcaaaacctcatcgctaacaaaaactcagccaggcacggtggtgggcacctgtaatcccagctactcaggaggctgaggcaggagaatcacttgaactcgggaggcggaggttgcagtgagccgagattgcgccactgtactccagcctgggcgacaagagtgaaacttcgtctcaaaaaaaaaagaaaaaaaaaaaaggtagagatcctgctgttacatgctacaacatggatgaaccttgaagacattatcttaggcaaaataagtgagtcctaaaaagacaaatactgtatgattccacttctatgaagtgcctggagtaatcacaaacatagagacacaaagtagaatggtggttgccaggggcttgggggaagggagatggggagaaattgtttaataggatagagtttcagttttgcaagaggaagagttctgccgatggatagcggtgatggttgtacaatagtgtgaatgttctcagtgccagtgaactgtacacttaaaaatggttcagatggtaaattttatattacgtgtattttaccacaacttaaaacttggaaaagaaagtaaaacgcatttgtacttatttaaagatgtattaaaacatgggataaggtggaattccaagcttttaaaaaatctgtttctggaactggagaatttgcattatccacatagttggccaggtgcagtggctcatgcctgtaatcccagcactttgggaggctgaggcaggcagttcacctgaggtcaggagttcaagaccagcctgggcaacatggtgaaagcccatctctacagaaatacaaaaattagccgggcatgatggcgggtgcctgtaattccagctactgagacgggaggatcgcttgaacctgggaggtggaggttgcagtgagtcgagatcaggccactgtactgcactccagcctgagcaacagagtgagactccgtctcaaacaaacaaacaacaacaacaacaagaaacagttgattaagctgttatgtaggctgggt

SEQ ID NO: 43812 - DNA, 1044 bp, Homo sapiens
tggcaaaacaacaatctacagatttattgcaatctctatcaaaatcccaataatgtttttgcagaaacagaaaaacccatcttaaaattaatatggaatctcaagggactctgagtagccaaaaccatccagaaaaagaaaaacatagctgggggactatgtttttcctgatttcaaaacttattataaaactatagtaattaaaacagtgtggtactggcataaagacaaacatatagaacaattaaatacaatagagagcccagaaataaactctcctcaatatatgattaaatgatttttcaacagagtgccaaggccattcaatgaggaaaaaacttttttttttcaccagatagtgctgggaaaactggatatccacatgcaagagaatgaatttggacacttatcttacaccatatacaaacattaactcaaaattgatccatgacctaaatgtaagacctaaaattataaaactctaagaagaaaacacggggcaaaactgtcgtgacatttgatttggcattgatttctgagctatgacaccaaaaggcacaggcaacaactacaaaaccagacaaactggacttcatgaaaattaacacttttggggcatcaatagacactatcaacattaaaaaaggcaacctacagaatggaagaaaatatttgtatatcatatatctgataaaggattaatatccagatcatatagagaactcctaaaactcagcgatgaaaaacccaattcagaaatgggcaaaggacttgaataaacatttctctaaagaagatatatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtataaatctttaatccatcttgaattgatttttgtataaggtgtaaggaagggatccagtttcagct

SEQ ID NO: 43813 - DNA, 1994 bp, Homo sapiens
cagatgttcatgctacaactgtcaccagcttggggcttgggatttagatttctgttgccaggcagtcatttctttataattacttctcgtttctatttaaaaataccttctccttggaaagtaaccccagatgagtgtgcgcttctcaccaagctcagaagagctaccagagggaggcattatgagagctacgctgccccctcaccccaagactggcaggggactggtggaggagccctctctctcccaagtgctggttgacaagcagcaggtgataagggatgaggccctgagatctttcctggtgaaaagtcagctgcagatgcagaggccaggaaagagggcatacctcagagagaggtctggactgaaattccactcatgccttccctggagccagacggcttcccctctatcctctcctctggtttccatcttgggctcattgggtaatcaggataatgtccaaaaaagtaaaaaactttaggatggcgtttttgatctcaaatgtcccttccagactataaataggactatcctaggagttctgaactttccttgaggctgaacttgtatctcttttgggagagaaactacatggctctttttgtaagaagctctctgcccagtgaactctcttaaactttgtatgtctgtaaatgtctacatttcaccatctttttttcctcctttgttatagccaagattttattggtccttgcttggtgatcagtacacaagcatcatgaattattaatgctagtattaaaaagcctaagcagtgtaattgtgatactttgctaaagagtttgctaaagagttactcaagtgatgttgcaatctaagagttggagataatttacccacaaattaggacattagaactcaaaatcttagaaggttgctaatttgtaagtctttcacagggaatatcctgataacacaggatgtgctatattacacattatatccacaacatattaatactttgggggaaattctggacttttgggagcacaatattgccacagatagtgtgcagttctcataggtagacaaaagacagaagacacagtgataatagtaggggaacaaacacacatatgaaagatgagtaatttaaaaggtttgcttatgtcttggtcatttggggcatgtgtcactttagagggtttttttataatgttctttatagtctatggaatggtaagttaacatcaaataaagcctcccttaatcaagccttccactaatttctggttttagtgaaattaaccagtacatgattttaactcttaaaaaggcattaattaaaaaaaattacaagatagagtctcaccgtattgcccaggtagcagtgcagtggctattcataggcatgatcatagtgcactatggccttgaactcctggcctcaagtgatcctcccacttaagcctcccaagtagctgggcctacagacatgtgccaccatgcctggctttacaagatcgtttagaactaacaccagttcttctcaagcttttccaaaaaattgaagagaagggaacactccttaattcatttgatgaggtcaggattaccctgataccaaagctagacaaagacactacaagaaaactattgatcagtattccttataaacattgatgtaaaaatcttcaataaaatattagtataccaaattaagcagcatattaaaaaaaattatacaccatgaccaagtagggtttattgccagaatgcaaggatggtttaacttatgaaaactggtcaatgtaatacaccacattaacagaatgaaggaaaaaacccacatgatcatctcaattaatgcagaaaaagcatttgacaaaatccagcaccctttcctgataaaaacactcaatatgccaggcacagtggctcacgcctgtaatcccagcactttgggaggccaaggtcggaggatcacgtgagcctaggagttcaagaccagtctgggcaacatggca

SEQ ID NO: 43814 - DNA, 1432 bp, Homo sapiens
gagtaaagaaaaagaaccagcctggacaacatagtaagaccccatctctacaaaaaataaaattagctggttgtggtatcacgtgcctgttgtcccagtaactttggaggttgaggtgggaggattgcttgagcccgggaggcagaggttgcagtgagcaaagattgtgccactgcattccggcctgggcaacagagtgagaccccatctcaaataaaaaaaaaagaaaaagaaaaagaaaagaaaagaaaagagaacagccctaaacccaacgttagtcaatctgcaaaaaaattattttgtttaatgactacctatcaaatgtattatgaggttgcagagcttggtaagcaaagggaaaaaaggggaagaatgtattatgagatataaaaaatgaattagaaaaaatttaatgagttaggagaccatgagaatcagccaaggtataataataactaactaattattgtgtttggcagtattctaaggacatcattgtattacctttttaaatcttgacaagaacggatgaggtgggtatcagccacattttactctcaggacgattgaggcacagagaggttaagtaactcaccagaagtcacacagctggaaacggtctcaacctttacccactgcctcaggcagcctctgagtactgagcagatgctggcattggagttagaaggcatttgaggcttacagctgggcatgtacatgggccttgtggtctctgggaagttgtctaacctttctaagcctcggtttccttattgtcaaataaacataatacttacctggctgatttattgtggggattcaattaagcccaatatgcctgaaggcattttgtaaactgtggagcactagttcagtgattattgttataatctgactggggagacgaacccgagacagcagaagtgtgagcaatcaagcaggctgtgattaactcttccttagagggatagatgtggtactaggtaatgggataattaccaagagcacgtggataaagcacaggctttggggttgggagccctccccgaggactgaagcacatcttgtagcatgagttagtgcttgctgggtggaggaggggatggggcattccagtgacagaagaacataaataaagagacatctagactaggcagataaacttcccagcgggtgcagtggagactcattggctggggtagacagagaggcaaaattggccactccctcctctgaactatagcagggctggtgacctctcctagttcctgtgaccttgtgctggcatcatttctctctgtggcccccattgaacactgagcttattgagggcaggtctgtgtcttgctcttgcctgcatcctgaagctcatggttagtggtgaatggggtcagcaagggaaccctgggcctaggtgggtagttcagccctg

SEQ ID NO: 43815 - DNA, 1030 bp, Homo sapiens
aaaccccatctctattaaaaatacaaaaattagccaggtgtggtggcttacgcctgagtcccagctactcaggaggctgagacatgagaatcgcttggacctgggaggcggagtttgtagtgagctgagatcacgccactgtactctagcctgggcaacagagtgagtgttggtctaaaaaatatatatatatctcctgggctcgagcaatcctacgccgctcagcctccagagtagctgagactacaatggggaatgccaccaggcctggctaatttttgtattttttatagaaatggggttgcactgtgttgcccaggctgctcttgaactcctggactcaagccatcctcctgccttagcctcccaaagcgctgggattacacatgtgagccgcctaagcctggccaaatattgatttaattccttgatatgccaggtattgttccagaccctggggatacaacagaatacaacagcctgagttcattgtccctgccgttgtggagctttctttttttgttgtttttaattattttttctgtttttatgtgttgtttttatatatttttttcatttttatctttatttttggagctttatgttgtaaatttttagggacagggtcttgctctgtcacccgggcaggggtgcagtggcacaatcatggcttgaactcctgggttcaatcaaccctcctatctcagcctcctgagtagctgggactgcagacttgtgccaacatgctaattttttttttttaaagacaggatcttattatgttgcccaggctgtcatggaccttctcttctatttagcaaacagacaataaaccctagagataattggctataatccaaagatggaagcatctcccttttttccttcccatcccctcccctcttccattcccctcctgtcccctcttcccttccccatcctgaggagtggacagagccctgcacacagtcaccatgtcccctactgcagcgaaaccttttccccacgcctccagggtgtcttctccctc

SEQ ID NO: 43816 - DNA, 1049 bp, Homo sapiens
gtcaggctccctcccacatctggaattcagtttcctccacatccctcccaagtcctcatctccacagaagaggaactcgctacctcccaagccttctacttgggccatcccaaacaacttgactgctagaaaagcctcacatttggcccagtgcagtggctcatgcctgtaattccacccctctggaaggccaaggtgggaggatcgcttgagcccaggagttcaataccagcctgggcaacacaggagaccctgtctacaaataataaaaattagccaagcatggtggtatgtgccagtggtcccagttactcaggaagctaaggcaggagaattgagcctgggagtttgaggctgcagtgagctgtgtttgcaccactgcaccccagtctgggtgacagaatgagaccttatctcaaaggaaaaaaacataaaaagcctcacactcagctcctatctgcctctctctaaggaaataccaaggtaattaacaacagtcttattggctgctgtatgaagcactgtgtggtaggcattgattttacttggtgttttgcaagtgaaacttatattaaacaagcagggtttccacagtcaagaagtagaattcaatcatgcagcagctttctgtctttaaatctttgcttgcccttggattgtgtctggttactaggacagacttactgtccagttcatgttaataatcaaaactaggaatttaattcaaaggtaaagctgcttctcttcccctctcaagctttctttgggctcccacatttgaggaggacagtagttgacttctgtttattttgtttcctcttccatcccaccccagcccaggccaactatggcttctgaggcatcctgtgttggtggagggggttataagagagtagagatggggcaagaaaagccccttcgacatctggccttgttactgtctcagcttgatgggaatttgtaactgactctcccatgcagtgcttctgggggtctttcttacctccagttcccatgatcaggtggccatctcagtcttgctgcttcaa

SEQ ID NO: 43817 - DNA, 1065 bp, Homo sapiens
tgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttggggggggaggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcc

SEQ ID NO: 43818 - DNA, 1045 bp, Homo sapiens
atctctgagtagatgctgcttgaagtaatgactgtaatcacttttgccaagcataccccccgtttataatttaagaaaaaaaatttttttttttttgagatggggccttgttatgttggccaggctggtcttgaactcctggcctcaagcagtcctccccacctggtgtctcaaagcactgggattacaggcatgggccaacatactgaacataatgattcaaacatagaaaaaaaagtctcctggtagttcagttcccccatgccccaggagtttagtacaggggtgtccagtcttttggcttccctgggccacattcccttgggccacacataaaatacactaacactaacaatagttgatgagctaaaaaaaaaaaaaaaatcgcaaaaagaattctcagtgttttaatagagtttacgaatttgtgttgggctgcattcaaagccatcctgggctacatgcagcctgtgggccacaggttggataagcttggtttagtagatctttttggattctaggtccctacctgtcgtctctgtatgtaatataatgttatacagatgctgcagttgatcaacacggaacaatggggactcaagggacagggagtaaccacttttcttctctcctctcctctcctctccccatccccagccagttggcatgtgctggtagtcccagctcctcggtaggcagaggtgggagaatcatctgagcctggggaggttgaggctgcagtgatctgtgatcctgctgctgcactccaggctgggcaatagaatgagaccctgtgtcaaatataataataataataatgtatttcatatggttgtcaagtaatgtaatagtatatgactctgatactatagaaaccaggtaaataaatttagtattattggctgatattaataagcagttatttgtagtcataaaaatatacaacattggtttgagatgccactttagtcttctgaaagtgattagccttgggggtgatgagggcgggagccttgagaaatggccatcttgggagaagcattga

SEQ ID NO: 43819 - DNA, 1119 bp, Homo sapiens
tgggcgtgttccaaatgtggtcgagctactgtatccaaaggtgatcctggcatttcataatctccttgttccaatgtgtctggggacagctaggcagactttacataagtacagattgcctctctgggcactgctgggagacttcatttgtggcaggaggagtgcccccaggactggtgagataatttgagctttaaatagctcctggcccttgaaataaggacaacatgatttaggggaaaggccagaacttgatctttgtggccttcggcacgctggcctctccttgcactggaggcagtcatgagggctgcaccgcggggcggtttgtcttcagcattcgcacactcagtaaagtatgccagagatgggtggcagcagcgcccaagggctcagctccttccaaagccaagtctgggcagttttttttcaggctgtatggaactagggtttatggaaaggaagcgatgtgaggcagctaaggcagtttccgcttaatatagagaagaggatgaaacggagaagagacactcgatacaggaagatgagctgggagatcgttaggaaatgtagacatcccctgtggtgagaactaaaatgaaggaaaattattcagggtattcttaaaagtagttcctcatgtttctgtagcattttactttttcaagaagactttgctgggcacaatggctgtcacctgtaatcccagcactctgagcggccaaggtgggaggatcacttgaactaagggttcaagaccagcctgggcaacatagtgagaccttgtctctactaaaaatttttaaatggctggatgcagtggctcacacctgtaatcctaacactttgggaggctaaggtgggtggatcacttgaggccaggagttcaaggccagcctgggcaacatggcaagaccttgtctctacagaaaaatacaaaaattagctgggtgtggtggcatgtgccttagtcccagccactcaggaggctaaggtaggattgcttgaagccctgggaggctgaggttgcagtgagccaagatagtgccactgcacttccagcggattgatatagtgagaccccatctctaaataaagaaataaataaatcagccatag

SEQ ID NO: 43820 - DNA, 1002 bp, Homo sapiens
aggcgcctgtaatcccagctactctggaggctgaggcaagagaacccgggaggcagaggttgcagtgagccaagttcgcaccattgcactctaagcctgggtgacaagagtgaaactcagtctcaacaaacaaacaaacaaacaaacaaagcaaggaaggaaattcttacacatgctaaaagatggatgaaacctgaagacataatgctaagtgaaatgagccagttacaaagaaagacaaatagtggttgcttcaacctatgggaggtatctggaatagtacaattcacagaagcagaaaggagagtagaagttttcaggggctggagcggggcagggaaagcgagttgtttgttgagtgtagggtttcagtattgcaaggtgaaaaagttccagagatctattgcacaacgatgtgcatatagttaatactactgtgctgtccacttaaaaatagtgaagatgggccaggggcggtggctcaagcctggaatcccagcactttgggaggccgaggtgcatggatcgcctgaggtcaggagtttgagaccagcctggccaacgtggtaaaactctgtctctactaaaaatataaaaattagctgggcgtggtggtgcacgcctgtagtcctagctattcaggaggctgaggcggggagaatcgcttgaacctgggaggtggaggttgcagtgagctgagatggcaccactgtactccagcctgaatgacagagagagacctcgtcaaaaaaaaaaaaaaaaaaaaagcttaagatgggctgcgtgcgctgactcatgcctgtaatcccagcactttgggaggctgaggcgggcggatcacctgaggtcgggagttcgagaccagcctggccaacatggtgaaaccccgtctctaccaaaatacaaaaatcagccgggcatggtggcgggtgcctgtaatcccagctattcaggagggtgaggcacgagaatcgcttgaacccaggaggtggaggttgcaat

SEQ ID NO: 43821 - DNA, 1026 bp, Homo sapiens
ttcttaatggttagcaaagacatccagaatccattccaactctgccactgtcttgctgtagggttcagagccagccactggagtctcttaggtcttcaacattttctgatgtggaaaaatatataatgcttgttttctttcaccttatgaaaattaatatggtgaccttcttaattcgttccaggctatgcttgggcctgggagtcacacctgaatctgagtactgacttttccacttaacattttgtccttgggaaaatcactaattttaacataatatgccttcaataaatgatgctgttagttcacatttgaatttttaagaggatagtactgatgtcaaccatgaagaagttaatgatgtgaaaagaggttaaagaacacaacaagagccctcctttctaaaaaagtgttaaagatgggacattaggaaggttttcaagtcatgaaaattcttcattcacaaacagtaatggagttttggtaggtggtttttggcttttaaagatgtggagggagatggggtagaaatctttgcattgcttaacatttctaaagatctgaaaaatttaagatcatgttatgcatttaagaacagagacaagtgttcataaagttagcacacttgaaacttgatacatttagacatatcaagccctacaaaaaagttttttaaatccatgattttctacttttgaaagtatgtttggtagaaaaacgtgtcctctatttatcctgaaatcttccagggttgtttttgttttgttttttcctaaagccctcatatgttgttatgggaatctcctgtctgtagtttacatttgaaccctggaaagaaatttggttttttgtttttgtttttgagacagggtatcactctgtcacccaggctggagtgcagcagcaaggtcatggctcagtgcagcctcatcaggatcgcctaagcttgggaggtcagccttccaggtagatgagactacagttgtgcaccaccacacccagcttttttttttttttttttttttt

SEQ ID NO: 43822 - DNA, 1068 bp, Homo sapiens
gggtagtacaattatatcaataattcaaagatctagatagaatgctgactaattctgttttggtgtatgtgacaatgtaaaattagttcattttatctttttttgattcctaggttttgaaaaatgtcctgggcagtaaataaatttagcaggaaagtacgcctactccatttatccaaatgttaatgaactttctcttagtgaacatggcactgttgacaccacctaagtcataaaaacgggtctcaagggaggaaatgactcagtgtgtttaatacaggtttccctgctaagcctcaatctggggaagtcctgttggttttgggaagtgagcagcagttctctatgtggtttaaaaaaacaacgacaaaaaaaaaaaaaaaaaaaagagacagaaaatgaagtgggtaaagaagattctttaagtctattttagaatccctattgggtctagaatgccatcttctgtacaaagtattcactcagaaatgtggaccctgagagctcgggaaataaggcttgtgtaatactcactgggtggtttgggccactgggcctgcctctgaaggccactgatgtttttgtctcctacaggtgctcagctttaagggctactgggaaaaactgaactccaacctagaatatgttaagtacgccaagccacacttccactataacaacagtgtggtcaggagagagtggcacaacctgatctctgaagaggtatgagtgggtcagtgagaacaaagccagcagcgaggcatagtggactggatccaggtgatgcctttaaatcataaggctggcttccatgtgcagcactcttcccaattgccagggacttgatcattgtcattactgatctcaatgggcagagatgcttctatgatctctgttctcctagggaggaaactgaaaagcagaaagtttaaggggacacacagcacattcatagtagaagtatgattaatatccatgtctcagatgtgttctcaggttacttatgtagttaaaaattgatattaaaaaatctaggtgttcccaacttagtggtcattaggggttggg

SEQ ID NO: 43823 - DNA, 1047 bp, Homo sapiens
gagcctaacaaaaaggagcgtccatacagaagctcaaatgggctgtaccctgtagcatcccgaggacaggcctgaattctgagaagggcaagtggtaaaagtattgtccagtcctttttaagttggaggctgaacttggcgaggtgtgtttttataagaccattagtccattttacctttcctgaagattgaggatggtaaggggcctgaaggttccactgaataccaagagcctgagaaactgcttgggtgatttgactagtaaaggcctgtgtgttattggactgtatagaggtgggaaggccaaaccgaggaattatatctgacagaagggaagaaatgaccacggtggccttcgcagaccctgtgggaaagtcctctacccatccagtgaaagtgtctacccagaccaagaggtgttttagtttcctgactccgggcatgtgagtaaaattaatttgccagtcctgggcaggggcaaatcctcaagcttgatgtgtagggaagggagggggcctaaacaatccctgaagagtagtagaatagcagatggaacactgagaagtgatttccttgaggatagatttccacggtggaaaggaaacgagaggttctaagagatgggctagcggcttataacctatatggaagaggttatgaaatgatgacagaatagaatgggcctgtgaggctggaaggagataattttccttggtctaagaaccatttgtcttgtgtgggaagagattgataggtagaagttagtcagtgggggagtaggtggaagtgaccgatgagaaggagaaaaactggcagtgagggacagaaattggaatgctagctgcttctttagctaccttatcagcataagcgttgccttgagcgatgggatctgacaccttttgatggcctttgcagtgaatgactccagcttcctttggaagtaaagtggccttgagaagagtttttattaaagaggcattaatgatggaggacccttgcatagtgaggaaacctctttttgcctattatataacagcatggagg

SEQ ID NO: 43824 - DNA, 1048 bp, Homo sapiens
cacagtcttctttccagtttgaatgtgtacttaaggagagcaaactgggggaaaataaagttgaaaattgtagtacaggcatcagccactgcttaaaggcttcactgaagagccattagcagccacacagcaggaagcaaaaggtagagagagtaaaaggggccaaatagagtaaatagaaactatccataaatgtctctcctggggttaattatgctgccagaattttcatatggaagaacatcagctcattttgatacttattttaagaaagggataggaggcctataaaatgtgtatcaggagccttattcaataatataaatctctgaaaagaaaagcttaagttttgtggttgtttaaaaaaaaaaaaaaggtttgtggttccagtcaattctccaggaagaggaagctattttaggtaagaactggtaggtagagagtaaagtgtatttatccacaccttgaagcctaggtctggcaaagaaatgtaaggaaaaatgatagactcatagaatgtctgaattgcaaatgcagccctgtacgtaatttgttaattttctttactatcctttactttctttttgaacagtgaataacctccagaataaccattcttggcttcatagtttgagccacactgtcagaccacttgtggttaagaggatagtgtttactgagtgccttgtgtatctcttatgtttgtgggtgttatgcatcatcccagttctacaaagctttccaaggcatttttcaaaactgagctggaatttcatgtttattctgactctacaccagttttctttctaatatatcctattttgcaagaggaagcagaagtctaaagcatcaaaatgttaaatccagacattggtcagggctctttagaagtttaagttaatttaagttttatgtttagaaaataggcattcaaaaaagatgcagtgtttcttagagtgctggtagattccagtgcttttatctcatagaaaagaacaggtttgaatgtgtccccgaaagttgtgtgtcccccagagttcatgggtta

SEQ ID NO: 43825 - DNA, 1044 bp, Homo sapiens
gcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtctta

SEQ ID NO: 43826 - DNA, 1038 bp, Homo sapiens
atcagaaaggtcatcggcaaccttgactagagcagtttcaccagggtagtggtggagagggcaggctgaggaagccagtttggaatgaaaggattttccttcttaattttagccactgggcctggggacattggacaaaggggctgcataaatcccagcaggccagatatggctgatttcatccttctaggatgggtctctattatttctaattgtagttagagcatctcagaacgtgaacgatgctgtgtagcacatcttccttggcaaccacctcataaatgaacatgatcacacactttagccaacgcccaggtccaaaaaaggagaaagggaggcaaggaaggaaggagggaaggaggaggcagggaaacaggtaggcaggcagggaggcaggaaggagaaaaacatcgtctgaaggaagcagaactaaattgaactcttctggttattatatgtcaagatttcataaaaactagattttccagtcttagagaagggctcttcctgtccagcacaatctgtgtcaccttgctgaggcaggtgatagggcaaggtgggatatgggctgcctactgaagaggccccttgtgctttacagagctttgcaggctcgtgcctggagctttgcaggctcgtgcctggacagacaccatatgtttcgtactgaactgaagagttcctgtgcagaaaaatgaaaatattcaaccactcatatagatatccatcttttaaatcactttgtgatatagtaaatcttaatttcttgttaatatttttaacccatagtgacttggaacattttagtttttagtttctcccgctgttaagtgtttaatgatctataaacaaactcttgagaaacttttataagaggaatctttgaatttgtgaataatttcaccttttacgatatgaaaaatcactggaggagggaaagaaaagagtgtctccctgaatctcagaagtaatttgaagccaactaatgatggatggatgaatattttttcatttttctggataggaactctccagttc

SEQ ID NO: 43827 - DNA, 1047 bp, Homo sapiens
gcacttgacatttcttctgttgttaccacagatgtgtgtatctctcaactataacctttagcttggtgcactttgtgaactttatgtaactgaaccatactgtacatgttcttctctgtggtttgctttctatatgttatgttcatgagattcatccaaggttggtgcatgaagctatagtccatttatttttcactgctataagttatttcattatgtgaatatgctacaacctataataattatctatttttccattttatggacatttgagattttccctgtcaatttacactttggttgtttccaagtttgttgtaactcatacaatctttgtacatctttcctgctgtacctatgcaagactttctctagactagactagatgccttggagggcacaaatttaacttacctaagtaacacaaaagtattgtccaaggtggttttacaaagttatacttgtattagcatatgtaaaaaagtttttcttactacacacactcacaagatttgtacgtcagacttttaaactctcattctggtaggtagaaaattatatattttagatttggatttgcatttcttgattacaaattcatattcatcattttttcttatatttattagacgttcatgttctctcttaactaaaaaatgcctgtacatgtctttcctcattttctgttgaatatttcttcatgttgattatagaaatgcttatatattattggtgatctttttcatcaattaatgtgatacagatatcttatgccagcttatggcttgcagtttcactttctttatgatgctctttgataatgagaaagtcttaattttagcgtaattggcttaacccttttttttttttttatagtttctgctttctgtgtcttgtttgagaaatcattctccaagacatggtcttaaacgtcttctcttatatcttcttctaaaagttgtatagttttactttttatatctaagtatttaatcacctacagttgatttctctgtatgatataaggtagaacctcaatctcaattt

SEQ ID NO: 43828 - DNA, 1098 bp, Homo sapiens
gctgattccttaaggttattttgaggattaagttagttaatagatgtaaaatttaacgaatgtaaactagcatgggcaaagcactccaaatgtgacagagaaccagcatatcacagtgaataagcatgcagtctctgagccatgagcctgggtttgcatctcctcgctgtcccttactagttatataaactttggcagatttcttgacttcattgtgcctcagtttcctcaactgtaaattgaatacttatagtgcctaccactaggaacgccacttgcttattctgtgcttttgtgtgaatttgggaaaagtatatcaccgggacagatacccattaattttactacctaaaggtatcttgatgcaaagaaagagtcccaggcaaggtcacagaacaggatgcagtgagtgagggctggatttctgccccatcccactctctgccgagtgcctttcaacaagcagcccagtcacgcaaccctatgccatgatcttgtctacactgtaggattatcctgtctattaaatgagttaatacctgcagaacacttagaaccaccccaccacgtagtatgccctcagtaagtaccagcaattttcctgcctataccttttcacagtttactttccagccaggtttccctacagcagcaccatttaaaactgtcattttaaagcacaaaaggcaagtagagagctttttctaacacctcttttggcagccaccacctattttagttatttataaaacaatttatctctgatatattcaaaataacacacttaaattaggcgcatgcaaacacataaatcctcacaaacagttttttctcctttgggacaaatttgaatggacgcaatcactgattttaaaatacctcctgcattcccagcttgtgttcacacctgtgcccaagtgaggcacttccagtgcaaagtggaatgggacacagaatctgtcctctttctagagaaataaaatcagtgattacagttcactgtgctccgtgttaggctgagtggaaagggagcacaaagtaggggctgagcaaatagcagatcggaaaaggggctcaataaggtatgatgctggagtt

SEQ ID NO: 43829 - DNA, 1030 bp, Homo sapiens
attaacccttgacattttttactgatttcccagtatttgtgttcattaagaaatattttactttctcccgcattatcttttcaactttttctaatttatattctttctttgccttcactttggtttaactaacctaaacttttcctttgaggctgatttactctcaaccccagcccagtggttcgaggctacaaaaaagagtggccttttccttccaatctagtacttagttcttacatgatatcgtaagtcattttactcattttaatgcaatttatctgcaaacaaaataagttgatctggttgtccatatgacagacacttgttggataacctctctgcttgtagaattaaattatttgccatgaaaaatgcaaatgaatacaacttctgaacccagttttcaaagagcagtatagtggggaagatagtatgctaagctcctcaaaaatgaagaggagagtttaacaatgatgtgaggagtcatccaccgaacaagaatgaaatgaaaaacaactgactgtgaacccaggcatgttccgagaagacttggtgaaagagatggaatttgagcagaattttaaagatgggctggatttagagtcactcctaaatgttcaagttctactagattgcttcatttggtgaccttctcttttctcctcaccccttgtccctatgttattgttcccaatcctgtggctttacttcccatctagatgctgatgactctctttttccttccaactctgatttattccgtctgctattatgaatacatttaagtgctatattcatttctcattattctattaagctttatttctatgatgttattatttctagataatttcagttcactccatcttctgctgctactctagccaggtctgtatttgttatattacctttcctttcaagttctttctattactaaactatattcttacctgtgttcttctaatctttattctatacttttctctatgaaatccttcatggaggaaaatatttcttatacttaataaaa

SEQ ID NO: 43830 - DNA, 1123 bp, Homo sapiens
atgtgtctgcttccccttctgccatgattataagttttctgaggcctcctcagccatgtacaactgtgagtcaattaaactgcttttctttatgaattacccagtctcaggaagttgttatagcagtgtgagaacagactaatacagtgatagttcctactttactcttatcaaaattgttttagatattttaggtcttttgccattttatataaattttaggagaagcttttctagaactacaaaaatcttgttgggattctcataggaattgtattaaacctccagattaagttgacaataatatatatctttactgtgttgagtattccaatccatgaacatgataagcccttccaattatttaagccttctttgagttctttcatcagcatttcgtaatttcagcaaaaatatatggcacgttttgtttagtgtatacctaagtattccattttctttgagcaatgtaaatgggtattgtgtttttaatttcagtctctgtatgtttgttgttagaatatatacatgagattgattttcatgtgttggtcatagatctcatgtacttgctgaattcatttatttgcaggaaattttttggtagatttcttgtaatttctacatagactattttcaactgatataatcataagatatttcttatttaagctgttgacatggtagattacattgagtgattttcaaatattaaatcaaccttgcatacctgggataagtccaactaggacatggtaaataattcttttcatatactgttttatttaacttggtaatattttattgaggatttttgtgtctatgtgtctgtgttttgtgtctatgtcttttgtgtctatgttttgtgattttgtgtctattgagaaatactggtctgtaatttttttttgtactgtctttatctggttttggtatcggggtaatactggccacataaaatgagtagataagcattccttcatcttctgttttctggaaaagattgtgtaaaattggtgtcaattttttctttaaatatttggtaaaattctccagtaaaacaactgtcctggggatttttttcaagaggattttaattacaagttcaattgctttaatggtt

SEQ ID NO: 43831 - DNA, 1025 bp, Homo sapiens
tgctagagaccaatgtgtcccaaaagccagttgagtagtctggattcttgaaaaagttctaaactgtgacaaaacaagaaaaaaaaaaagcattatagagaggtttgttgttgttgtttttgttgtttttcagaaataaagccctgaatttacagaagtgttttcattctactgttgtggtagttttcatgaaaactttttattttagaatagatttatattttatttagaatagattatatttatgtacaaaaatagtacagagagtttatgtttaactttcatccaattttctctgttatcttgcattagtgtggtatgtttgtcgtaactaataaacctatgttgatatattattattaactgaagtccatacatttcttttgtttttacctaatattctttttctgttgcagaatttcacccaggataccacattacatataattattatgtcccttagattgtgacaatttctcagattttccttatttttggtgactcacaattttgaggagtatttgtcaagtattttgtagaatgactatcagtttgagtttgtctgatgtttttctcatggttagtctgggttatgggtttgggagaaaaagatcatagagataaagtgccattctcatcattttattaaagggatgtgtgatcaatgtgacttatcactatcgatattaagcttcatcatgtaactgagtgatgcttgtggggtttctttactgtaaggtgatttcccccacactctaccccctttcatttatgtagtccttggaaaaaagtcactatgtgcagcccacacttaagtagtggggatttatgcttctcctccttgatatctatatacattatataacagcatctatatacattaaatagaattcttctatacgggagatttttctattctacctcatttattcattcaatcaatcattaggttggtgcaaaaagtaatcatagtttttgccgttactttcaaacctaatattttatactttggctataatccaata

SEQ ID NO: 43832 - DNA, 1080 bp, Homo sapiens
tgtagcacagagggccagtcatcattttccccttgattttcttttaatccattgatattcctctcttaaatgggtacatgataatattgctctgtactgtcagattctttttaagttagcatgtgtgtttttgatctatcttattaatttttaaatttcaaagggaaaaataatttcccttatttttgaggagcatctcatcataaaattcacacatacatattcacatatacataaacacattacattcaccatattataaaaaaagttacttcaaaaagcttcattctaagttacattttataaattgtttggttgagaatatctctggcagttccatcagttcattcattcagttgcaagtctaagtatatgccaggtgtacaatactggatattagagatcaatagacgagcagttggtcgctgcagtcaaatatcataatcaagttggaaacagacaagtgggtagtttagactagtgtagggaagagtaacccccatcggttcttagttagaatggatccctgtaagaaaaaaatagattaacaagagaaaagcagaagtttattaacatgaatattttatatatacatgggagacaggaaataaagtagttctcctagaagtggcttatatagcatcttcaactaagaatagaatagtaaatttttaaagaaatggcaagacaaaggaaaagactctgagtctctaggggaagcaacttgtgaaaaggcaataatggcataaaaaggctagttagtgaagcttgttaacgcagattcctctggtaccatctccaggtcaataagggtctaaaattgtcttcagtggttaatctttgttctccctggtagaaggggaggtgggataccttttgtttttgtaaatctatatcctgcttttaggtaaatggaaggcaaagagctttcctgcctctgctgcttcttgtttgtcttcagctcaaccctccttcatattttggggaggtatatcctggtctcccacactactcatccatccattcattgtattcattcacccatctgatatgtatttagcaccttctctaggtcagtca

SEQ ID NO: 43833 - DNA, 1051 bp, Homo sapiens
ttagaaatgtacctccagctattctacatttttatgttaatcatttgcatttaaattctgaagtttagagaaatcatgggtatcagaaaatcatatcctatgcctcatatgcctataaatttgtaagtctctacctttactctctttctttttatgcttctctttccatcactccttcccattctttcctcccattccaccctcactaaatccctttcttcttccctatgctgtcttattccctttcatcccttactttcattcacaactttgtacaaaaagaaagctggatgactttcaaacatatgcacataagttgagaggtgctaacaatatagttggaatcattaaatactagagtatctcatggtgtttacattaagtgttataacacttggaatctgattctcctatataaatcactcttgcttagttattgttttatttgcttaacagggaaacaattacattttactttgatagtctgtgtattctgtaactatttaattgattctattagttttgtgactctgtatgtctttctgttattattttaattgtagcctttctggattaatatccaaaaaagaaaaatattccatattcaatgtatatttgaggtgttcatgaacagtatcaaaaatatatttgtacatacaaatatagacagtgaaacgtttggccataagaatttcctattattctgacagtacacatcactaatatagtttccataatttagaaatctgacacacacacacacacacacacacacactcacacacataatgcttttatttaattaatttttaggtatactattttggagagaaaaaaatggaataggataaatgaattggtagatttgacaagccagttggtgtaacagtgatatgtatgatcaattgctctatttcaccagcattcttcctccaagttaacctgaacctgattagatgattctgtgatgaaggccagtggcaaccttcaaatacatgccgtgttcaagttttcaagatttatatctgtcttttaggatttacattcatga

SEQ ID NO: 43834 - DNA, 1059 bp, Homo sapiens
gaataagtcagtaggtggtaatttatgttgttgataacaaaatctaatgttttagtttcacaattagaacataccagaaagtgccatcaattttttctaaaaataaaaggatatttaagaaacaaccaaactaaacctataaaaaatataatatgctcactatgcatatttaagagaatattgaacaagaattaatttttttgatagtaaggaaggaaatattttctgaaaagaggattttgggtttgctttcctttttaaaaatatttagagaagtatattttagcaggttataggaattcatgcattttttaaatcagtgatcaggtatgttttactaattaagtctgatggctctttttatattcctgcttacagactgaaaattatatgctatttagaagtatagatttttaaatatcatgttaatgctaaaatattcaagtaaatatgagcagatcatgctgcaggcgcagttatgaaatatttgaggcccttttcatctcttattttttgtgatgtatgaaaggcaaacatttgtagaactcaaaaaagtagtacttaatatttatatggctcttaaaatgtactaggaatacatttctactttataagctctacatacataaagcatagccatactaaagtagaaattttctatttataatcagaactggaaacttgattaccatgaattttctcatctagcctgatgaaacccccattatacaggtgagaaattgagacagattaaatcatgtccccaaagtcacacagtttgtaaatagcaaagtcagtatttgatcccccaaaatttggctcccaaattcacgttctaatcattgagctgtactacatccaatgtatgacctgaaagtagggtggccaaacttaacacataaaacaggatttatagttagggttgacagataaaatacaagacctaatattgcataggaaatacttatactaaaatattatttgttgtttatgtgaaatgcaaattaactgggtgtcctatatttcatttagcacctttaccctaaatgaatattttgt

SEQ ID NO: 43835 - DNA, 1046 bp, Homo sapiens
gttaacctcttgctcagttcttgaaaatagtaagatatataattataaatcttttttcctttactgtgtgtgtgtgcctgtgtgtgtgtgtgtataaaaacgtaaaatatttaatatagagaatatgttaactgcatttttaatcagtgcaaacaaaacacatcaacttgacatgctggttatttcttttattaaaaataataaatgaaactgtttttaataaaattcttattgctattcatttttctatagtagagaagattttcaaacaagattaatgggaaaacagaagatgaaataaatattccatagttgtctgtgaattttttattgtctcttttgcaccttgaacttgatcgctttcatcacttagataaatccgtgacttgaaatgttggtgcattatggattaaacaaaagtaccacagtgttttttatcctgtattgatgataaaccttcaaagtaagataattatttttcaattaggctccatacaaggactagaaagcattagttatcaacatgtacggaaaataatcagcattaagttgtcatattttggctgcattaatgtcgttaaattaacataatagtcattataagcagatgctctttcctgaaagatttttgcaattaacgttgtattcatttgcacacctatatctgcacttttttccaactcattaatatgagtctcactttccattgcctaaagtcatgaagcagtgtaaatttataaaataaaacttcacctccttgccttgtttagaagaaataccacattattcatccaccacaccagttgtattgaccttctgtatgaaaattaatgccctccaagtttccactctgagaattttctttgggtttcatagcaagttctcttaatttgggggctgctgcttattcttgctctgaacatgtttgtttgcaatccccatcctggaagggctgaccctgctgtccatcgtctctctttccctggttcctagctactcacaggtgagtatgttcttgattgtctttgtaccatggaagcagaaaa

SEQ ID NO: 43836 - DNA, 1117 bp, Homo sapiens
gaattgcttgaacccgggaggcggaggttgcagtgagctgagatcatgctactatactccagcctggaaacacagcaagattccatctcaaaaaacagtgaataaggtgaacatagatttgggatatgaaagaaattagttttgtggaagacctgattgaattacactgagttacgctgaattacactgattgtaactcacaatagtgtttctacatatttaagccctttaagttagtaaaactaaaacacactaaaaagaagcattatcaagggtaaaactgtaaagtttctaatatatctttaacatttttgatatttatgccaaatttgtttcacagaaaagcaggctcttcaaaaattatgagaaaccatctcctgttaagaatagcagttactaacacaccaaaaggtatagctatgcaaggagtcagcatccccttttcataattatataatccctagaagactatgatcacagaggactgttagagtgaggctcgttggccacatatctaataaaatgtctaaaattagagcagagctttctagtatactttgtgggaaaaataattttatttctcaagcaaaaattagtactataaaggttgtaaaaatacgtgttaacatctaacaaggcaatgtgtttttgtggatatgaatgaatctaattatttgtgactttatttatgaaggtacatttatttctaaacatgttgtaagaagggagagtgacatcaacctgtggattagatcaccaaaaaagcaatcatcttattccaatggaaagaaattccctgagttaaaaatgatcaaaaatggtatgtattgagagtatctttaagtaatatagctttgagttctgggatgttaagttgaactgtagctccacgtttagacagaggagtagaagcaatatatccaactgaattttaaagcaaactacaactttcaacccacatattgcaacagctgtatatcgtacatctgtttctacattaatcttattgcctcaaataagaatcatcaatttggcaactcttttttgaaattccttttagagtgtaaagcatattcttttgtgattacttcagaatgaagctgccagatttttgttc

SEQ ID NO: 43837 - DNA, 1051 bp, Homo sapiens
gaatcttatagaaattcatttggagtggaacctgaaaatatatgtattttaaaagcacttcccgcctccctggagctctgatacccatccatgtttggaaaccagcagacagtgttgcctggctcagtaaaaaaaaacttctgtgttttgtgctagtgatgaattgtagccaaatagcacttacttgcataatttaaatctcaaaagcaagaatactttttcttaacgaagctaggtcttaaaattgaagcttgtactttttaaagttatttattcagacatagatttagttttcacttatcaatccttcctaccaaaaagcacaaggtgctttgcaaatattaaccacaggagaaacaggagtcttgacaaaaacactgtcaagtagatgaaatgtttttagtcaatgaaaaaatataattctgcttttcaaattcagtttcgaatgatatttctttctctagtgatgtttcaatctgttgctttgttggttaggagtattttacttacacttagatactcttctacacactggcagttgaacattctcttttccctataattccttttctctttactgctgaatgataaaccacacattatttccattatttacatagaagaaagggagttgaagtgctactttaccattcctcccaacgtatcttaatttatccctttttgattgtctcccatcatcctgaagtggtgtccttgaatttcaaaatgaggacaggttttgattcatgttctatcacaatctactgtcacaccataatttctggactttagacacctgaagtactggtaaggcatctaaaaggggagtttgtgtctttctcccttagaggttttttccagctgaagtagttttcatttttataaatccacagggaagccacacatagacttgtctctccacaaacaccttgttctcatcttatttttcttattacttttctatcaaatttacctgccctgtgttatgttctgctgaagtccagaattcagcttatttttcccttcagaataatttcagaaaatgactgta

SEQ ID NO: 43838 - DNA, 1013 bp, Homo sapiens
tatccactaagttgactgactttactctttaaaaacaaacaaacaaacataaacattatgatagtttatgatatatgttgtgaatgactgcccaataaaaagaatcttaggtaactgttttgtaaaatcaacacaatataaatgttaagctattaagaatactggctaatggaatgaatgcactctattattctcattttaagtaaaactcattttctttccatgagttttattttaattaagaatcaaattgttcataacactcctgacaaaccccttatcccagctgacctgctgacagatctgtatattctaagtggtacaattttaagaatctcaatggcatccttttacattcatgattattcttcttagacaagggttgttgaattaagtcagctatgaaatagctataactttaggcatttataacaatattaaaccactcatttatccagaagcttagaaaacagtatgttgtagataatctgatattttggatttaaagcattagaatacatttaacaatagtctctataaaatatatatcaatctacttttgattcaatactttatagtattttggctgggcgcagtggcacacacctgcaatcccagcactttgggaggtggaggcaggaggatcacttgaggctagaagtttgagaccaacttgggcaaaatggtgagaccctgtctctacaaaaattttttaaaacattagccaggaatggtggcacatgcctgtagtcccagctactcagaaggctgaagcaggaagattgctggggagtttaaggtgcctgggaaaattgcccaggaggttaaggttacagtgagctatgatcatgccactacactccagactagggaacagagcaagaccctgtctcaaaaaaaaaaaaaaaaaaaaaaaaaaaaagtataatatctcaaagtaaccattgaaaaattaattattcttgaataattttgaaggtgggttggatgacctactatggtcatctggattt

SEQ ID NO: 43839 - DNA, 1033 bp, Homo sapiens
cttctatggaatcacctcattctttccttatcccccaggctattaaattttgtcacttgatcatggccctttccttcattgattggtgccattaattgtgttgccatattttcctgtttttttgtttttttatagtgtgaggaaaggaggttatgaattgcacctttatttattatgtcacatcaagctttattttttatttttttaaagactcaaaagaaaagaaaaaagttatccaaaacttaaacagcaatgagaatattacaaaactttgatagaatcagaattgcagttaatgctcatttcaattgcatttaagtttgcaaatattagtaacctactgtttttataactgctttacgaggaacttttctaatagcttagaaagagtcagctttccttctgcttttctcctatgcaaagttgtatcccatgttagaaatatctacatttatgcctttttttctcctattactctttaataatattctactgctatagagtgaacatagtaaaacaattgaatccaatattttagtttgttttttattttaactttaatattttaatattttgattttttatgttattttatttttattgtttcttatttttatttttaatttcaatacgtttttgggaaacaggtgtgtttggttacatgaataagttctttaatggtgatttctgagatattggtgcacctatcacctgtgcagtgactacacattgggtatagtataatgtttatttttaattgaccaataataattatatatatattttggggatacaatgtgatgttttaatatatgtgtacattatagaataattatatcaagctaattaacataccattacttcacatttttatcattttttgtagtgaaacccttaagaatctattcttttagcaattttgaaatacacaatacattaatattgacaatggttaccttgctgtgcaatagatcttgaaatttatttcctcctttctaactggaactctgtattgttcgatcaacttctctgc

SEQ ID NO: 43840 - DNA, 1049 bp, Homo sapiens
tttaaaagaaatgttcaggccaggcattttggctcatgcccgtagttccaactacttgggaggctgaggcaggaggatcacttgagcccaagagttacaggcttcataagctgtgattgtgccattgcatttcagcccaggtgacacagtgagaccctatctctaaaaaaaaaaaaaaaaaaaaaaaaaaaaaaaaagaaagaaaaagaaaaagaaaaaaagaagaaatgctcaggaaatgaaattgctgcaagatacttttcaaagcttgcatgatttgagagacataatctctatgtgaaggaagatccaatcattgaaaatatgtaaactctttcaaattattctctaaatttaacacaacctaaatcaaaagtaaaatgggatatacatgggaaagtaacaaaataaatatgagatctgtgtggaaaactagaagtatcaaactaattaggaaaatatttttaaaatataaaaaaagaagatgaatttgccctactcagaattaaaatacactaaaatcctacaaaactcaaaacagagtagtgcaatgctgaaatcaacaaaacatgcagtcgaacagaattaagagtttagacattgcccacatatatgtggaaatatagtgtatgattacgttggtattttcaatcaatagagaaaatttatatcttatttttaatggcattgatttacctaataactattaaagaataaaacatctcctgtatacatcaaaatcatttcatatcaatcaagaacttatttttaaaaatgggagaaaaaaattagactagtgtatactaaaatatagcatgttaatgtgtatagaatcccagagcatggtaccaaaggcagaaaccgtagaagggttgatacaatttgtcttcaaataaattagaaactttaagatggtagaacatgcaaatacccaaaccaaaaagccttgtttattgtaagagtgtttgcaatatgtatgagaaagtattaatactgctaactttttaatgggcaattaagagaatgaaaaagtaaaactaggagaaaat

SEQ ID NO: 43841 - DNA, 1034 bp, Homo sapiens
tgtccaacatggtaaaatcccatctctactaaaaatacaaaaattagcttggtgtggtggcgggcacctgtaatcccagctacttgggtggctgaggcaggagaattgcttgaacctgggaagcagaggttgcagtgagccgagattgtgccattgcactccagcctgggcaacaagagcaaatctccgtctcaaaaaaataaaataaataaaataaaataaaataaaatggttttaatatgttgcgtttccattataatttatttcaagaaaattttcaattttcttcttaatttctttattgatccattcaggagcttattgtctaatttccatgtgtttgtatagtttccaaaattcctcttgtcattgatttttggttttactctattctggtcagaggagatactggataatattttagttattttgagttttttaagtcttgttttgtggtctaacttatgatttgtctttgagaatgatccatgtactaaggagaagactgtgtattctgcagccattgggtgatatgttctctaaatatctatataagtccattcggtctatagtgcagattaagtctgatattgctttgttagatttttgtctagatgatctgtccaatgctgaaaatgtggttgtgaaatctccggctgttattgtattggggtctatctctgtctctagctctaacaatatttgctttataatctgggttgttccgtgttaattgaatatatatatttattattgttattacctcttactgaattgacccttttatcattatataatgaccttccttgtctctttttatagtttttgtcttgaaatcaatttggtctgacataaatatagatacttctgcccttttttgtttctatttgtatgggatatctttttccatctccttatttttagtctatttttgtctttatgggtcaagtgtaattcttgtatacagtaaatcattgcatcttattttcttcatccactcagctactctgtgtctttagattagagagttcatt

SEQ ID NO: 43842 - DNA, 1051 bp, Homo sapiens
tgacaaaggatgttggaagacagatttggtttgtctcccactctttttcatgggatatgggtgtttgtaagtaagtataataatgaaagtatcacaagtttatagaaaaatgaaggttcaaaggcataaaaaattagaatagaaaaatacgtgtcatacagaaacatggactagaaataatttgagaagtattaaagtctatgggaatgtatttcttaatagttattagcatggctcagaagaatgagtactagaatactagcgagagaatccttgttctagtgcctctctcccgtgaacttctatggaatttcaaatgagtcttggaacattcctggcctccagttttcttacctccaaagtgaaggagctgaattaggtgcccttaattgtctcttcaagcatttactttctattgtgtttattgaatactctagattgagcgagttcagttctactacatattaaacacatttcaacacatctgtaataattaaagtggtatagtgttggtacaaaagtagaagattcatggaaaaatgtagaggcccagaaatatattttaggaaaatttaatacctgattaaggtggcatttttgttcactgggataggctggacaaaatattgtcttaggactgcctaaccatttatagaagcatacaactgtattcttagttactctttacatcaaattggattctagaagcaccaaaattttaaacataaagagaagagaagatagagaaaataatggcaagaaaactttttaaaaacatattcagtaagatggcctttgtaagtatctcaataaatttggaggctataaaggaaaacatggatacatattatacatgcaaattaaatacttctatggagttgaaaatgccataaacaagtcaaaagacaaacacaaaatggggaagatacttctaaagcgtgtgatagagaattaatttattttatacagagaattcttacaagttaatagaaaaagttgaacaacccaagagaaaaatggtcaaagaatatgaacagacagttcacagaaa

SEQ ID NO: 43843 - DNA, 1008 bp, Homo sapiens
aatgtagtaagatttagagatctttaaattgtattttgtgtaaacattttagctttaccttggaaaatgctctttgtttcattgacccaatatctagacaatgtgaggctaagggtaggaataaagcaatggaggggaatagaggaatatgaatgtagtttgcatgcttgtgtgtggggagatgggtagaaacattacataaaggggtcagagggaggtgactgagaagatggcatttgagcaacttgaaggaaatggcaaaaagccctcacatgaggcctgtcctttgaggaagtggatttgacgtcccatccactaaccttaggcttgaactatgtgatttgctttgaccaattaaatgtaagcagatattttggtatcctttgtaattgcagcaaaacggattcaagcaatttgtgaggcaaggtctttccagctgaaacaggggtatgccaaggttgtagcccaggggaaaccctggtgtgtcggagggacgtcaagggacaataaatttgaaccacaacgaatgaagaagtgaatgtaagaagtgagagagtctaatagctattgggaatcaagtcttcccattcaatccaggttcttgggctccatttggttgttgattaacctctatgattttgactgttctatactgaaacatgaccatattttgagttatagcatgtaaacactcttgaatgctcatggctgttctcttgagttgtttaattctctcattgttgtttcacttctgcctgtttattgtttgttttccagtgtagaatataagcaatttgaggagaagggctgtatcttatccatgtttggacctctagtaaggcctagtatagtgaacacccccattcagttagtaccagctgagtatttcttatcggaaatgcttgggaccagagtgtttcaaatgttagactttttcatattttggaatatttagaaatacataatgagatatcttggggatgagacccaagtctaaacatgagattc

SEQ ID NO: 43844 - DNA, 1042 bp, Homo sapiens
ttttttctgagcagtaggtctcaaacattgggcttaaaatatttagtaaaccatgctttaaacaggcatgctgtcatctaggccttgttttccactaatagaacacaggcagagtcgatttagcatcattcttaagggcccttttttagacttgtagaatagtaagtgaacactggcttcaacttaaagacaccagctgtgttggcccctagcaagacagtcagcctgtcctgtgatgctttgaaggcagacattgacttcttcctagctgtgaaagtcctagatgacatcttcttccaataggctatttttgtctacattgaatgtctgttgtttaatgtagacacattcatgaatgatcgtagctgcatcttctagataacttgctgcagcttcacattagcaccttgtacttttaagttattgaaatggtttacatccttaaacttcatggaccaaactctgttagcttctaacttttcttcttaagctttcttatctttttcagccttcaaagaattgaagcaagttagggccttgctctggattaggctttggcttaggagaatgttgtggcttgtttgatctatccagacaactaatactttctccatattatcaaaaaggctgttttgacttcttatcatttgtatgttcactggagtagcactttaaattttcttcaagaacttttccttggaattcatgatttggctaactgtttgctacaagagggctagcttttgatctatctcatcactagatatgccatctttactacttaatcatttctactttttgacttaaagtgagagacttgtgactcttcctttcacttcaacacttagaggatattgtaggttatttgttgtcctaatttcagtgtcatcatgtctcagggaatagggaagcctgaagagaaagagagagaggaaaaagtggttggtcagtggagcagttagaacacttacagcatttatcgattaggttcattgtatcatatgggcatggttcatggtgccccaaaatgattataataata

SEQ ID NO: 43845 - DNA, 1029 bp, Homo sapiens
gaaatgtccagaataggaaaatccacagagacaaaaagtacattagtatttgccaaggactggaaaagtggagtgcggggagtgattactaatgggtacagatcttctttctaaggtggtgaaaatattttataatgattcatagtgatagctccacaattctgtgactaactaaaagccactgaattgtaagcttcattttttatgttttatctatttttaaatccccgcgattagtaatgcaaatgacttatacactttaaaacaactattttatggtatgtgcttatatctcaataaaactattattttaaaaaacagaaagggagcatattagaacgatattttccagaagattcctctggatttggtagttattcatgatgacttaatagttgtttggatgtaggagttcaaagggttttatccatctatatgcttgcagcatctagaaccatatcgtggaaaagtaatgaacactaaatgtgtgaagaaatcacacatgaatagatattagaaaaaatgaaggccacatttagctatgtagatgatgacatcattcattaagccagaaaaaaaaatgagggaaagcaaatttgaggtgaacatggaggaatgtttattttttggcatcaatggacgtatagatggatgcgtctgtcataagcattgagaaaactgtaatttgtagcaaaaaagaacagaggtgaataatatcagactcatctttataatctgaccattcaaaaaaatttaaaattaaaaagattatgtacatagtacatatatatacatatatatatatccacaattgtattaatcatattaagatagcaaaagtgatcgaagcttagtttaaaggaaagtggtgagtttagcttttgatatgttacttttgaggtggtacgagaataggagttctgtgaggacaggaaatttctgtgttttgcttatcattgtaaccaataataacaatagcaatagtacccttagaagtcactaaacacatttgttgaattaataaaacca

SEQ ID NO: 43846 - DNA, 1036 bp, Homo sapiens
tcattgtaaattaaactataaagtgcttagctgcaaagcctaacacataggtgccagacaaatattatctaccattgttatacttatcactattattcttacttgaagaactatgtagaaaataattattgaaatccatgcaacaacatttagcatacttattaaatgcaaactgtgtgaagcattgttcaagattctggagtctatattttaggtaagaagctagacaataaagaaataaataataaatgggaaatttttatatacttgtaagtactcttgaaaattaaatagggaaatatgaaagagagcagctagggaatgaaagaagggaataaagatttttcattttttgtaacactagatggtatgcttaagtaagatcataactaagaagtgaatgataaaaaggagtcaggcttacaaagatttcagggaagaggatttcagacaagggaacatagaaaacaaagggtctgatataggaataaacatgctctgttcaggaccagaacaaaaaacaactgaaacagtaaagaagtggaagagctataaggtcaaagagggatagtacatactgacccacagaaagcactgtaggacagagtgagtgaggagtttgaaatttttccggagtgcagtgggaaatgaatctaattgtttaaagcagtaatgtaggttggaggtaatggcaagcaacacccagcagtggcagaagaaaacagaggaagccgaagacttaattaagatgggaatattccctaaattgattctcagactcagggcaatccctatcaaaatgacagctgaggagctgccttttttttttttttttttttttttttttttgcagaaattgacaaagtggtccaaaattgatgtgaagaaagataaaggacccagaataggcaaaacaatcctgaaaaagaacaaagatagagggtacctcccaattttaaaactttttttttcttttatttttttttggtggcagggtctcactctgtcacccaggctggagtgcagtggcatgctc

SEQ ID NO: 43847 - DNA, 1034 bp, Homo sapiens
acccaggctcttaactgaaagcaaacaaatttatagaaagaaaaaaatttgttctctcacataaggtgttctgttatggaagcactgcctttttgtcctattttatcttttgtcagtagacactactttccaacgtgttctgtgagaatgttaacgtggttggatctacttgagggaatcagcaagttttattaaatattagacgacctcatcttttacttttaaggaacatggatatatggctatgtctaaagattgaatattaaattatgtcaaagcactaaaaaaagttaataaatttacaggtcacatttctttttgtaattttctttgaaaaaccaaggccctagtggtcaaacattgaaagtaggttcttgctatgaaatgaaaaattagtaaaatgtaaatgtatctgttaaattgtaaatctattttcacttattaacagtgttattaagtgaatataaaacatctcacttactacaaataaatgaacagctttagtaatgcaaatgtaaaaaggaccatagtactgcatattgttatccaaattatgtccatctaatgacagaaattcaataatgactcccagtaaatatactcacagcagttggtaatctgcccacagtatacaattctgaacaggttatgtgtgtggtatttcagtccttctcccagcatgtttcaaagcagtttttgttataagaactttgaaacccacaagaaagaatttttagtgggttttcttcaattttgaaatgccttgggtctgtagtaacttattacatgaatccagcagtaactttggctttgatgtgcatagttccctattttgtgatgtgtaagaagtcatcaacatatggatacatgatatttggcctgcaacatttgaaattaaaaaaataaagaataaataaagcaatagatccaagtcagcttccaaaatatctatgcaaaaatgctactgttttaaaacaggcattagctccatctattgttctatgacctaatttgttttaacttaacttgaaaga

SEQ ID NO: 43848 - DNA, 1086 bp, Homo sapiens
cataggcctagttaaaaatataagcaaaactgatctctcaatgtcaatgaagctgtgcagacaaaaaaaaaattgcttaagatagggacgatccacagtgtggcagaggcaaagaagaaaagataacacagaaagaatcatgggattatggaagaacagagaggcttgagtaattaaggcaggattgaggggaaatgaagtcatttagtgttgatcatgtattcacataatttaataaaattataaagaattaaatatagatttgacatatgtttttggttatgattttagcgtgctatttttctgcaagacgtcgacatgacagaaagacattcagttattcattatttcaaccaacaaatatttatggaacaggctccttgtaaaataaaacattgttcaagccatgttagggcaaaattaaaaaggtaaagatgaacactctcgaattaacataaaaaaggtgaggattgttgcagtcgagaattgatgggatcatggctgcgaataaagaaatgacaacatttccagggaatctgaaaaacagtgactcaggatgttcaagacagccagagtctctatgctcacataagatctactataatagtgtattagagctattatcacagatgtgaattcaatgagcaataatcagttgtatagaacacatccctacaaaccattgtgtaattgtgtgaacgaacagctctaagaatgcaaaaggagagatcatttctgcctaagaaaaccagataaggtgtgaggaaaggttgaacatgggatcccggccataggaatggaaagtattccagcagtaataaactggaggaagagcaataacccaggagtatagagggttcagcaaaccataagataaatatactaccagaagcacagactttgttgagagaattagtggatcagagaactgaagaaagactcagtacagagggcagtacagttgcagagagccttattgcctagaaaaggattgatgctgtaatagtctgatgagcaagataaaatagtgcctagaaaaggattgaggcagtaacaggctgatgagcaggataaatcagaatcaaa

SEQ ID NO: 43849 - DNA, 1062 bp, Homo sapiens
ttagtcctatattcagtcatgctgtgggttataacgtggtttccttaaacacagtgacccaatctatttcttttattctagaaataaagatctacttcgactgtgtttcttttctatgaatgccagtattatagtcagtttctttcatcagaaattgtttaagatagtatcacttaatcttgactggtgtttgtatttattttcttttttgaaggtcaataaaatatcaaggctttggaaactgagaacattctaagatcaagatcaacatgttttttctaaaaattaatgctgtaaataggaaacatttggaaactttttttgcttttcatttctaaatacttttctgtttttcttcattaatgtttaaattttagagagcaaacactgcagaagtcgtgacttactgaatatagatgcatgtccactattcttattaatactgattgctgatgtagattattgtgggggctgagagattcgtaacatagcatgttatttattagcaatttcagaataagaactcaacagaaaatcattctaactaatgattgtttgaagttctggctctataatacatgtgatattttaaattcctagatactctaaacaattatgctttatgaattaaccttttttcatataacctatttcacatattattattgtatacttcctatgaatactattgtcaaagtacagtagacaaaacaaaattatatcctttaagcaagatggatgctgtaaatgtatgtatggacatttttatttctggttatttcctagatattgtttgtaatatctgctacaaagaatttaattttaaaatgacatgttaatatgcttctatatggcatgattatacataaagacatcattttacctacaaaaggcagaaaatattaatctctcaaatatgttaattgtctctttcaaaataggaagtgttgatatcttaaaatatttgtatatctgacaattgtgttttatcatatgtataactaattagttcacaaagaataagggggttttgataatcacagtggttgttgtatttaaagc

SEQ ID NO: 43850 - DNA, 1044 bp, Homo sapiens
tttgctactaaacagttaatagagtcaaagacagaaaaggcaagcaccataaatgccagtatgatgcaaaataattacagcacattcataagttagtcttctctctttcaagtatattttatttttagttaacatctcagaaatttaattttatttcctaggaattttgcaatttagctattccataagaaattttatgatacttatcatcgtacgtaatttcttttatggcatactgaccatagcgtttatgaaataacacaaatttgaaattgtccttgatatctgtcaatgttaaaattaaaaatatagattatcttaatttattaattaaggatatgtggatagaagatatgcattttatttgttaacacattaggtatcttacttaatcaatacaattatgccacaacatctcaagaaatcttaagatcaactttttgtttaaaaaaaagaagtgttttaggtattttataaaaactctttctccagtatgcacagtaaaactttgacgtttctgaatttctaagaagcatcccaaaatatactaaattatggaaaggttatatacttattttaataatgctaccattgctgtgattctcttttgaaattattgtttactcatacccagctttgggtcaagactgtgttttttttttttttaatgactacatatatgtggttcataaagttgagtctgatttgatttcaagacatatattgaaaactgcctttttggttaagtctctgatttagcctgattattatttttctttttcacctttctcattaagagtggaatgtacaatatgaactagatgacctcccactctgtgaaatcatttgcctttctgtaagattcattattgtcaaagggtgaggcaactctctaaatattcttattataaaataaaaataaaaataattttaattacatttacatactttaccataatttgaatattcttttccttaaaataagttgcccattcaatgtccatgtaagcctcaactgactctctaatgaactaagaataactt

SEQ ID NO: 43851 - DNA, 1029 bp, Homo sapiens
ttgtatcattgacttaccatcccagaataatcatatcaaaggataaataaaatgttatagagttctaatttttctgaaaattaggaattgattttgttttactcagatgaatcactgcatgaaaagtagagaaataaaaaatcaaattttaaaacatctttataagaagcttgttttttcccttaaattttgggtgcatatttagtaattaccattttacttatgcagtctctctgatgtagagttcttaaactgttgttactggagtctattattataggatactaccatttaagtctttacaataaatcagaaaatgggaaaatacacctttgcagccatttaatgaaacagatttcaactaccaacacacagtaatttaaagattatgatcaagtttcctaaccaaatatacactgcaaatagatactagtggagaataaaggctgaagtattgttttttgatgagtaccaatcatttttctactttagttcatgttctatctctgtgttggaatttctgagagtggagggaagacaattaacaaatcctagtaaaatacgtgagtgttaaaatcatttttgttcttccaccacctatagtacatattggtgaatggtcgtttagtttgtcctgggagaactctcagggtagctctcattcctgccttggcaaagtatttactataagtgaaaaaggaggtgccttttaaatttggaaaatcagaattaggccctcataaggttggttttaaaataccacttaaaattgagtaaaggtcaagaaaaaaacaagtaactccatcaaaaagtgggcaaaggttatgaacagacacttctcaaaagaagacatttatgctgccaacaaacatatgaaaaaaagctaatcatcactgatcattagagaaatgcaaatcaaaaccacaatgagacaccatctcactccagtaagaaaggtgattattaaaaagtcaggaaacaaaagatgctggcgaggctgtggagaaataggaatgcttttacactgtt

SEQ ID NO: 43852 - DNA, 1070 bp, Homo sapiens
ctgccccaagtttggtccatggccagctccttttcccttcctatcctggcttcatctagcaccaggaggagacccatgcactcatgtcggcacctgagcctgcatgaccagtctccaaccatactaaagatctctaaaaaatatctcctttggtctcctttgggcctaggaggacacatatgggtaagaacgttccccttaggaaggtggacctaaggaaaatgcttggaagtaatgcccaggttaattagacagggaatttgggagttccagctacctggagaatagtctatatagagggatatgagctttgggtgggtatcctgggccccatggattcttaactccttggaaagttgtgacaggagaaagaacagcattgggcctagctcaggggcctgggtctaagggtggtctggcttttttgaaaaacatatgtttcctagaatgagagattgctcttgggaaatatacaaatttgtgtgatgaagacagtaatggcactgtagtttctgaaaagaaaaatgtattcatataactcaagaagaaatgttaaaggctgaacacggtgggtcacacctgtaatcccagaactttgggaggccgaggcaggaggaccatttgaagccaggagttcaaggctgcagtgacctatgattgtgccactgtactctagcctgggtgacagagtgagatcttgtctctaaacagaaataagtaggagaaggggaaggagaggaatatttgagacataaattaatgcagaagcctatgaacagggaagactatttggtcttatttactatttgccttgatcaaagttctgtttatcaatacaaatattaataagactatataagaggctacctatgataggtagaaaaattaggagtgaaacgcatggttgctgtatccttgccaggtgtcatttttccagctgttgtagtcatagggctagactgtcagacagttcgagaagcaggtggctataattagttctttatgtaaacattaacattgtcatccctatagacaggagagttaagtagagccttttcccattatcttct

SEQ ID NO: 43853 - DNA, 1098 bp, Homo sapiens
aatttcaattgaatttcagtattcaattgaatatatagtattcaatttttcctttcatgtcaataggtatttatacaccatttatgtattttcagttgaagagctaaaaatggttatgggaataaaagacttcaatcacgattctattgttccctttaaagaaaggggtgttattttcctacctactattcatggaacaggaggttgtgttaactttgtaatgctgctgtaacaaattaccacagacttagaggtgtaaaacaaggcaaacttattatcttatagttctggaaatcagaagtctgaactctctctcactgggctaaaatcaaggtgttgacagggccatgtagctttgtgaaagctccagaggagaatcagtttccttgcctttccagcttctggagaacacctgtttgccttggctcatgcccccttccaccattgtccaaaccagcaacatcaggacaagtttttattgttgtcgttgttttcacattgccatgtttcagactctctcttcagtctctcttccattttcaaagacccttgtgattaaattgggctcacctgtgtagctagggtaatctccctatttaaaggtcagctgattagcaaccttaattcttctttgtaccctaattacgttcacaaattttggagattaagacctagacgtctttgggagccattattctgcctaccacaaagctcaagaaggttaagatgaaaagctgttactgccacttgatgacaggtggttgaggatatcattgcatccctgctgaaaacttcatgctggagtgtgtgtgattagtgggccgaatgcaatatttctctaaggcatagaatgagactcagtactttcccctcacctcgctacaggctaggatgcctagcagctaagtctgtgctgaatgttattaatgagttaactactaattatatgagctgattccatcagaatatacctgaatgtatataagtagtaggcagctaatatattcagataaaaatcattttgaacaaaactgaaaatatagccaaattcaaaatatagtttatgtaaataccatatccatttttttcctttcaaca

SEQ ID NO: 43854 - DNA, 1050 bp, Homo sapiens
tttttagtagagacaggggtttcaccgtgttagccaggatgatctcgatctcctgacctcatgatccatccgcctcggcctcccaaagtgctgggattacaggcctgagccaccgcgcctggccaaaacaattatttttctctcacctactcctgccttaaagtgtaccctgtcagaccccattgccctacctctagacagcatcgctagcccacctcataactatttgtttctttcatgtatcggaatagtctcaattttaggtatgaaacaaaaatgtagtctgttccgaagacaaactttaaccttgcatccaatttaaaggttctctcatcttttgaactctggaaaccagtgaaaagggaggttagtgtggtctgtttctttgccatttgctctagctcctcccaacctcaccttcttctgtctcctcttgagatcagggcaaggaatgaggaggaacaagaataaagaagcaaaagcttcttcctccatttctccttaatctccccatgtgtgtcctttgttatgtcaggcatccagatgctgcttttctgttatgaatgatatttgtatgttcttcaaagacactccacctttatcatcaccatcgcacacctcactctgcctattgcagcattttctgacaggggaatagactaaacctgaccacttataattcagctccttcccactgcattatacctccagggtctttctgaggctgtccccttaacccaacaggcagccctcctgggcagcatcccttcaagagaacttgtacttgttttttctgaaaagcaaggaaaacctcaggcatccctgacctaccatgtagtggaaatgcagccatctcacttctttcccaaatattatgagcagctccactcaggttcccaccttcagaattcttctgccaagaagtaggcataaatccccattcttatgaacattcctcaggctcatggaaaaagctgtcatattctacaagaactctctcacactttgcttgtgggtatcatcatgggacacctatactttttcaataat

SEQ ID NO: 43855 - DNA, 1067 bp, Homo sapiens
gtgaatgtattttctttttttccatctttcaactgataagtatattttaaagaaatgtagataaaatactgtttgaagtatagtgaccactattgccaaatggcatgaaaacattaagatgagactacatgagggagtatggtaatttaaatcacacttgagattaatctttacagagattaattttttttttcactataaaggaaagtgtttctgctgaagttagagatcttcaggttacaaagagcttggcagttaaaggagaacgaggcaaagcattccaaatttgaagaattcagtaggcatgactaacaaatgttgtgtctcagaatagataataaattagggcacttgttaaaagtatgtggttgccactgtagaaaaagtgtgtagtgtgattaggagtgatgtatgcatgtttcctgtgatactgtgccttcaattttgtaattctatattatcaatgtgtactcatagtcttgctatgatcttttcccaagataactcttaattgctccagactttacaaggctgactcagaagcaaactgtagaatgtcagaaaagtaatctccaccacttatcgttaactagtgaccatctaacatgacagatggcgccctgcctgtcttcagcagcttgtgggacaaagctgaatgtcaacaccactgggatgtaattattggaatctcttgggtccagtttggcgtgaccctgaaagcaattccccgagaactgctgggagcaatgcagtgatggaaagagcagagaaaggagaggtttgggagaccagcagcattttcaatttactgacaagtgttttcacgctgcttaagaatacgtattttgcatgtgacaaatcagattgacaaattgaagaattcatgggactttcattgtggcctaatttaaatattatcaaagggctttattttataatgcagaggcaactatttaatgatttaagtaattttgaaaaatattttaatgatgagaaagcagtataatttatattttaattgtttcttaaataatttggtaacattctcattatttgggaacacactt

SEQ ID NO: 43856 - DNA, 1043 bp, Homo sapiens
ccctttgtgcctatgcgagcaagtcagtgcttagatggataacagtagaaaaaaattattatacactctcctcatttcattatgcaaatttatcaggatgtatctccataaattcactataccttgcactgtcttttaaaacaaaagattcagatgttctttttcatggatatcattcattgcattaaaaaaatggcaccgagacacactcaattttttctttcataaacatcttttatataaggaggttgtaaaaaataacttattttaaataaaaaaactatcactttgctataataaagaactatcactttggttttagttccattactgttaaaaaaaaaaaaaaaaagaacgagcattgggaaatagagctgtgagctttgggcagattccagcacttttttgccttctgcattttcatttatatattactgaagacctctgttgttaaggaaaacacatttaaaggcaaggaacagaaaggtaagatgttctgtagctcagagtatgagttagcaagaagggcacatggaaggtagaactaagtgctgagccatgtgctattttagggtagcactagccatgaaacaatttgctgagctgtaaaagatggcaagtatgttccacgttttaaattgcaggcttttcagaaacaatcatttcaacccatcctccttatccaatgagaatgagctgtctttaagctctcaatagggatatgttacttctgtaaaatgctttttacttttcaaataattcccttattatttaatttattatagaatgcctatgaagtaaattggcatggaggctaaagctcttggttaaggttctacagcttaatggtggcattgacaagactagaagacaaaatggtataagaagagaaaaattaattatgagcagtgcttgtatagaatcagagataccctgcaaatgtatgttacaaaatctgcagaaatgcaaggctattaatatgagtattaacaacttgcttcatgatatttcttctccaagtatgtacaacactgtagctttaa

SEQ ID NO: 43857 - DNA, 1024 bp, Homo sapiens
cttaaaagttaaaaaaaaggatactagtgaaatctagatattgttgaatgataccaaacatttatttccttttcctactgatgtttggctcaatgtgaattgttaatgttaataattgttaatgtttggctcgattagaatccctttccagtgttctgaagtcttctgaccttggtctcttattgtcttctttcttcttctcatgatgttcttaacttttccaattatctgccaagtctcctagtttgtggcttggtccttaggggagcttgtcatgcagtaatgaaaactctaggcaatgttccttgcagacaggtaggcctgccctagttttcattgctggaagaaattttaaatatttttccagttggaacatcacaacatctcaatagagtttgcagtatcgtcctcctcataacaaacacattttaccctaattataccttccaccatgaatggggaaggggagatcctgaccttctgcattttaagattaagaaatttacttgttttgttgttgctgttgtttttgttttgagacggagtcttgtgatccgcccacctcagcctcccaaagtgctgggattacaggcgtgagacaccgcacccggccagaaatttacattttttaaaaactctctattgtctgtggtgagttacgagcatagtttcttcaatatttattagtcattttctctttatcatacgtgtgtattttcctaataaaaattaacatgtggctaggtgtgatggctcatgcttgtgatcccagcactttgggaggctgaggcaggtagatcacttgagcccagagagtttgagaccagcctgggcagcatggtgaaaccccatctctataaaaaatacaaaaattagtcatgcttggtggcatgtgcctgtagttccacctacttgggaggcagaggcatgaggcggcaggagataagaatatgaactgtttagtcagagggctggcatatctctcaagtgcagatggcatatttgattgtcctagagtgatgtt

SEQ ID NO: 43858 - DNA, 1035 bp, Homo sapiens
aacttttttctatgtacatcaacaactaaattgtgcttattttgcaatgaggattaatactttaaaatggtcacacataaaacatatattgcaatttttttattcatttgacataggtaatacgttcatgctaataaatgaagcatttttttcttctaaaatcatactcctattgtgctgggaatggtttctgtttcagatgtcatattttgtctttcattttaatatgtaagaatctttgaaagatttccatttattttggaaaagatactcattttctatgataccatatttattttgcagaatctttcatggagaaaagcttatgaacaccaacttaatattcataatggttgagagcaaagggacatgtccatgtgacacacgactgctcatacaagcggagcagacttgtatcctttgacatcagagctatctggaaaggaaaaccatcttaatgcattttgaatcttgtcacattgtttatattcataaagagaaaactattagactgctctgatcacctcgcaaaggcagaatcgattcctcactcaaaatttggttggaatgtcaagaataattatgctacacatgccccagaaaaggataattcacaatttagttctttaaatccctatgtacttgaattgtgttggatgagagtaatgatgtataagttatctctctcacatgttttgggaaatacattgcattgtatttatttttaatcatgtgaaaaaaactaacatgagattccttaacaagtctcttttagctgacggtccaaatccttgtgacatggttaagcaacccagataccgaaaagggcctgatgtctgctttgataacaatgtcttggtaagatcacacttctactggattaaaatactataaattaatggtcactgtccgcaagaattcaaggatacaaattgcaattttaactcaaacgtaatgtcttaaccatagtttttctcattaacatgacatacttgctggtagatttttttcatttcagtagttttcatggttagc

SEQ ID NO: 43859 - DNA, 1064 bp, Homo sapiens
gaaaaggaaaacttgtaaacacattaaaatataatgcaaacaaagtgctagtaaaattatttcaaaatgatgtggagggccaggcacagtggctcatgcctgtaatcccagcagtttaggaggccaaggagggaggatcatctgaggtcagaagttcaagaccagcctggccaacatagtgcaacctcatctctactaaaaatacaaaaattagccaggcgtaatggcgggcacctgtaatcccagctcctcaggaggctgaggcaggagaattgctttcaacctgggaagaaaaggttgcagtgagcctagatcgtaccactgcactcaagcctaggcaacagactgagactccatctcaaaaaataaaaaagtaataaaagtgatgtggggtagagttagattatcagctgtctggtgaattatacaagctggcattgtctagttaatggcatctggctctcttaccatgacattcagaccatccaaagattctaactcaatctacgtttccagttttatctcttaatgtacagttcaaacttcattgtttacccctgtattatattttctccacttttaatttttttgttttattttcaattctacaaatctgcctttttgtgttcgtgtctctatgtgcctagttcctagagcccatctctggttgtgtgcatcttatcattcattcaaaataaaatgcaggccgagagtgagggctgacgcctgtaatcaaagcattttgggaggccgaggcaggcggatcacctgaggtcaggagttcgagaccagcctggtcaacatgatgaaaccccgtatctaataaaaatacaaaaattagccgggtgtggttgtgggcacctgtaatcccagctactcggtaggctgaggcaggagaatcacttgaacccaggaggcagaggttcaaatgagccaaggttgcaccattgcactcacgcctgggcaacaacagtgaaactccatctcaaaaaaattaaaataaaataaataaaataccaacatatgaagacttgcccccaaagcaatctttctttattttgttc

SEQ ID NO: 43860 - DNA, 1038 bp, Homo sapiens
ggaaggaatctaaacatgactgagccataaagtcaggcaataacaccacgtagtgaaactggtcaggagacggattgtagctgatggccttaggtcacttttctgtagggctgccagatacgataaaagatgtccaattaaatgtcaatttcaaataagcaatgaataacttgttagtgtaagtatgcttcatgcaatatttgtgatacacttttgctaagaaggtatttattttttattgaaattcaaagttaactgattgtcttgtatttctttttgctaaattcatcaaccttgtctttcaggctttcagtttctatatttgtaatatgggaaagtcagcttccccattacttcacagtattgtaaagatcaagcaaagcctattcgtccagatatatagaattttataattttcatttttaacttctgtaagctacctatttttatttttgtaagtgaatacttgccacagagctattgaaaataaaatattttgcaggaactagaaccttctgattcacaatagaagctaaaaaatatccttgttgattattaatatgctacttaaagcagagtcacatacaaagaggcaggtgagcaatttatttttatatatatacacacctatatacatatataggtatataggtgtgtatatatatataggtgtacatatatgtatatatatacacacatctatacatatgtacgcatatatatacgtatatatatacacacatatatatttttaaccccatcagtattatgtacccataataattaaaaataaaaaaattaaaaattgaaagataatatgtataagttttgacatacacacacatattgtagaatggttaaatctagctaattaacaaagcctcacctaacatagttattattatggtctatatatcatcattaactaaagtcaccgtttatatgatagatttcttgaatttattcctcctctctaactgtaattatgcgtcctttgaccaacatctccccatctcttcctcccttgtaaccaaccca

SEQ ID NO: 43861 - DNA, 1049 bp, Homo sapiens
tattgtaattttctaggagggatagatcttaaattaattcccccaacttccaccctaatggtagttatgtaaaggtgatggataagttaattaacttgattttgatgattactttacaacatacaggtgtatcaaaacatcacatttcatactttatactattttatatgtcaatgacatctcaaagctgttacaaaagctgtagttgacattataaataacagtaagattcttcaaatagtcatatggtgccatcaatgtatggtgaggccttggaccctgaataaatcaagaaaatgtattcaaacttaatacaaacttaattcaaacttaagagggagcaatagtgcaacattttattggttgaagtttgcagaagaacactggattcagagctcgtcaaatattctgtattccttgtcataaacaagatatagatagaagagtcgtgtcttttagaagaattagcagcaaatataaggggtttcttttgtgctgttacaaattagatttttctttcttctcttgagaatccagactgaacaatagaatactctaaaagggagaattgctgacaccaaggccagttttttaaaactaagtaaacaaagaatagagatgtatgcttggctttctgaatcgattatcagtgaaatcctattatgccgttcagaataaaggcctcaaagtcaaggtttgatttccaagcattcactgcttttagtaggcttggccttggacatctataaaagacttaatttttacaaaatcgaattttctaacagggataaagatcttcatttcttaaaagttgacagaaaatgagaactaattttactcctaatctaagacaattagctaaatttgtcagcaactggtagtaggttcaaggctagattgtcactgagcagtcttctatagtgaaaaaatattgaacactcatgtacttctaatctcatctgaagcaagaaactggaagtatatgtgaatgtaaaacattactatttgtcaggggtagggaggaaaaagagggcaactgtcaatatata

SEQ ID NO: 43862 - DNA, 1062 bp, Homo sapiens
ccattttccttacactccaccccctaggccaaggcagacataggccttggacacacaggtctgacacagaggccttatacataggctctgggcacacaggccctggacacacaggtccaacacataagccttatgcataggctctgggcacataggtcccagaaacacaggtttaacacataggccttacattccactccctaggctgagggagtttttctagtgaggagatgtgcccacagggtggaatcctggacccagagttcacagcagtaatacagggaacaacaactccaggttatggcaggcaaccaccccatggtgactttaccctaatgttgcttcatacattaagccaggtttttatttccctacctttaagggtgttggggcaggcagcaacaggttaccgttcatccgcatacctggttggagaaggtcatccttcctcccctaggtcttgccacatggcctggccgcatatgggcctgtgaccaactagttacttttgtaacttctaggtagttaaccacaaggctaagactcgataagctccccagctgtcggtgcaggttatcatagttgtcacctccttggtgatcaccattcacattgctctaggttcagcccattgactactttgtccacacctggtatcaaaccatatggtgtcaatactaggttggagtgcaacagcagtccaggcagcagtagcaccttggctaaacccatctgtgtactatgccccatagggaatggaggatgcccttccttaaacggtgaaggcttgaggtctaggggtgcctcaggccccatggccttatcttgcattaggactacaggtcccaagatctcttgcaactctgctgctacgggacttgtactcagcatacttggctgctccaagtaggtgccccactttgctaaagtggatgtctgtgcgtcccagtttggggggtcattttccatgaatgcatccatctgctattaggtaagttgtctgcacgatgactgtagcccatccggccatgctgtcatgagcctgaagggcagcatatgcag

SEQ ID NO: 43863 - DNA, 1021 bp, Homo sapiens
ccagtttgtggtattttgttatagtagcctgagtagatgaagacaggtggaaaaggggtaagcagggaattccaggtacacagaacagtgtaggatattttgaggctaaaaaaaagcctgagtctgtacacagctgccagaatttcagcgtgacaagtcagccaggtgccagcagagattgacaaaagatgaggacagaagagtaaacaatggtcagaaaattaaaattcttacattcaacatagagaaagtgtactttgcctgtaagcaggagagtggcataatcaaatttgtattttaggtgtgcattattctattatttaattgaaagcaggttttgttttagtttttggcttttagtgagcttgcatttcaaatctagtgggtgttttgtagcaagaaaaagtacagccttatagaagtacaaacaggtgaggaaggagagctgagtttcttctgttttacttggaagtgttatgaccttgtctgaccttagatatatcagccttaagaatatacccaagggatcctgtactctgccagcctcaacaagactagctcctcaagaggttgtctctctttttgtttgtgtgtgtgtaaatattttttaaagacttacttgcagtttatcatattatatagttgtctttttgaaaaacactctagaatattacttaagaaccaggatattgggccaggtgcagtggctcatgcctgtaatcccagcattttgggaggccaaggtgggtggatcacctgagatcaggaattggagaccagcctggtcaacatggtgaaaccccgtctctactaaaaatacaaaaaattagcagggcgtggtgtgggcaccagtaatcccagctacccaggaggctgacacaggagaattgtgtgaacctgggaggcagagattgcagtgagctgagatcgcaccattgcactccagcctgggtgacagagtgagactccatctcagaaaaaaaaaaaaagaactaggatattgtacctagacttcttgtct

SEQ ID NO: 43864 - DNA, 1035 bp, Homo sapiens
gtgatgaagttaaaaggatatttcaggatatatccacaggaaattatataagattttatatgttatttaagaaacaaaaatgctttcctacaatgagaatttatttttataggattatgcttttctctctccacgtagtattataaagcttccttaaaatgcaggagaattgcagaagagcagtagagacagttttgcccattacttactactgtggtttgaatgtattccccaaaagttcttatgtttgaaacttaattcccaatgtagcactgttgggaggtggagcctaataagaggtgattgggcaatgagggtggagacctcatgaatggattaatgtcaatgtctcaggaatgggttagttatcatgggagtgggttattacaaatcctgccactggtgcctctctctgtttacttgcttgcttctgccttcaccatgggaagaccctcgctggtgctagcaccatgctctgggacttgacagtctccaaaactgtgtgccaaataaacttctgttctttataaattacccagtccatggttttctaatatagcagcagaaaatggactaagacacctactcaccaatcattttcctatttccccccttctcaaaactctcatactgtaactgtcataaaatgtagataggattatgtaggattgatcctaggcccagcttcagggataggttctgattggttcaggactgagataaaatctgtctaagccaatcagcacaacatgcgtgcatgattatagagatcacatcaagggtattttaataggtgggttcagtattattgtttgatggttgtgagaatatgacccttattctcccactggacggatgaaaaggatgatttcaggtttatttccaaccattttgtaactatgaggttagcaatgctgaacatgatgtgttaaagataatgctaacatatgaagaagttaagaaccaaggaaatgtctttctttagccagtcaaaatgatctttcataatctggttctggaacaccttttcagcct

SEQ ID NO: 43865 - DNA, 1052 bp, Homo sapiens
gtatacaagagaggcatcaactttctttttaaaactgtttgcatttcctatcaatttttctatgccatttcatcatctgctcctgttctggccagaaccactgtcttttcaatttcctgttgccagcctctcttgtacatcgggagctctggattaaagcttcccagccaccctttgcttccttatctttttcctgtcttatgctatttagcaggctttttggatttactgtcttggaaaggcttcttgtcattgtattctattcaacattcttaattgtgtcttttttttttttttggtctcaggtatctctcaaattctttccattctcactttctctagagcccaatatagctttttatgcaagacagcttgctccacatagcccaaataatttctcaacatttttcccaaccatggtccacacatccccaataattaactcttctgttttgatatttctggttttggttgaataagaagaagcgaagagaagaaaaaaaaggactgcgtgtaattagagggagagtgagtgacttggttgcccccagtaaatttttgtaattaaataaacgttaaacagtatgtttcaggttctctccgtaatacctttgctggctgttttatttatttttgtgaaagaacctttaaaggttatatcatatctgtgatatattatgctcagttaagtatttgctgagtatttaatattgaaacattatcttagacatttaccgtgaaacttcctttaaaaaagacaaattttaactttgatgcaattattgcactgtgttctttgaacaattttaatctttctaaactccacttaatatttcgcaaatacttttgtgtaaaaggataaaaacaactttatgccaaacgtagatttttcttctgcctatgtaaaatatttaagtaacttaatttaccaaaagtagcaaaataattgttaattctttatttatttttgttccctaaataggcagcttgtagagtctgtaggtttttttgttttgttttgtttttgagatggagtctcactctgtcactca

SEQ ID NO: 43866 - DNA, 1098 bp, Homo sapiens
cgtactatttttcacacacaaaagggagaatatatttattcaaaaatatggcatgatgatatgctttgttaatggtggtggtattgatgatagtctgagaaccacaatcaataaattagaaattagcaagcatgtgtgaaatttgacaagtgataatgggttcatttgtggatggtagaaaatgaatacaattataattaaaaatgttctattttaatgaaataactatatatttagatgataaaggaaataaaatttgataaagaatcaagagaatttattcatttactgcatgtaggggagaaataagagtaaaaatgaatgactcaggtcttcagattgaatgactgtgtacatcatggtatttggactagaggggatctagtttctagagaaagtggtacttttcttttctacatgatgaatttgaggtgatggtagactctattgctgtagctgtcgaacagcaaatggaattagaagattgacacttctgagagagaggatggtagtggatatgtactttcatttaggtgacaattgacatgaaaaaagccagagcagaggcctgaatctggggttaaaacactgtatttatagagtggaagaatgaaatagagccagagtctcatgggaattatgacactcatttgtcatctgatgcagcacaggaatgagtttggataaagaagtagtttgtagttaaataaggaatacagttcaagaaagatgattatggagaaaatacagttagcttgaaatgggacataagagtagttagacaaaggacataatgaaataagttaaacaatgagtgaaatccaaagaagtggttaataggagtttggtaatgacgactttgaaagagtctgtgtagaaatttactagaatgaccacaacttaaaaaacaagaattaaaatttggatagaagagaggagctagcatatggagaaactggaacttaaatacattagatgtgtggatatccatttcacagaaaccactttggaaaattctttggcagtacctaccctacaatccagcaatttctaggatatttccaacagaaatgaatacatgtctcccaacagatacac

SEQ ID NO: 43867 - DNA, 1094 bp, Homo sapiens
ctatttagatgctggatccttcctggcttatcttttcactgttcacctgcccagccttgcatataataagcattgagttgtcttcttctaatgttagaaggaaactttgtggaagacagctttgtaaatgtctcataaaacaacaatttgagaaaactcaggttgaattctggaacacagaatggaaaagataggtacactattttctgaaatgaaatttttttaacttcaatttttttttttaatagccgcagttagattggtattcttcagggaaggtctaatatggtcaaaatacaattgtagtagcagatttcttataatacattgtaaggagcgtgggaaacaaaatctgtctctcgattcagatgtttaaatgaaggttctattataaagttaaaaatatttgaaaaattctgaatgcatagtcaccattgccatggcattaccagttttatttaatttgattcttatattaggcgaattgcagcgtttaaatttgtaatgtattgtaggaatgtgcatggtgtacctgaggtgccccttcccacaccctccctgccacacgcacataaaataaatttgaactaaaggaaaacaaatcagaaatatcctcaaagatgtcttcttacttaggaatcaattttattgttttggatatttttatagataaccctctgtgattcccccccccacattttacaattttatttacacaacactttgtttaataaaatggaattatgaaaacatcattttatttgttggcagtatatgaactagttataaatataagaaaataggataattacttaggttaagtatactgggaaatcagacacgccctccttctgctaagagtttttctcacaaatcctgctaaccttcctgcccacagctcttacctgtctcaaaggggtcaacccatggatcaggatgcatcagttacaactttcacatagatttttctccctggaacttgttgggagcatactgggtattttcaattccgatattccccaacttccctagatcactcggtggatccgaacataactgcaataacagattagatttatttttattttatttta

SEQ ID NO: 43868 - DNA, 1028 bp, Homo sapiens
aataactatttcaagagtacgtactgcatatcatgacacttttcagtctgggaaaggtaccttggctaggactgcaggattgcacagggttgggctgtgtagggggttcaaaggatttggggcctgattgaggaaagatatgaccatgagaggcattaccacaaaacaggttttattgggcagcccttgaacaggaatgcaagagcgaggaagtctctcacagcatgaagccatctggaagcttatggccatgaccaccatcgagaagaggaggagggcaaggggagctcctgggaagaggggaatcagagaggaggcttacatgtctatgtgcagtgattaagcagcactgggggtggttgtggatcaaagagctctgcatggcagcagggccttgggattttcatcgccccgggcttatttgatctattgctagtagatgtgggtggagttttaaggaatacacaaaggaggcagtctcctgtgtggctaaaaatctgtttgttggggctatttaaaaaaaaaatggatgcgtaaaaatttgagttttgttaagttctgaagggctggacctctcagggtcttatgtacattacaaagacaacccaagccacatatatactattcctatggcctgaatgttgatgtttctccacaactcctatattggaacttaaccctcaaggtgatggtattatgaggtgaggcctctcacaggtaataaggtcatgagggctctgctctcctggatgccattagcgctgtacagaagggcttgaaggagagagtttaccttccttgctcttcagctcctcctgccatgtgaggactcagtaactaggtgccatctttgaagcagagagcaagccctcatcagacactgaatgtactggtgccttggtcttgaacttgccagccttcagaactgagaaataaatttctttgtttataaatgactcagtctagggtattttgttacagcagcctgaatggactaagacaactgtattaaccctcacaacaagagg

SEQ ID NO: 43869 - DNA, 1034 bp, Homo sapiens
caggctggtcttgaactcctgaccgcaggtgatccgcccacctcggcctcccaaagtgctgagattataggcgtgagccactgtgcccggcctatttttacttattaattgaattatatgtacataaacttgcctcattagacatttggagctgggtgtggtagcatgcgcctatagcccctgctactcagaacactcaagcctaggagttagaggctgaagtgtgcctgtgaaaagccattgctttccagcatgggcaacatagtgagacccttgtctcttaaaaaaaaaaaaaagacatttgcactctttttaaaaataaatttcatagtatgattgaactataaatatgaaatttaaagtaaagaaaggaaacttattcataagttctggtcaccaattttaagtaaagagagtaaatacggtcattcagatgttaacaatattatagaaaagaatggaaaacctggattatgtttctgaaatatataagcttagaagaagaaagaagacagtggaatctcagatgacttcataatgccactctgtaatgttatcttttagtggcagttacagttctagtccttttatatatactagtacactcagaaatcaaagaactgggtggtagatgggaatgtctgcattgccctgggattccctattggtggaaaacatttacatgatactagtttttagagtcattatttgctactggagcattttaaaaattcatactaaatattactcaataattaccagtcggtgtgtataattctacaatagctgcaaacatttttgtattgaagagtttttgaataacattttctagttagtgatgtatttcataataattttgttttaatatatttaatgaggaaaggtttttaaaaaattattaaaatttcaattttactctacttgattctaattaaaaccaccccttggcaataaattctgcttcttatatatccgtattacaagaaaataattgaggaaacttaaggttgtttcttgtttatgaaggtggatga

SEQ ID NO: 43870 - DNA, 1035 bp, Homo sapiens
atacacagtatcaaatttcatcttcagaataaccttatgaggaagatatgttattgtgtttgaagataagatacagtcttcttacagtctgtaatctgttacattttgaggcgaaagccatctcacttttttttgaggagggggtaagactctattttattttattattttatttctttttcgagacagaatcttgctctgtcacccaggctggagtgaaatggtgccatctcggcccactgcaacctccacctcccaggttcaagctattcttctgccttagcctcccgagtacctggggttacaagcgcgcaccaccatgccgggctaatttttgtatttttagtagagacggggtttcaccatgttggccaggctggtcttgaactcctgacctcgaatgttctgcctgcctcggcctcccaaagtgctggggttataggcgtgagccattgcgcccagcacccatctcactctcaagtgtcaggtagaggaagttttatacccaggtatgtctgacttatgtctgtgcttttcaacaatgtgcttttagctagagctaaaaggttcattaagtcatagatgactttaacttatataaaatctttatataagtttttggctttatatatatataaatggctttatataagccattaacttatataaaatctgtttactaattttatagtattcaattttgtgaatgtattatttatttagctatctcctactgatagtttattttttatgtgggtgatatgaatactgtttatagcacatctttacacatatatgagaaaacttttgattgctttattatacttaagtcatgtaagtgaaattgtagtgtctaacagcatatgggagtcaggtggtggctcactcctgtaatctcaacattttgggaggctgaggcaggaggattgcttgaggccaggaatttaagaccagcttgtgcaatatagcaagaccctgtctcaaaaaaaaaaaaaaaaaaaattagccaagtgtggtggcatgtacctgtagtct

SEQ ID NO: 43871 - DNA, 1044 bp, Homo sapiens
ttacttttatttatttggatttgatacatgcctgtggatgttaaaagggaagtgctaaggctcgacatgtttacccagtgacagggcaatgagacacggcatcaaggggcacaaacttacataaaaacaaggcagtgagatggagctggtctcagataggacccaacagggcttccctccgggaacaaaactagtttagcagaaagagggtagaaatacactgtcaaatgggagctgaggggctggggtttaaatgaccctcagaagcatgacattgcaattgaatgtcctgggtacctccaaacaactaggaaagtatcttaataagggaacaagtcagtgttgaacatcgatcagccccagagagtaacaacacataattatagtcaagaaaagccatccattgccaactttctcttagtgccattgctgaaatcaccgtgtttgagctgctaagaagtgtcaagatgaaatcaggaggaaaaactcagagagtggccatagacctctaccacattctccatctgaagtttcttggtctgaagcagtactaacctggtaatgggattttaaatgaattttacattaagcttagacatttgatttttattccagactagatattttaattgattaactgagactgcttttagcagtaacacttttatatacaatggtgaatggaaaaattagggaacctgaaaggcataatgttgtgttcaaatatgattaatagacaagacaacaaaagggtgatttaaacagagtgtggatttatttttcctcctgtaataagatatacgtaggtaggcaactcaagagatttgcagaaatcccactctgttacttctgtgtctatctcactgggcaacctttggctgcaagggggataagaaatgtggttttagctaggccactgcttctctgaacaaaattgggcaaactctcaattacaatgtatatcccatcagttgatgtctatgttaagactttttcaggatttaatatgagttttatggaagatggtctagagaaaattcattt

SEQ ID NO: 43872 - DNA, 1024 bp, Homo sapiens
cattcgatgatctagataatagaatattctggaaggctattaatttttcagtgaatcctgtatcaattaaccattttcaaaagaatgatttagtgaaagaaaatatatggtatttaaacaattttcatttttatttgagtttggaaaattttaaaaccttcattattcttcagtaaacataagatatctttgaaaatataaatgtaaacactgtgaaagaaaaataaatgtagctggttgttttcttataagcctactaaagaaattacttaacagtctttgataattcaggtttttgaaaaaaggaagttaaaaagtggagggttttttggtgaaattattgctttttagtatctgcagtaattgttattgtgcatacatgaacacagattttatgtatttgaagattaaattgttaatcctatcttttataatatttttgaataaaaagtcaatttaacttattgccttatgtgctagcttgtttttgtttatatgtttgactctaaactacttattgcaactttattttacactcatttgtgcttttgtcttttgatcagctccatctaccagccttatgaagagctgaaagataaaacgatatcaaaaccttttagttgctatctctttgatagcaattttgctttttttttgttgggggtgggggcttgttactatataaaatcatgttatgattctgatgactcttatgtattaggcccttacagaaactctgtgaagtagacacattaaacatttatacattcttattttataaatgaggaaattcagaagaccaatgttcttatccaagactgtgtagatagcatgaggtagtggtagaattcaactttatgacttctgtctaaaatccagtttgttcccctctaaacccacattcataatttgaactattttatttccaagatgtgtctgctaaatgacttttttttctgacatttgctacgtctatatctcaggaactggctccctgcaatgattatataactaatatcattgg

SEQ ID NO: 43873 - DNA, 1070 bp, Homo sapiens
cccagtttcgagattggagagtgcagcatcaagcctcaaaattgcatgtacaaaccactgtggtacaagatgttttacaacctgttaacataacctatattttggcaagctggtggtcctagagcaaatttatatttacatattttttcctgacacactcaaactccaaaaagatcaagataaagaacagggtggtgtttctaatcagttgtttatagttttaaatacattccaatgggaacttgtaagccaaataagtaactattgttcttactagttttttttttctttcacacagatttatgagaaatatcaagatttgtatactgtggaaccaaataatgcacgccagctggtagaaattgcagccagggatattgagaaacttctgagcaacagatctaaagccctggtggtgagtttaaattggatctgctcattttattattttccttacttatctattatttaattttcatgctctattgaggggttttggtatgcgttcttcttcttagtaactgtgttcatctgatatgttcataaaaaatgagatatcatggtttaaatgcaaaccccaaaatatttctaattatgtttattttatattactattatattttaataatctgtgtttaattgattatatgtatatgtatccacatgtacatcatgatacataataataaattgaacatgtttaaatccatatgtacatcatgatacataataataattgaacatgtttacacaacataaaacccagaatattatcatcctctttagttgtatagtctcttattccatcacccttcctctctgctagaggtggccaaaatgctagatattcaagttaccattttttttctttttaaaaatagttttccctcacaaaaatgctttgctaaacaagttattctttagtttgcttactttttagcattatcaaattcatattgcactgtatgtaatcttcagctacttggttttctccatcaacattgtgtttgtatgatttatatgtatgtttgcacttagatttaattcattttattcagttaaatatttta

SEQ ID NO: 43874 - DNA, 1051 bp, Homo sapiens
tacacttacttagacaactaataacaaataaaaggtcattctctgatttaaggggtcactttccttttttctctggaggactgccatcccgcccactgcccactcccctcccctagcagttctctgaatagtctctgtgaatgggccagcacgcctctgtttaggcctcagctactcttggtgcaatacttgaaaagagcaggtgcaggtcagaagtgaatgggacagcccaagatcactgctgggaaacatgctcaagcaagtcacaaactaatctgggaatgacttcagacaaagaaaacaaaagaatgctttacagtcaaaataacccacttgacagagaactccaggatgagaagccttgggaaggactagttgcttctgtctcactttcattttagttctagtaaattttagaggtaaaggacaaaaccctggccatcagaaaatcaggaaatttccttaaattgaaaagaattcctatacgcagttatttatcataatcctttctcactggaactctgtacagtctgtaaccctgcttcaatttgaactttatttctcttactttgggattcacaatatctttgttgaggatgcttccttcaagtcacgaagattcacgtcctccctgatatgtttttttcttaatagtctcatatgtcagtgggtaaaataggtctattaggaaatatgcagtatctataaatatttttgtatttatttatacacttctatgaatataaaactataggaaataaaatctgtacaaaagtaaagactggaaaaaggcaaatgcaaataagaggccggggttgtttgaatgcaaatatgtagaccatggatgttacatagctattaaaaattgacctgagaattttattcttgagttttctaccagccaaagtaagaagggaataaatctgatgtacaatttatatatggaaatagtgtactaattgcataagggagctcaagtattttttcctggtgcttaagatgagaaagacagccctgccataaattttcaatacttgagttattgaagatt

SEQ ID NO: 43875 - DNA, 1051 bp, Homo sapiens
gatttgccttaagaaatccctaaagagcttctcaagcttcaaccctatttcaactccaggtttgctcaattacctgagagcagggagaataccaactttcccaagagacttttctctctttttttaaatttttaaatagacatatcataattatacatattgcttgggtacatgtgatattttgatacatgtacacagtgtataatgatcacgtcagaggtttttctttttactccaaagaaatacaaaggtttgaacacagatacgttattgactccactttctgttagaggaaggttaagaccttagaaaggaattgctgtctccaatcttattcctacagctaatttcactgactttgagtagagtgttctactgattgtcattcaaatgagccacacctacattgccctttctgtaaacctttgcagatttctggaatatgagctcatctttattttgcttcttctgtcctattccctgaagacctcagagaaacttccgcagactggaagtgtcttctcccctgagctcatgttgcatatgcaattttaaaaactcaagtaacaacacaaagaacacgtgagatatatttaacttatcaataaattttaacttatggagactttaaacaaacacgtcagaattttaacttcaaaacaattacatctatttatgggaatgtttattgtgtataaggcactctgctcagttattttaagtttattaaggatatataccttagttcatattattctccccataacccaggaaattaaatacagttaactgtgttttaaagatggggaaacagagactgggggtttctaatagagatggggaatttctatggtcatacatcaagtaagaatgaggcatcgaatctgtacatcagctaagtgggccagcttcctgattagaaatgtcagggggcagggagactaggagttcagttcagtagagataacacctcataccatttagcattctgtacttctaaatgctgtgttgttaacagaatatatatttaagaatggaagtgaagaactca

SEQ ID NO: 43876 - DNA, 1054 bp, Homo sapiens
tctctttgtctcacagaaaatcagttggttcttttacttctaatggtggagttcatcctgaatttgataaatctttatgaaacaagattctgggaaaacacacaagcaaacaaaaccaaaaaagcccctaaaaacttacccgaaataaaccacctgcttattgccgcttcaggaatgattcatttttctgtgtctcaaatacaaggtacaactctcaaaaaatgtctttgaagcaaacttgtactgctcttggctgttgataacctggctgtatctatccatctccatctgtctgtctagctacctatcatctatgatgatagatttcatttaatacagagaaaatttggtttttatttttccttcctttctcccttgtttcttttcttcctatttttcctttgtttcgtcttttctttctcccactttcccttcttccctcccttcatctagatttctctttcttctttttcctttttgtcatttttcttctaagctctataagatttataaagaagaatgaggaataagataaaaatcactcgattgtgatttaaaatgcaggtagacgtatcaagaaatgtgtcttttggagccctccttgacccctccccctccattttcaacctagagttaataaaaccctcctttgagtcccattctaccttttacttgcctctattggcgaacttaatatgctttatttatttgcattgcatattctcagcacagtctcaataaagttttgtttatttctcaacttgaccttgggcaaatttttctttgcctcttctcactccacctttctgttgctccctaattctcatttcaacaaagggttgttgctgctagtttctcactgatgctacactagaagtctatgaggtgtctgtttatctgtaaataaaacaatgtatgcaaattatatatatcagtaactcaaatgttattattttacacatttgtttgatgattttaaattttcgaatattaggaataatttttttacaatgttttaagagttttatcctgtcttgtttatatcataaagatg

SEQ ID NO: 43877 - DNA, 1087 bp, Homo sapiens
tttttttatgccaatgattgggactcaaagtagttaaatgagcagtctgcttgattccaattattgtgttctttatgctagaaaatatttctagcatataggctgagaaaatacatacttactataatactaaacattgaccatggtctgaagtgttgtattataaatgcaggtaggcatgcctgttagtccaacttccttcagactattaattgtacccaaatagactattaattgtgctcagctattgttcatatccatgaacagcataatattcaattcagttcctcagtcacttttagaatacacattttatcaatgaatttaaatgaaataattatagtaattgaagtgccttacatgcttatatgagacatgcgcttagagggtttttaaatatgtaactacattacgttgaattactactaatataatacaaagcgttaaaattaaaatctgaaaagcagaatgccgtggataacccctggcaagtatgcattagcttccatggcagcaaaccacatggtgtaagggaagctgtcctggaatcagactgcttgacactgaccttgtcacttacttggtgtgcaataccaggaaaatatcttttacttctctctagctcagtttactccatcatatcatacattccatcagagttggagtttttttgtgttttttttttaatttgatgttgtgtttttagtgtctagaatagtactcaacatataacaggcatttgatacatttttttgaaaagatctgcaaagtggaatgactatattatctgcccataggatgcttcaaaagtatactgtttaccagaattcttagcaaatataggagatagtagcaactaacaaatatgggaaatgctaatttttactattgaaattgtcattaggttttattattatggctgatggtaaaagaagtataaaaaaataatgaagctggtgttttagagaaaggccctccatctggggcagcacatttgtatctaagagttggttcactttagtcaaacccagaggggagagctatggctttatgtacattctcactaataaaagtttgaagttgcctt

SEQ ID NO: 43878 - DNA, 1022 bp, Homo sapiens
aacacttgctttcagcaaaccaactattttgatactgcagtgaaaaggaggactgcatactctttgttcatagtttcagtaaatcagctaatctgaaggtagctattcccttttgatggcttctgagattatttgtatatagtcaagaagcagatgtatgtaaaattgttaatccacaaagattttatttccaagaatgaagataaaaacattaatgcatgcctggggcaggttgagttctctctacgttaaagaaagtgtatatatatgtatatatatatatctgtttaaaatatatttggcctatggggctgaggctatataaaagtctccattgataactcagatctcagagtgtctgcgaaagtacaaaagtataaataattctccctgtattgaaacacatccagaattaaacaatatattcttgcaaaaggcaattaaaagttttcaaggaatggagtgtgtcatttaagtttggttcagatgttcagttagcaaatagtgagaattgcagagctttttcattttgtggaccttagtttctttccaggcatctgtgcacactggaattaaaatgcatggaaattttttttttttcttgacaaagcatcttttgcttattttctgttctattggagatttttctgacagcctgttgccaatgatgttctgtgttgcacgtaggattttacctaatgaaaccaaggcataaattatatcaaaagactagtacaaggttatctatttttttaaatgcctttccatgcagtccttactacattatatctgtcactatacacttcttccggaacagctgtctcaagaacttctatggagtttttccagactgttgagataaactagtttcctagaaaatcagagttatgtgtttcaagactctcttgaggggtccttattctgctttccagtaggtcacttaaaacgaattgaattgaactagatctttttacaaagatgctgcatctcccagataatagttacaatgtcaggtcaagaag

SEQ ID NO: 43879 - DNA, 1084 bp, Homo sapiens
gaacatctgcaataatgctttcctaaaattataagtaaatcaattttcatggtcagaaatttactagacacaagaaagagtatatatagtgggttaaaatgggaagtaggacatcacaatttcttttctttggaaggatctgaaattttttttaacgatgaaaattcaagatattttcaaattatataagacattgattatttaatgaatgaaatacttaataaaaggttttgtggagcgaagtcaatctcctgtaggtaatcttaacaatatttttggaagccttctgcatcttcagtttttcatttgaaaagttagtaacactgtcttctgaggaaagaactgatggttgacatttgtacttcatgttagatttctgaataaactttatgaaattaaaaaatgcaatatttttcataaagatgtgccatttgcttttctttcgagaaaagaattcatatgcactgtttaatcaggacaaatctcaaatctttgggggaaaatttcaaatttataaaaactgagtgcaaagactgtagtgtcaataaaggcaaattattatgcttctgtatgtaaatttctctcggaatcattagtaaatatttttgggtttttttttttgccagtttcatttttcacagaaaaagtaatgtaagaagtttttatcagctgaagaggaagagcatgccatcacacactataaaattaattatgcactaattggagttggacttcaattagaattagtagttcaaagtttttttttaaaaatatagagtgtttacatttgtgtgaagggcttaaattctattatggtaaaacaaatgatgtgtcagttaagtatcttctttcattttttgctctcctgtttaacatacattctaatataaattttcttttggattaaagtagtagttaacctgttctaagagttaacactaaaatagatgtttttcagacaaggaaattttgatatgattatttctctgggttaggtgtttcttttggaaatgtttgtctccctaaggtgtgaaacataaatacatgatatggtagcagccacataatgtgtattggttgatat

SEQ ID NO: 43880 - DNA, 1056 bp, Homo sapiens
tactttattgagatggttataattacagtttctcatcactgatcctttaccagagggttttagaaggtgctcagctactagaaatcaaatgactctaaggacccaactacttcaccttcaagacactgtcatttgcagaatgaaactataaccaatttttgtaagtccttcatgccaatgaatagattttgaagttccacaactacacttttttgtttgttttctgtttctgtctcctatgttggcaaggctggtcttgaactcctggcctcaagcaatcctcccaccttggcctcccaaagtgctgggattacaggcatgagccaccacactcagcctgcaactacacttttagccatacctctataagttatagcaatcttaagtctatttgtggattctcagttctgatatggacttgctgggaaaagaaaaactatttttaaagatattcaaatagaaggaaagccccaaaatatgtgtctaaagtattggtgttatttaggatctgttcccatgtttgtaacccatttgttactatagaaggaattctgccaaaggattttcttgttttagttttacaacaatgtcaatctttctaatttttatagcttaaaaattcaagattgcccaatagtcacattaggtttaaaataattaacatgcattgctttcattaaaacaggggttttcaaccttggctctgttgacattttggcctggaaaatcctaggaagataccctgtgcattgtaggatgtttagcaacatccctggcctctatccactaaatgccagtagcatcgttccacggtgacaaccaaaaatgtttctagacatggaccaatataccctgggaggaaaagtcacccccatttgagagccactgctttaaaagaaaagagttcaagcctgtaattccagcactgtgagaggccgaggcaggaggattgcttcagcttaggagtttgagaccagcttggacaacatagtgagaccttgtctctacaaaagataaaaagaatagagctattcaaatatttcattatttgtcatg

SEQ ID NO: 43881 - DNA, 1032 bp, Homo sapiens
aaaacaaaattaaaggaatgaataattgattccatgagagtgaagacattcacaatattcaaggataggaggatagatggtaatattaatgtgaaacataagcatacaaatgtaaaatgtatgtgaactggcagtagaaaaataagcaaggggaaatgggattcaataaaggagtaaggatttatattgattttctagaatattttcttgacaattagagtgatgatcaaaggtaggaagaacaaggatgtgaaagtcaagagaaaaacgatgagttctcagcttttttgtatgctggacatcctacagcaagtttctaaccctccttagcagtctcagctgctttgttgtaaaaatggtatgaatagtacgtaactcaaaatgttgtggaggtggttaaagaaaggcaacgcaaaaaaagctacgggatagtgtcagacacataggagaaactttgcaagtgttactttctcttttcttccatccctgaagacaatactgaagagattgagaaaaatcaaatacactaaacataaaataatattggcacaaaaacaaaaatcaaataaaatccatctgttcaaagtcatgtgttttgagatgttttgacaaaagatcaatacatcctatataatagaaaattagatgaaaataaataaaagcagctcactttttgcttaaagcataatttcaatgggatgtttgaatcttgttagcccagttattaacaccatgaaatacatttttgtcgcttccagatagtagtaattatttttaatagagtaatgaaaataaccaaaaataactgtactaaataactcttcaatgaaaaaatagcccctgatatatataggaaagtagaagctgttgaattgtattgaatacctccttcaccgaaggcaaattgattttgatgagaacaggttcagcctgtagtgtaaaaataatctagcatctggatttcatttatatacctaaaatgactcagcaaatatagaacttttctctctaaatccattttcaactccctcc

SEQ ID NO: 43882 - DNA, 1039 bp, Homo sapiens
tacaacttagtcctactgcatgccttaagatgacagtcacaattttagtatagcaagaaaaattgaagtgaaaacctcatactattgagacaactacaaaaccagtcctacatctaaattgaagaaagtagctaatcaaatgcaatcctaaaatgcctaggagtttagcaaatgcagacatatcaagggtagtcctgaaaagggtttaagtaaagtaaggggaattattaaaaagactaaattgtgttattaagcctacctaatgttagtgattatctttgagggacttattctttctagtgggtctgaaataaaggtcagtgattatgtgtttgtgtgtgtgagcgtgtgtgtgtgagagagagagagggagggggagggagagagagagagagagagagattaagactcatttcttaatgtagcttttcattccttatttagttacttggtgattcttagagaagaaagtcaatcattacaggtgcacttagaatctgattctgaagactgttctgaatgtctttccatttgttcagacactgaatcttaattttaccatttcccttttttgtgtgtaacatggtattttatcaatgaggagatgaaatggtacccatattacatccaggatatagaagctaacaagggggcatacctggagtaaaattttaaatgatagcttttgctctgaatataaaaaattccaagatatttgatataattttttatggactccagatcgtttcagtcttgtagtaaaacatacatttccatgctcagaacaccaagctactgcaggaaaagtaccgttgcctatttctaatagtgtggtatttggaagaggatgtttggaacatgcatatgatgtctctgagtttgaactgatcggaaattgttaaattgatatagtttgagctgtaggttaaatttataaactctttcaaattactttgctcacaatagatctgctgttagagtagttgctgttatccctaatttactaatgagtatgaacagtgcagctcaggggagctaa

SEQ ID NO: 43883 - DNA, 1048 bp, Homo sapiens
gtatataattttctttttatacttcgttagatttgatttgctaacattttgttgagagactgtattttttaatcattttcttatagatgtctagaaaagaaatttcaatttagaagtcaacagtgtataaatgatagttaatgtcaaggaataaaagtagagtgtggtgtttgaagccaagaaataatagtatatagattaatagtattactcccaccactaataacttacattgctgagtgttttatgccagataatattctaattggtttagaaagtatttgcttttttggttttgttttttttttttttttttaaaaagcacttctagttttttttgtttgcttgtgtttttttttttttttttttttttttttttcagtttttcagatgaggaatagttcaagtataagtcagtcaaagaatgtaccctagaactggctttccgacccagattgcctcacctaaagactcaagccctcaaccatcacacaatattaatgattggaatcccctttggtacaccgagaacagaggactggagctagtacttagggaaagaagactgtatatgggtcaggaagcggaagatcatatgaagaaataacaaatttgaggaaagatgggagagaatggggactagaatttttgtaccatttattcataataagctgatgaaacctcaatttatcttattttgttaaatcgtagcagtgaaaaggagacctagcatgactaactccattttgcttccaaccactcactccccaccaaggtgatatcttttagcttaaccgcttttgcttatctctgcagtaggcccagctaaccatggaaggaatttagtttatagtttaaagcaaggagataatagttccttcccaaaactaacccctaaggagataaggagggtatacatagaagtactaatgttgtgttaaagatttgtaggagcattgtgacctgaccaagaaaaagaagcttcacaaagcccccagaccctagacccttgctgtcacacagatgtctgtgatcatcggtaacctct

SEQ ID NO: 43884 - DNA, 1023 bp, Homo sapiens
acaactgtcattaacatatgtattaccacccataatatgcattagttctccagaacttgtttctcttacgattgaaattttgtgccatttgatcaaaatctccccatttcccacaccccctaacccgtggtaaccaccattctactctctgcttctatgagtttaatttttaaattccacatataagtgagatcatataatacttgtctttctttgcactgaataatgtttcactgtgtatgtgtgtgtattatgtatatagtcacaatttctttatccagtcatccatcagtaaatactttggttgtttccatgtcttggctattgtgaataatgctgcaatgaacatgggagtatagagatctcttcaaaatacaggtttcatttcctttgaatatatacccagaagtggaattgctgtattatgtggtagttctatttttaattttttgaggaagctccatactgttttccataatagctgtactaatttacattcctacagtgtacaagggctctgttttctttatgcccttaccaaaacatatgtcttgtcttcttataacagctattctaacaggtatgaaatgatatcttattcgtaattttgatttgcattttcctgatgattagtgatattgagaaccttttcacatacctgttggtcattcgtatgtcttctttggaagaatatctactcaggtcctttgctgagtagattttttaattggattatctggggggttttttgtttgttttgtttttgttattttgttgtgtgagttccgtatatattttggatattaatcccttataaaatatgtggtttgcaaataagcttgtaattattaaagaataaacattttattaaaaataagtgcttttctctgcttaccttttactatgatctaactatgatactttcaatatgctgcagactctcattcttatctttcttttgttgttaccttgttacctagaactcttatgtttcagcctaatttcttcatctgcaaagaccta

SEQ ID NO: 43885 - DNA, 1057 bp, Homo sapiens
cagcctctccacataattctttataaatttttaatacctatttttccttctttttcagatattttttatttttaatcatgagtacataataattatacatatttatggggtggtacatgctgtattttgatacaagcttataatgtgtaatgatcaaatcggagtaattagggtatctatcacttcaaggcttaatcatttctttgtgttaggagcattccaattctactcttttagctattttgaaatatataataaattgatgttaactgtagtcaccctattgtactaccaacatcagatattatttctaactctattttctacccattaatcatcccttcttcatatccacctcctcactgtgcttcctagcctcgtgtaaccataattctactctctatctctgatatttttcttttccaagttccaagtatgtacgatttttattatagttgacttgaatctataaattaatttcaaaacatgaaaatttttatattactgtgacttctcatctatggttatccatttagcttttcttttaatataaagcaaaatatttttacacacgttctatgtatgaaacatctataaaatatatataagtattataagtcaaaaataaaatgatttattattgagagtagtgttttttctattgcatattttaacaaatcattccccgtatgaaaaatttttattgttgaggattttacatatgtgtgtgcgtgtgtgtgtgtgtgtgtatagtataggaaatgtataagataaatggaggaaaatttcttaggaaattactaccttaaaacaatcagtatcatttcatctaatatctttggtctttttcatatataaacagaaactgcaatttcttgttcccgtttaatggtaaaatatatacattaataattttgacagtcattttgttaaaatatttattttttactcatttacaatcatcaaatatttaataggaatattattctaggtattatatggtatcaaaaaataacttctttttcttaagctttgaatctagttgatagaagcaatt

SEQ ID NO: 43886 - DNA, 1050 bp, Homo sapiens
tttaactttccctgcctattttgagggtaaacatcatataagtttttatcaacatcacgagtttattaatcagttatatttctcctcttaaaaatttcctttttatacctgttggtgattttgggggagggagtgtctgtatattatgttttagataatttaaatctttatcaatttatctatctggaaatgattttcccttatctgtcactcatttttaaatttctttatgagattcattcttatatgaatttttttatttttatgcaatcaagtattttaatttttctttatgattacttttacatttttaattttatgagtacatagtacgtgtatatatttatggggtacatgtgatattttgatataggcatacaatatataataatcacatcaggataactgggttgtctgtcagctcaagcatttctcatttatttgtgttaggaacattccaatgtcactcttttagtaattttgaaatatataattaattatagttgactgtagtcaccctgttttgctatcagatactaaatctgattcattctatctgtatttttgtactcattaactatccccacagccctgctccacccactatccttcccagcctgtggtaaccatcattctactgtctatcgccatgagttcaattgttttaatttttagttcccacatatgagtgagaatataagaaatttgtctttccgtgactggcttattttgcttaatgtcttccagttctatccatgttgttgtaagtgacagaatttcattctttttttatagatggataatattccatgctatatatgtaccacattttctttatccattcatctgttgatggacatttaggttgattccaaatattggctattgtgaatagtgctgcagtaaacatgggagtgcatatatgtcttttatttttttttaatttttttagtatttattgatcattcttgggtgtttctcggagagggggatttggcagggtcataggacaatagtggagagaaggtcagcagataaacatgtgaacaa

SEQ ID NO: 43887 - DNA, 1051 bp, Homo sapiens
aactgattgatgcccagtttgtataaatggcaatatgatccgttaacctctgacagcaagagacaattcttttaggctttaatttctgccaagtcagaaaataccttgtattggaaagagttttaaaaatggcagttgagctttcttaaaaagctggtcttacagaatttggaagcatactgagaaaaacagcctaatcagtttacctagtgaattttttgtcattctggtaatcaaattcaaaatgagtcagaattactcataatggatatttattttattgttgatagcacccttttctaagctaacttttttactatgaaaataatatttaaaagtaaatatgtttcctcatgtttcaggaagtcctggagtcataattttgcttccttagcaagatgattgtgcatggcctaaataatgtaggaattgctaggagatatttgtcactatgcaacaaatgagtcttttaagataagacccagtgatgtaactgagattttttgagatctttactctgtctgcctgggtggcttccacattttccattaaatactcaaaaatggcctagtggagatatcctgcattttttagtttgcaaacacatatcttccttttactttaatggccattacttaatacattaaaaagcatatatattcagtactcaaaagcatttacatacacacacacaaaagaaattaaaggctaaaagaattatcaataagaagaaatcaataaggataaaagaattctaccattaattagtttcaaaagaattacataatggagactggtcagcacagtggctcatgcctgtaatgccagcactctgggaggccgaagtgggcagatcacttgaggtcaggagtttgagaccagcctggccaacacggcaaaatcctgtctctactagaaatatgagaaagccggcatggtggttcatgcctgtagtcctagctactcaggaagctgaggaaggagaattgcttaaacctgggagacagaggttgcagtgaactaagttttccctactacactccagcgtgga

SEQ ID NO: 43888 - DNA, 1050 bp, Homo sapiens
tatttttaagaatgtttatttatcaaagtctttccttcttctattaaatatttagcaattacctttctaaaatatgaaattttgtaagatgttttcacctaaataaaaattgaaagcaagtggattacacaggagaaccattatgaacatttatttagatattaatcttaaacagtgtttatttcagttttcaaagttagcttataggttatacatttaagttaaagtgctcataatcacttgcaatttcattgtaaaatgaacaaatacataaatattttaagaaaaatttaagtttattcagataagtcaccatgcttcaaaagatctaagaaatgcaaatatactgaaaattgacatcctctgaaaattccacttgctatttacccaagaatccactggaggtcattactgccattaaataataactgaaaagactatgtagtgaaatgtatttttaaaaactatattcagtaaaagcctgctcaatttggagaaatagaaccacaaacacagatcacaggggccttacaaagtttatgtctgaacaaataagtcaattaagtacactttattgaaaattgccttccattaacacacaagaaagaaagcaggattttctcctgtatctgaattttaaaattaaaaaggcagataagacataaatagttatcattttaattgcaataacacagacaagtagttaatgatgataacaatggtgtaacttgtaaactaaatatttggtaactgaagcaataggcagaggaaaatagcttttctatgacacaagtcataagaagtccatatactgaagagcgtttgattaaaataaagtgactattaaccagaaaagaaacattttacataaaatgctaaaatttattataggaaaataaatcaaacccaaagaaagtttattcaatgctaatttgaaagaaaattgataagaaaactttgagggcccaagtccacaatttggtgagaccactaaattttacatataattatacacacacatatgtacatatatatgtatataatcttgct

SEQ ID NO: 43889 - DNA, 1033 bp, Homo sapiens
catcagtatcatatatcaggtttatgttggaaagtgtttttaataaaataaatttctatttttatgctctgtcatattaggtatattttctgtaagtaaaataaataaatatatatacatatgtatgtgtgtatatgtataaaattggtcaaaggcaggccagataaataaacaaacaaatatataaattgtttcctctatttcttaactaaaactgattttattattaaatgtattctcaactaaatcaattcaaggcctatgtctgtccttttcctgtgaaagtatggaaccatatggttggtagacatggaaataactgcttcttcctgaccagctaccagatgttcagagttctttgttcaattacttttttttttactagaaattataaaacatactgaatcaatctttatagctaagaataataaaaccgttttcagcaaaaattttgtatttatatagattgcctataagaatatttgatagaaatgatgtattatgcactatcttcttgacagagaaaatctggtctgcagacgtagaaaaaaacacagatggatgaaaacaattctgtaatcaagatttgatgttggaggtacccaagtaaactgacagggaaagactaaattgtggaagaacttcagatacaaatttctaagtcattttatatttttgggtatttatagtccatgtaagatacctctaactttctaggtgatttaacctacataatgtatggccctccagaccgagcatgaaaacagcttatattcctgtctttgtaatgtgtatttgtcataaccaagagtgtagatcaaaattctgagaggcactatctctaacatggaaataaacaatgtaggacaatttctatggtaattgtcatgattccgtatcttgtatcttgaccaatctggactttatatgtacataatacagtgtttctcaaacttgggtttctgattttttttaaaccctgcttttttaacttaccaaacttgaaaaaacaagcaacaaacaaacaacccta

SEQ ID NO: 43890 - DNA, 1050 bp, Homo sapiens
ggtgtatatagaggcaaattcaaatcaaatcatttgtgccacttggggaagtttgattaacgagatcctgcttggttttattaatctttccacattcttcacttctcactcttgacacctaaccattctttttggaaatcacctttattttcttcacatttagtgcagctttaataataatttaggtttgaaatttttcccactgcatttttttataaactatttacaagatctttatttctaagcatgtggtgaagatctttctaattttctaacctcttgttaacaaaatccacctggtaaagaaaataaaatattaaagtaattgagatcttttacctcaagcattttcttttggccatacttcttagattataaaaaggtataaacatgcagctttggattgtaatatcagaacaataatgactttagtaatgattctcagggtcattgataggttctttaatgctgtctttgaggcaagtgtgaatagactctaaattaccattaagaattctgtgactgctgtgattacctaagcaaaacatatttgatagattgtataaatgtttgccctgtctccttagtgaatgaatgaaatattacctgcttgaaaaaaaagtaactttttaaaactggtctcttggtcatgtttaattgcatgggtttgttgcttactttatgtactgacaaaagcacagcaaatgattcaggcaggaagcatggttgatgcccaataccacccctccttagaaagcaaggaaaagccaaatttatgtggagtcaaatggtccagtgaacctagtcccaagctatgaaactctttgatgagactcagtaagagtctttatctaaaaatagataggaagttaaaaattccagcagattcacactcaaaattaggcaaaggctgatttcacatttagcatatttacagagaacaccaaccattggagcctggaaatgcacaagaaacaaaacaattttattcctgcctaagagtgccattttcagggtttcagaacacagtgggagaccgttgattagaag

SEQ ID NO: 43891 - DNA, 1069 bp, Homo sapiens
tcaatatacaatatttaattttataaatgtaaggtttaaaatacattagaaaataaagtaagcattcagtacataatttaactatgattttgaaaaataatttgtttagttaacttaggatatttgtttcagataagaaagtgataaacaagttttatgcaagattgtttttaatgagttttaaataaaccaagttttaatttatatgagatatagttgatttggtaagtaaaaatctgttgttttattgttaaattaatcaccgttgatcacaatatatagtttaggtaggagatgatggttgtttgaatgagagtggtattgattaatagggtagcataattttgttagctacacaaagtacaatattgataatttcctaaggcctaaaatatttatttatatttggaagagcctatctcaatacaatattaaaataagttaagcagaaatgtacctaaaatattcacaaaatttagatgctagccaactcaatcactttgtctctgaaaacatagattctaagcaaaagtttgagaaagtacatacatgtacttttaaacatgtgtttaaagtagacagtgtgcctgatccgtatcataatttttttctagtaaatgtaaacctttgttgttgttaagtagagtttttctatttaaatatcatcattttatgaagtaggggactgacatacactgtttcaacataacctttttttgtactattgagtattttttgaacttcatggttatgctatatgataaaatatacagtagaggttaaaacattatttaaaatgtttttaagagatgtgaaatgtatgtgtaggaaatacactttatataacactatttaaattatctttctcaatacttagtaatttctcagaagtttctctacaatttcttgttacgtagagatttgtcagatggctttacttttacttcttggcaggactcccttgaatctttcaaatgaatgaaattctatgctgcaagttataccacagtctactttttttctcacatctctcaaacaatgagacttgggattttaccaacttcgagtg

SEQ ID NO: 43892 - DNA, 1029 bp, Homo sapiens
atgcctgttgtttgtgtgcaggaatgctagcaaattttgcatattaattttgtatcctgaaactttgctgaagttgcttatcagcttaagaaactttacagctgagatggtaggattgtctagatatagaatcatgtcatctgcaaaaaaagacaatttgacttcctctcttcttatttaaaaacctgttatttctttatgttccctgatttccctggccagaacttccaatgctatgttgactaagagtggtgagagaaggcattcttgccttgtgctggttttcaaggggaatgtttccagtttttgcccattcaatatgatattggttgtgggcttatcatatgtggctcttataattttgaggtatgttacttcaatatctagtttatagagaatttttaacgtgaagagatgttgaattttatcaaaggccttttctgtgtctattgagaaaatcatatagtttttatttttacttctgtttacgtgatgaattacatttgatttgtatatgttgaaccaaccttgcatccccctgatgaagccaagtttatcatagtggataagctttttgatggactgctggattcagtttgccagtattttattgaggatttttgtatccatattcatcagggatatttgcctgaagttttctttttttgttgtatctctgccagattttggtatcaggatgatgctggcttcataaaatgaattaggaaagattccctccttttcaattgtttggaatagtttcaggagaaatggtaccagctcctctttgtacgtctggtagcattcagctgtaaatccatctggtcctaggctgtttttggttggtaggttaaacatgcttactttctttaagctaggtttattcagatttttattctcaatattaggtatatgtcagttctgacttttgattagtaaatacaaatcagaaatacaccaaagtcagtgaacaaatttatctcacaaaattatgtgttcctttcatcatttgtatttttttttagtatg

SEQ ID NO: 43893 - DNA, 1083 bp, Homo sapiens
atttgacacgatcttttgtactagtttcagcctacaaagtgagttcttaaacattcttgctaatttaaaagtttcctggtttcagtaataatgcttgagacttaaccaacattttaaaaaatttccccacgatattaaaattacatattcatttatagtttatatgtatttgtttttcctatcaaaacttagtactctatgtttcatatgaaggcgtatattccatgagtactgaagccattttcacctatgccttctatttttaagaaatcacaattttttgttcttttgtgtattgttaaatgcatacatgtgactagaaaaatcccaaacattattgctaagaatttatattcatattttaataaatcatatctaaaatgtaagaactcagtatcaatatttctcttaccattgtataaagatgaacttctgtttttattcttgctgtcttgttcagtaacattttcaagggatcagccgtgtgtatgtatagcatgagtgatgtgagaagggtgttccttggtccatatgcccacagggatggacccaactatcaatgggtgccttatcaaggaagagtcccctatccacggccaggaactgtaagtagcttaggtgtttaaaatatgaaatgaatatatttctgccaaaggtcaaaaaacaatgcagctacagacagatattaaatgtatcctgtaatgtagaaaaaagatttcaagattataaattaaagcaagacaaagattttccatgattgaatgaaatttcacatttaaaaacatgttctttacagatgtcagttcttaaattcagtataagatataaatctaaaattattaaatcttattttaatttttgaccacacatttctaaatttttgcaaactatttttacatggtagtagagaagtgcagaaataattttcaatctcatgaaaatacattttattgtgtcttccaggtttttacataaatatttgatatttctataaccttaattttataatttacatacaaaacaagaaatacaaccttacattccttaactgttatattgttgtattattgtgtatgtatatac

SEQ ID NO: 43894 - DNA, 1074 bp, Homo sapiens
tatgaagaatagtttggtcttgggagtttttacaagcttagggtaaaatttaaaggaaccacacattttaaggaatcttgtcatctcctgaatgagtcattaaacctgcatttccaggtttcccttgcttggagaaatgtggcgtgggaaactatgttgaccaaaacttagagtaacttaaagcgttgcagcaatcataaacatgtctttagataaaatataacatgacccactggagtcttcatcagcaagccaaatgaagtttcattctattgaatatgtcaattgactcatttagtctgtgaaactgcttatgtgaatcatcttgtgccagattctgagtttctaaaggctgggtatgtagtatttttcatctttatattctcaatggctagcacagaattattcattgttgaatgattttgtgctttatttggcacaccttttaaaaattaacaaataatatgcctgttaataaaacaaaattatttttggaaataataagaatgaaaatttacaataaatcaattcattataaatgaattgtgcattataatatatagtagagaaagtgagtttagtgttaggtgctagggcaggaagatatcagtcaaggcatttaagagtgcacaaaggattgtgagagtaatactatctccataaacagtatctccttctgaaccacacctattccagaactgaatcagaaaatatccaggtcatatttgttagtctgcagctaagagataggaaacatacaataaatatgttggaaggctctaggaatcaggaaccaggctgaggaattattgcattcctttggacaaaaacccagattttccttgtcctcttatcaggtcacagtatatacagccagaaaagaaagtgaggtttctactctaaaaccaagtagtagctaaagataagtgaaagtatcccattctcagtcttattgtatctgaatgtttgtgaagatcaaatcagttctaccaaatgaagttgtaagtgtaatccttgagtaatttcaattggttctttttcattgtccatacttttaggagaatccagacttgg

SEQ ID NO: 43895 - DNA, 1043 bp, Homo sapiens
tgcattaaaatttctaattatttaacaatttgatatcaaaaactacggcttgaatgtcatgatattatttctttgaaaactttggctactgcacaactacagctgcaaagtcaaaagtgattttttcttaagttggagggctttttaaaaactgtgtgcaggcaaaatcttgctctgggtttgattttaatgatacaccaaccagattgaaccataggcattataagcctactatgaattgtctttgactgagcctcaaacatgcagcctataattggacaagagctttgtatcatttgagctccatatccattttgagtccctgcttaatctatttaatgcaaggttcttccattattgagttgacggattccgcttggctgaaggttaagtgctggaaataatgactgaacgtgcagacttagatctttagaccaacatccagttaagaatatgttaagtaaatgcaaagtggataatattctaggacgtttctaatctctctggtacagacctgggacaaataactaaatatccagaaagtatcagtttcttaataccagacattgaaaatttttgttaaagataaagatattcttaaattatttatagaaaaacattaacagacttttagtacaacctctttgatatttcttctaattcataataagccattatgattttattggtataaaatttggggtcaaagtcaaatattgggactagttctagtatcttcagctccctaagaatgaccctcttgaatattttgagaagtacattatgtttttggagccttgtcatgattctaattagtgccaagtttaaatggttcagttccatggagactgtttccaacttctctaaaaactgaaacaaagaaaagcaccattaaaaaaatctgtccttactgtcaatcattttattctctatgactgcatcaattgactaaagttttcctctccaaaagaatgcattagtccattgagaattcaaatgtgataaaagaatcgttctatacgaggtaccttcctaaattgcaa

SEQ ID NO: 43896 - DNA, 1048 bp, Homo sapiens
aaagcaaatggtgataaacttttctggaggtgatatccttgaccatgtaggattctgtatatagaacatattattccaattcagtcataattgtgagctagtaaccacctctaacctttaaacacatttgctgctaacccaggattaaatatatgaggagctttttgctttttgctgaagtctgtagtttgatgttgaatcatgtagtgataatttttaatttttgcctcattttaacttgttcgtttaaaataatgtttcattttagagcttctaataatagctaacatttttgtagcagttaccatgttcaaggaactgttttcaatgatttacatgtataacctcatttaatccttatgacaacactatatgctagattttattattattttctattttctggatgagaaaactaaagcaaaaaatcttaaatggcttgcccaatatcatgcatctggtaaatagtaaagccggggattgaatccaaaaagcttgctccaaggtctgtgctcttacataacattataaaatatccatataagatccaaaaactatatccttcaagttatttctttctataatatcaccagaacatagatcctcatttttaacagcattacatagattttggcggacagaaaactgagacagctctgtggttttattgacatcttttattacgtttggcattaccctttctccttcttcctctctagtaatttttacctacttcccaagagtgtgtttaggattaacaactgtttggaaagactgtccctttacacaaaggtactatgtaactgcaaaacagtgaattatttaccctaatgaaagttagctaattggggtggggatagtagaagatgaggaaacaaaagggaactattccactttgttgaacatagtccccagtttaatccaaagaagggtagagatgacagaaagatatttggtagtattttgcttctatttagaggaaagttattcaaaagaaagtaactaaagaaatgtctttagttctgactatataattgtgggttaaaca

SEQ ID NO: 43897 - DNA, 1027 bp, Homo sapiens
caaaggaacgggtggaattatgtaaattagctgggaaagatgccaatgtaagtatgaaactgtaacaattatctttgtaaaacttctactgatatgatagcaaatatttatattgggctttactgaattaatggtattagtgtattatttttcagactaaactaacatattctatgtgaatattaatgtggaataaaatatctctatcttaccaaaagccatgatattatttataaaatttaagaaatgtagaaacactctactttctaatgtattaattctgaatattatttttgtcacaaaaaagattagaaacacattaaagtattcaaaaataaaccatccaaaagattgtagttctaggaacatgtatttttcatttatgcatacatgtttttgtaagtgtacacaaaaccttcagttattttagcatcacaaacagaattgatacataatttcaactgagttcaaattaaacttaaaatatctataagaattcctttatgtggtgacataatggaaagaacaataagaattagttaataatgaatgacagcattctggcgtaagaactagtaactacttcctctgaaatttatgtattagtaataatgattatataaaataactcataaaagacaaatagagggtactaatgaaacttttagtttaagctgccttgaagagcagagaaaacacttaggtatgactttttgtctctggtatggtcctatctgtcttgatttctgcactgtccaagttgtcctgcatgctccctctaatcatgtaacctgatttatctccagcaatgagggctatggctctgactggctcctctcctcatccgagtgctctgattcaggacagatattctgtcttctgtcctgacttcttgcattatggtaatggggagaattgctcctttttttggcaaaataaatcacattcaaattgtaacccaagatgaaaacaggttgtaacctggggcagaaacatagacatcttgaggcttcttttgcaccatcct

SEQ ID NO: 43898 - DNA, 1077 bp, Homo sapiens
ttgtctttcttgtttataaaacaacacatggctccccattgcctaccaaatcaattgcatcaaaacaccttcagagtacacatgtggtttgtatatgaccagaggatggaagtgacagaagatggaaaataatgtaatggttcatgaattaggtaataaagacagatgaggactagagttagaggaaaatttgagtctggcactttagatttgggaaccaattttaaagtcaatgactgttaaaaaggggtagattctgtcctaccacctggagtgttttcatgattaatccagattccttatcacccctctttgacttgctgcaatgaaaaatttgaagatgatggcctggaaactgcaatttaacaccctcctctacccttactgacagttgatttatgtgtttatactaggttacaaatttttagctgaaagtgcagccagtcattgtcaaaataagagaatatcagggtctaagataagtatgaggaaaaaacagacgaaaggggttgaggaactaaaggtgttgggtcccaccagtagctgaggtgatggtaaagagagtgatgtgggtaacaaagcagttagacacaatagacacagtcagtgagaaggggagaaataagtcacaatgaggaatttgtggaaagggccagaaattctgagtttctgatcttagtgaaacagaaaaaattctgatgatatatcaggtgaaattcacctctgatatttcatgtatgttcttttctattttccctaagtgttggctggtctgagaaataaagggacagagtacaaaagacagaaattttaaagctgagtgtccagaggagacatcacatgtgggcaggttccgtgatgccccgcaagccgcaaaaccagcaagtttttattagtgattttcaaaaggggagggattgtacgaatagggtgtgagtcacagagatcacatgtgtcacaaggtaataagatatcacaaggtaaacagagtcagggtgagatcacaggaccacaggaccagggcaaaattaaaattgctaatgaagtttcaggcaggcattgtcattgataacatct

SEQ ID NO: 43899 - DNA, 1047 bp, Homo sapiens
aaacctgtttatgccattaaccgtattcttggcaccttcctctactgattaaaaaattgatgaagcgcattatatactcaggtacatatttatataattttgttaggaataatatatgtccttttaaggtatatgaacccatctgcattttcccttgcctcttgtttttagcatcttctctgaatatttctgtaaaaggctgacctttggaaatactttgtagtgtttgagatgcgtgattgctttctctaccacatattttctccataaaaggagacttatgccacatacttgctcctattttatatgagaataattgtcaggaataactgatgtccttcttagtttaaagggaattacctgaattggttttaaagaaatatattgtgaactttttaaaagatggtatgcatatgtactcagatattgaaaaatcacaggtgatgaaactattgtgggtgaagcatgattttctcctgataaggtaaactcaaataaagtgactggcctgtttggacacctctggtgtcattcactccctactacaagtgatggcagaatccagtgtaaacacaatacccttgtcatgattgggttgtaatctaactttgcagtttagcccgtgtttatcttagtcacatgaaactattacatcacgtctttctcacgtcgtatcttatgtgtctattgaaacattatctattcacaaactctcgtttaaatgatttctctactgtgaaattttctttgattctactacatctcctatccatctcactctagaagtttttttttttaccatttaattcatcttctatatttctttttttaatttacataaaaaagttttattattattattatactttaagttttagggtacatgtgcacaacgtgcaggttcgttacacatgtatacatgtgccatgttggtgtgctgcacccattaactcgtctatcgcaaggacaaaaaaccaaacactgcatgttctcactcataggtgggaattgaacaatgagaacacagggacacaggaaggggaacat

SEQ ID NO: 43900 - DNA, 1056 bp, Homo sapiens
aaaacattgccctaaaggaattgccatctatttcgggaggatgaaagtaactggtgtgggtagtgatgacccagaataatgccctccttattttggcatggggaagaagggtgtagactgtgtgcccacttacaccagttacccagccgtggtgcacctgtatgtcccaggtctagggtctgttcttccattcggaggacaggcttattgggaaaatgggcttacatgatgggtgaatgcaacccatttcttagattaagcaacctaagctttcattcaaaaacatgagtaagatgtttaaaggcatcaaaattaaaaaaaaaaatagcccagaaggtatgtccagatggagccatttttattcaacctccttggcatgtactgtactgcatccttctcaggtggcaatccatcaatccatgtctttatttggtttttacatttttcattcattaattccttattcattcacatatatttttttcctgtgtttctggagcttttattaaatgaatgctgaataatcctctatgcctactgtaagtaaagggttagcaaaaccctttcttcttttatgtaagaaattgaccagtgacaaatctagctttcacagttgagtctgaatttcatttctcatgtcttctatggttttatgtttttttttttaaaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaagtaagtaccctctgagatgatcacaagagagctagagggcctattttgttgtgaaaattctagacttgatcattatatccaataaatagattctctcagagacacaagaattttctccttgcgaagaaatcataggaaaggccttgagaaagcaagcagaggaaacgattgttattctgacagtagaaagatcatagaacattagag

SEQ ID NO: 43901 - DNA, 1044 bp, Homo sapiens
ctgtgttctgtctttggcatacggtatgagaaaattttgacaaaaggggaagaatctagaggacagaggccaggatattttgtataaagtatgattgaaatatttttttcaggtagaaggaaagacagcaaaggatggaaaatcatgatcatctttgtgatgttttctacttgtcttacagagatttgatatctttcctttgggcactcatggcattttgtgtttcttttggagaagatgatgatgagacagtaacggtagtgttaataccacaagcagctatcatttccatatttgtgaacgtactctcttcatatgtgcatgtgtgtgtatatatatgtgtatacatattcaaacattgcctctaatttctttcaacatttgtgtaatttagacattcctgtacccagttttcagataagaaaactgaggcttaatgaggttaagtaacttccccatgatcatagctagtcatcgctagtcttaggtctggaattctaactcaaatagtctgtttcaaaatgtagtgctttgtatccccttcatgtttttcagtttttacgttatagtagctgtgaacctgtcttatcactattagactacaacctttttcagagcagtttgcctaattcttgaatctcccatggtactttgtcctgtgcatagtaggtactcagtgagaatttccttaatagggtatttcaagtatttgaagggaaattttagaaaagaagaactctggtgaacttagagaaggtaaattccagtgggatgtagtgatgttctaacaaacagagctgcccaatactggaatgacatgttttttcaattagggaactttctgctgatgctcaaagagtgcctggtagggaggatgttttaaaagggagccttcttcgaaggaggcattaggctatacaacttcttcatctctgaagaggtgaactgcggatcacagagattttgctagtggcttgatattcaaatgtcttatattttatttgccttttaatgaccttcagtgttgcaaattattccaaatgc

SEQ ID NO: 43902 - DNA, 1028 bp, Homo sapiens
cactacttcgggatttagtcaatcaaaacttctgacttaaggtgctggtcctgggcttctctctgttctaccttcagaatgtatctaggataaaaagattagtgtttgccaggcatgggaggaaggagagatgaggagtgatagccatggcgtaaggggtttcctaagacagaatacatttggaatccactagcctaggccatgccagttacatctcttacctagaaaactgtttcaaccccctaagtggtgtcgttactttcatacctccacttctgttctctgtatagcagccagtgtggtcttttaagaaatgagagttatttcaaattatctccctgcttcaaactctttaatggcttcccatttcactgaggataaaatccaatctccgttttaagatatctaaggccttacatgttttggcctctccacttctcatttcatgatactcttcttgttccccaaaactgtagtcagattagctgccattttgttcctcaaatatccattcctctttttctgggcttttgcagtggctgccccctctgccgggaatgctcttctttgggctccttctctctgtggctggcttctcctcctgttggtccatttctcctctatgctgacagctcctccccaaccatggctggtgccatctcatcttccaggtcatatcataaatacctccttccctgggcaccctatttaaagtagagctctccttcttttctctttcagagcaccctaatttgtttccaatttgtatcatagcttggtaatctgttattttaattgtcaatttttttttgtctctttaactaggatgtaagtttcccaaaggggaagatcttttctctcttattctccttcaattccctcacatttgcatttagctcagtggctggcttcattgtgttaaggttttggctctgggaagcagatggcttggcttccctgcactatcattgtgaccacgttacttgtgtttcttctgtaacatggagaatatatcttatagaattgtg

SEQ ID NO: 43903 - DNA, 1033 bp, Homo sapiens
ctatgcttatccatattccctttaaaagtaacaaaaaacctgtagtgaattttaacttttaatgctttcctgtttaccctgcctaaatcagctcccactgccagcaatgggttaaccaaatgtaccaccacaagaccacctcctaggtctctatacttgtatgctggtcaagtctcaaacttagtcttcttgaagatcagaagatcactggtaagctctagaccatgttgaagaccatgttgaaaagactcatctgaactacaaccaggcttgagaggagacagtgccatgtctgatctttagagaaactgtactttaaaccacagcagttaagctttcgtgattctaaacttttcttagtggctgaagtgaatgaaattccttattcccatgtaacactaaacagggatttatgcttaaaactcccagcctccactcaactacatactgtcataaaactcaacctcagatgatgtgtttaaaggaggtaaaaagtcatagcagcaacaatgtgtgtggcttaaggactgtggctatttaaattggtaaattaagcctcttgggggttgctcctatttctttgaagaggttgtaattaacagtgtgccttctttgcttgaactgcctatttctaagaattattctaatgacagtttaccaaatcttcgacatcctttgaatcttctgaaacaggactgcccaaggatgatccaatgatatttgattcttcctgatgatgttggagtatgggatctgtaatgagtttcaagttagtcttaaatgtatatatttattctctaatccatgtcaagaatttaaggtattctaccacagtgtagaactcaacaggactagtagcttattggatcaagaaagactgaaacaagttaattaaatgtctgtttttttccatctaaaatttatcaggcacatagtaagtattatattacagtacctgttagtgttgtcaaaggcaagacagattcagtatctataacatcagatgcctggataaagccatgtggtgaaggaa

SEQ ID NO: 43904 - DNA, 1028 bp, Homo sapiens
tagaatcacatagaaagtttagaagtaacaccaaaaatggagttctcaatcttcctccaccctctaccctgccttctccctcaagaatgtagtagggaatgtcttcatggcattgtccatccaggcttttgcttttctttttttttttttgagacggagtctcgctctgtggcccaggtgggagtgcagtggcgcaatctcggctcactgcaagctccgcctcccaggttcacgccattctcctgcctcagcctcccgagtagctgggactacaggcgcccgccaccacgcccggctaatttttttgtatttttagtagagacggggtttcaccgtgttagccaggatggtctcgaactcctgacctcgtgatccgcccgcctcggcctcccaaagtgctgggattacaagcgtgagccaccgcgcccggccggcttttgcttttctgcaaagacttttctctgttttgccttgcccctctctgggagtgttggggagcattgccgaaggattgatttgtcagctggagttcagagctgtgatgccttataaatcagtccttggtcctgccctagcagaaagtaactgggcttctactcaggaaaacgtggacctcagagatccccattgtttaccattgatatttctttgggaacaacagagcctagcctgggaggtatctgttagggtgttgcacctttgtggctggcagaccgtgacctgttggtctgcaggatcaggccacagcttctgtggtgccattgcatgcctgccctgcagcagtgaggcacattatgttcctattgataggccaggccctaagtggtaagatgagatgaatggtctctactggtgagaggcattctaaagaaaataccgttggccatttctgctttgagtctttcatttaacgaacattcattgagtgcttacagtgtgccacactgtcaagaaggaaaacaagtgtagtagttcccactaattcacagcttcacttttctaggcttcagttacctgtggtcagccat

SEQ ID NO: 43905 - DNA, 1048 bp, Homo sapiens
agggtctcacgctcttgcccaggctatagcataagggcacatcacagctcactgcagccacaacctcctgggctcaaccgatcctcctgtctcagccttcaagtagcttggactacaggcacacatgcaccaccatacccggctaagtttttgatcttgtagagacaggaccttaccctgttgcccaggctggtctcaaactcctagcttcaagcaatcctcctaccttggcctcccaaagtgctaagattataggcatgagccactgcacccagcccaaaaaagttattttagatcaccattagattgtagtggtctttcccatcaaacataacaggcttgtatccctgtggtgaacatagaaggcattgatttcagggaaattagcatacaataatgtaattcataccctttggcagctaaaaaaattaaagtgcttgaaagatggactctacattgatgtccagagagaggatttataacccatgtaagtaccaacaaaaatacttaaaaattagagtaagacttgcattgttaaagtttgtagatttggattgttgaggcttaaatactgcatagttctatattcactatgtcataatttgcattgctgctgcatcagaggagcttaaaaatatttctaccttctatggcagaataaatttagagagcatgattctactaatttctacatttaacaagttttcttaacttgttaaaggaatgttagcaagtcaacattccttcccatctcatattaccaactcactcccagcactcagtttaatgatatgttttggtaagtgcttaatagatgattcatctctaaagatgagtagagttcatcagctgtatcatatcatgaaaagcacaaaaagtcagctgaactagcttttccgcatcagtctcgggacaggatttccaggctgaacaggccacaacaaacctgtgaagcataaataatgattaatgattacacaaaaggctccaaatagtgatggtgaatacaaccaggactttatttcatctggatattcatacatgaaat

SEQ ID NO: 43906 - DNA, 1061 bp, Homo sapiens
tgtatacaaatgaaaacagatataagctatcacctcatacctattaattggaagaaaacagattaaaatgataaaacccagtgctagtaaattacaatgaaacagatatatttatatattcctgttgacaatgtaagttattaaaatgttttaagataattatttagccttttattaacaagcaacaaatgcccagcaaatccagtcattgtacatgtaagcaattgttgtcaagggagaaaaaataaatcataatcttcaacttagtaattctctactcttgcaataaatattgaagtaagtcaaatatttaagaagaaaggaagtaaattaaagcatgtaaaaaatagcaaaacatgggccaggcgcagtggctcatgcctgtaatcctgtaatcccagcactttgggaggccaaggcgggcggtcacgaggtcaggagatcaagatcatcctggctaacatggtgaaacaccgtctctactaaaaatacagaaaattagccgggcatggtggtgggtgcctgtagtcccagctactctcgaggctgaggcaggagaacagtgtgaacccgggaggtggagcttgcagtgagtggagatgggccactgcactccagcctgggcgacagagcgagactccatttcaaaaaaaaagcagaacaccataagctatcaaaattatatgtagaccaggaaggtaagtgtgcatttttatttaaatttaatattggaacataaaaataatggtatgccaaaaacataaaacccaaaattgtttatggcaaataatccttccacgaaaaaactgtatatatgaaaataaatatcaggagagagcataagctttttatttttgttcttgcatattgctgtttatttctaattattatttctaaacactgaaccaagttaaatattaggtaggatgtttttcatgaatggtcctgatacttcagctattaaatggttaaatacttaataggaaatatttctttctttcagattaacattgatgggcaggatattaggaactttaatgtaaactatctgagggaaatca

SEQ ID NO: 43907 - DNA, 1047 bp, Homo sapiens
taaatagtaattcaactcaagtcaggtctcctaagtcaagaacatgcctgtttcctctatgtcaacccatcatggcccctgcaccttgtaggtgttgggtaactgtgtgcagaatgaatatttacgtagagtacttccatactgtgtgtccaaaagtggggagaaagggagataacttttacttattgatccctaaccggctctttacagtcattggattattttctctttacatcaacactttgaggtgtagttaattctacattaaagataaagacactgagtctcagaggttaggcagtttcccaaatttgcacaactgttaagtgtaaagtgaggaccaaacttagttctttggaaacgaaacccatttttgttggtcatgcctctgtgccctactgccaacctatcaaaagttacattttaaggactgagaaatgaaagtggaatgagttttcaaatgtcttcttttcagaaactctttgaggaaagcacacatctttggaattacattttccttcacccaggcaatgatgtatttttcctatgctggatgtttccggtttggagcctacttggtggcacataaactcatgagctttgaggatgttctgttgtaagtattgggctattatttagttaagctctaaaaataaagctgggatgaacatgcttcatgtctagataggaaaccctactgtgaagcctcatgaagagattctggtgattcctaaatcggcatttctgcctctgagtcttcatgtgccaccattgaagcaccccctttcatttggaggagcagtaacttctttcctcattgctggctcacacatagttgaccttttcaaatctgtgactgagtggagtgattccattcggagattttgagaaggccttggcatttgggaagaagcctagccctgagcaaggagtctgactggctccttttaaaggactttcttacagagcaagtaaaatacagatgtgttgtactaagttctgcaagcctttggcaattccaggatatgtttactttcccttgataag

SEQ ID NO: 43908 - DNA, 1035 bp, Homo sapiens
tgtatctaaaatttactttttattgcctgcattctttcactattttccaaacattcttcaattgtcacaaatggcaatgataaagagaaaaatataaacatcacattttaaaaataagtgtaaaataactgtgaacttaaaatgtgatcatcatagaagaaagagcactgcaatagaagtactgtgagttctctggttaattttgcgaagccacgtaaagctgtgtggctttaagcaatgccataatccatttaagtcttagcttctatttctgcaaaggagaagtttgaattagtcaatcttccttccagatccataactcagtttgataaattacttagtatctttttctacagagaaaatgctcatacataataataaatatgtaatcataaaattattttcattagtctgttttatagaattcaaattaatcaccactatttactcttgtgcctcttggtgatcggtgctgtctgttacagatcgctactgaagcaatagaaaacttccgaaccgttgtttctttgactcaggagcagaagtttgaacatatgtatgctcagagtttgcaggtaccatacaggtaataaccgctgaagagtgggaggagagtgtgaataatttttcaatcatcatatttgttttcagagggattactttggctagaaggtagggagcaagtggagaaagtgctcgaaggtaaaccattgagaaacagttgtaattatgcaggagagaaagtacaagaccctgaactaaggcagggacatctctgaggtagaacctgtaagaatgggtcactgatgagaagggagggagacatgatgctgagaatgactatctgatgtccaggtaggatatgaccctataatttgctctagttgaaaatgagttatttatggaacctgaaatttgaggtacctgtgggacacagagaggatggtgcttcctgggtttacctgtctttctgctttttaccccttctccagtgcagaccttcttcctttaatacagtcatcccagtgagggctc

SEQ ID NO: 43909 - DNA, 1031 bp, Homo sapiens
ctatgtggcccccactctctctcaaatctcatctcctataaccgcctttttccaatacaccgtctactccataaacagtggctcactgcccaagagtaggggaggggaggatcagaggagccaaatcagaacacaaatctgtccagaggaagggggtggcttttacaaattcatacaaaggttctttttaggctgctggcagcctttaaggctttcttgctggtgtatgaacagattaggtatgcctttgcctcagggtctttgcacatgctgtttctgctttccctgaggtattctcatcctttccttcattcaggcctctgttcagatgtccccttagaaaggccttctgtttcccctccccagtctctaaaatagcacctcccctcacttttctgttcttcttaccctgctcaatttttcttttatttgtaccttccatctctagaatctaaacttcatgaaagcagctactttgtcttttttgttcgtacaggtccaacacttagaaatcatgcgtaggagaaagtaggcactcagaaatttttctgacaaatgaaatgatctatttatgtgtttttatattaagtttctttcttgtgtattgaatgtcacatcctgagtactaaatgcagggggtataagtataaacaaaactgaccccatcgctgccctcttggagctgagagtctcataaacagctttaaggtaataaaatcattttctgtgccacaggatgtgagttggtttgatgaccctaaaaacaccactggagcattgactaccaggctcgccaatgatgctgctcaagttaaaggggtacgtgcctcctttctactggtgtttgtcttaattggccattttggaccccagcatgaaactaattttctccttacgggtgttagttatcatcattaagaaaatgttgaataaatatctaacctacgaatatatcacatgctttttgtagcaacatgttaactatttaaacattatatactgtagagcatatagataacttataaaccatt

SEQ ID NO: 43910 - DNA, 1050 bp, Homo sapiens
aaaaaaatgaaaaaaggaattaaatgtactgttagttacaaacttttaaaatatttttaacacctagtatttatatgttgcctcgccattttaaattttaattacctatgttagaaaaagacagaagaagtatgaaaaaaaattgctgtcactatctcagtagcctgatggtttttcttcacattcctcaggtattcttttctgtattaattggggcttttagtgttggacaggcatctccaagcattgaagcatttgcaaatgcaagaggagcagcttatgaaatcttcaagataattgataatgtaagtctgagttggccatctatccacctatctaaaagattgtccagttaagtcaatttctttgtcactttatccagctctccacaaaatatcactaaaagtagttattgtaacctagtaatctcttaaaatttgattctgtttagaagccaagtattgacagctattcgaagagtgggcacaaaccagataatattaagggaaatttggaattcagaaatgttcacttcagttacccatctcgaaaagaagttaaggtacagtgataaatgattaatcaacaattaatctattgaatgaagagtttctgatgttttcttgtagagattataaaaaagtgcatgtatatttaaacctagtgaacagtcagttcctatatcctgtgtctgtgaattgccttgaagtttttttctcactcgtcctggtagatcttgaagggtctgaacctgaaggtgcagagtgggcagacggtggccctggttggaaacagtggctgtgggaagagcacaacagtccagctgatgcagaggctctatgaccccacagaggggatggtgagatgacccatgcgagctagaccctgcggtgatcagcagtcacattgcacatctttctgatgttgccctttcaattacaaatgtatgaaagtcacacttactttttattccaggtcagtgttgatggacaggatattaggaccataaatgtaaggtttctacgggaaatcattggtgtggtgagtcag

SEQ ID NO: 43911 - DNA, 1057 bp, Homo sapiens
tagaaaaaagaatcctaacatttacatggaaccacgaaaaaaacagaatagccaaagctatcctcagcaaaaagaacaaaactggagaaatcacattacctgacttcaaattatactacagagctagtaaccaaaacaccatggtacaaagaaaagagacacatagaccaatggaacagaatagagaatgcagacataaatccacaaatctacagtgaactcatttttgacaaagtttctaagaatgtatattggggaaaagaccgtctcttcaaaaaatggtggtgggagaactggatatccatatgcataaaaatgaaactaaatccctttctctcaccatatacaaaaataaaatcaatatggattaaagacttaaatctatgacctgaaactatgaaactactaaaagaagacactggaaaaactctctaggacattagattgggcaaagatttcttgagtaatacccctacaagcacagggaaccaaaacaaaaatggacaaatggatcacatcaagttaaaaaccttctggactgcagaggaaacaatcagcaaagtgaagagacaacctgcaaaatgggagaaagtatttgcaagctatccatctgacatcagattaataaccagaatatatgaggaactcaaacaactcaataggaaaaatctccaattaacaaatgggcaaaagatctgaatagacatttctcaaaagaagctatacaaatggcaaacaggtatatgaaaatatgctcaacatcattgatcatcagagaaatgcaagtcaaaactataatgcgatatcatttcaccccagttaaaatggcttttagccaaagataggcaataacaaatgctggcgaggatgtggagaaaagaaaacccttgtacactgttgtacaacttgtacatttttgagaatgtaaattagtacaaccatgatggagaacagtatgggggttcctcaaaaaatggaaaattaaactaccatatgatccagttatccctctgctggggaaatactcaaaagaaaggaaaccagtatatcgaacctg

SEQ ID NO: 43912 - DNA, 1061 bp, Homo sapiens
catagtggccctgatgtgatgtacatccttagcttataaaaataacaggattaagagattaaagtaagacaggggtaagaaattatgaaagtattatttgggaactggtaaatgtccatgaaatcttcagaatttatgttcctttgctgcggctccacctggtccctccattcaggatccctgacttcctgcaacacatactatcatttatgatccatgaatgtttcatcatattattatatgaaaacaaccctggacagagattcaagagacttgagtccttgctttgccattctcacggtgaatacacttgggaacagtatctaacttttatttgaacttcattatttcatctgtaaattaggggcttataactgggatttcttttgggtccctatcaacattaaacttttctgattccccatgtctataatagaaagcaagaagatggaataaaatattagcataatgaataatacagaattttcacaatttatgttcgtaacaattacaaataatctttactttgcattaacggaatttcttaaatttctctggttcacagttttctgtttcttacagtcagcttcttgtagatgtagccaaatgacacagttaggtgatagtttagcattttaatgatttttaagttggctagtttatgtaaataacaaatgattagaacaaataaattaattgcttatgatgtattttcaggtcagaatttgagttataaaggtcatagagatcatctaatataattatcatcattctcaagatgaggaaaagttttcttagaaacattatttggcatttgtttctacttggataaaatatagcatgcatattaaaactattttcctttgctgtgctatgcccaaatggaataacataacttagtgctaaagatgttttatgactagtttactcaaatttttattatctgtacctcttatttgatacaggtaaatttaacagattgggaagactaatatcatttggctattgattacttatagaaagttattctcaaagtcttttggaacttttacttcttatat

SEQ ID NO: 43913 - DNA, 1049 bp, Homo sapiens
ttatccttttcctgtgtgaaaagataagacaattactttcttcttaattacaggtttttggctactgatgttacaaacaataaaatattggagcatagagttgaagaacagactcaaaccaggtaggtagataataaaagtctaaagaatcaataaaattactatttattttgataaaggacattattgatattattgacagaattggaatatgaactgtagagtacggttcaaaattaagtttcctgaatttgataattgtattgtgattatataagataatattctgatgtatttatggtgaagggacatgatgtatgcagcctacttttgaatggttcagaaaaaaaattatatgtaatttgacagagaatttgataagtcatggataagtaggaactctcatattgccagtagaagtatagattgatccaagctttctggaaagcatcatggcaatttgtatgacgttttttttgttgttgttgttttgattttgacatgtagtcttctctgtcacctaggctggagtgcagtaatgcgatcttggctcattgcaacttctgcctcctgggttaaagggattctcatgcctcagtcccccacggaactgggactacaggtttgcgccaccatgccctgctaattttttgtatttttagtagagactggatttcaccatgttggccaggctggtctcaaactcctgacctcaggtaatccacctgccttggcctcccaaagtgctaggattacaggtgtgagccaccacacctggccctgtatcaagttttaaaatagcttatcccatcaatcttactatctttcctacagtaattgtaggaaggttacaaaaatatatatatgtatgtataagaatgttatagcagaatattttatagtttggaaattggcaacaacctgatatctaacaatctgaaactgattaaataaatataattaactaccgtgcaagcaataaaaatgtaaatctgtttttattgacacaatgtctataatgtgtttttaagtgttaaagcagcctacta

SEQ ID NO: 43914 - DNA, 1048 bp, Homo sapiens
gtaaagtagccacaagagatctgggacaatagacaggattaaattatgtagatatgcaagggaatcaatagaaaagaaatgtaagcctgttatgaaattcaaacataaatagtccttctctgaaagtgcagagaatatccaattttgtctttctgacaacttctttagaaatcctattaatgttactttcagaaattctatgccagactgaccttatatacaaacacaattttaaaattctttttaaagtaacagggaaaagagagagaaactatggtatcacttaataaagcaccaatatcaaagtgaaaaataagttggcattttaaacccacatttgctttattcatcaacattttttaaaggaacaactctaatgataggttattcctaatcgaagctccgggtgtcttgttaaaaatacagcaaccacagcaaattgaaagccctcaccatgttgcactgtccgatgtattcctttccacagattgcatgtgccctggggatcatttccagcctgcagcgttcagaggaccatgccacttcccatctaaataaagagtggctggaggacagttcatgtggccagtccactccataaggactctcttctatcccatgccttcctgttcacacttactggagagacttaaatgttcctttaaatcagggtttactgcactgcaatgactatggataaatggaacttctcaggcagcagggtgccaatctgtagtcttatcaatgcataaaactggaagaggggaaaaaggcatacaatggaacataaaggccaaataactgctctcttctgcttagcaatgattttgtagtggattgggaaatataaatattagttgcatgatataaactgtgatacggcctcaaagtttctctccaaaatagatatttaaagagaaataatgctgtgcttgtatatttaatgctacctacctcggtggatgaaaagtcataaatatttagatgtaatgcctctagaaccccaaccatgagtatacatatagatacttcttgaaactctcccttg

SEQ ID NO: 43915 - DNA, 1031 bp, Homo sapiens
gggttgtatttctcatcatgttagtgaccccttctgggacaccagtgaacaggaaagaaacaatcccttgactgtacccctaacaaagcttctgaaagagaaactagctgggagaaaaagaagagtcgtgcatcaaaataacataaatcttttattgaaagtcactttactaatgttacaatgggagtaacatagaaaaccatggtatcttattagcttccgaagtgaatactaataaaactgtgccagaaatttgaaccttaagttacagtgacctttaaaaacatcaagattttgtttacctacaatgtaagaacaattttataacttgaacagccataaaacaaatcacacttgctcaggaaagcagttgccatatacatttccattggtgtttgccataaccccagtaattattaaaatagcttaacgaacctgaagtgcagagtagcagagaaatgttaaaataatgcgaatctaagtatatacacatgattacctgattaccaaaagtgaaaccatgctgctattaacacctcctcatggggtggcttccactatctatagatgcacatcacctgtcaaaggtgataaccgtggaaaacactagtgccgacctactgctggctaacatgtaagctactatgtttaggtaaaacaccccgtttctgaaagaagttgtcttttgggggtgctagtttggaggggcaagtcttccagcaagttaaaaaaggagtacatgcttatctatcctgaataagcctttttttaaagcagttttgcagttagtgtaaaaaaaaaagttttccatacaaaacaaaggtgttgagtcatttttgccctttaaaaagactggttgtagaatcagagtttgattttgtgctggattagaaaagaaaagtggggtttctagtcaggcagtgatacacatatataatttagcaggaacttttgtattattactaagtattcatatcagcattttctgtattgtgttacttgttcaacttagcaccgctatatttaaagat

SEQ ID NO: 43916 - DNA, 1049 bp, Homo sapiens
tttggaaatccccacgtaatacaacagtataaactccagttgtttgtgtttgtggtaagtgtctttgaccacggccatttctagtcttggatattatttggaatttaaataattattcaaataattatttaaattatttatccattgaagttatatctgctttctctaagaagttttgatgtgagaaaccctgtggattttatattagactgcttccctaaaaaaaggaaacttttccatctatcatttactcatatcttagaaagttgtaggggttgttttacccgtgttcaaattagaaaaccaaatgtaagctgccagaaataggctgtgccgtataagtgctttgaggtctgtcatataatgctgatttttctttcagttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaag

SEQ ID NO: 43917 - DNA, 1055 bp, Homo sapiens
tagctgtggattaaaatgttcaaactagaattcacagctgtgaatttatagtggcctttttttaaaaactatttgacatggcatgtattagatggctgtctttgaactctttgcatttgttttcattatcctttgttttatgtgactttagtatcctattactctttcctaattagaggaattaatacaaacgaagaacctttcaagttcctgttatttaatctagtcctaaacaaaataagcactttttggattaggggatgttattctttactgtgtaggcagtacatttaaattgttaattgttacgcaattgagctggtaaacaaggtaggcctgcctattagcagggtttatcaaagtgcagtgagatcacagcatggcctgttattctacatcctttcagtagatgaggtgtggcagattttagaatctgactaacaaaatgggttgtatattgttagagagcagtccttttaaaatttcattgagaaagccacatttagtgatggccttagatcaatgcattaaagagaaagcatttcctgaatcatggggcctatgtgattgaatccatttgcctactctctggtggccgtactgaaccacagaaccatcctgcctatgaggtgtcagtgttttgtaatgcagatattatatggccattagtcttttaaacccaacttccaaaccaaaaagcacaggtccgaattggatgagcaggtgggatactccagctcagagcctatgggcccttcttaaccagtttaaaaggaagcagtcatacctagaggtggagttggtgagagaagttgtgttccagtcagtaagattgtaattcagcttctcttttttccctgaatttagttgttcgtctgtgataaggttgagagaaacagctggaggtagggctttccttctaggtccattatattgtatgtttctgtgagaagaaaagatgtttgaggcattctagtagaatgaacagaagagaagaaaaagagtaaaggtaaattacagcagagattctttggaaattattaaaattaacatta

SEQ ID NO: 43918 - DNA, 1034 bp, Homo sapiens
ccttaggattctccctcactagaagagcagggcaggaaagaagagagcaggccaatagtatctttagaacaactgtcagggtggccctgggtctacatttccaaacctcattccctactatcctagctccccaagacatttatgcattcttgaagagcaaagggatcagcagacgcaaaaactcaggaaacggtatcctaaaaccccatctgcagatttaaaggccgtataagtgcaataaagctcctggggaagtctcctcagtaaataagatacctatttaattatgcttaatgcttgaataaacaactgcatttgtgcagattttttttctgacccatgtgtaaacatcctgaaacaatttcctttaatgctcatttgagaagtggtgccccagaaacttgagaagaattggccacaccttgaagtcttgagcctagcactgacttcctccctgcactccttttggaagtgatgagcaatgaatcgttaggttgccatggtatttaggaactaaaagcgagctcacacagcctatttcagatgtaaacaagaaaagagaggtccttcaaggttaaatcattgttataaagtaacaggagcttgaagcagcccagtcaagatttaagtacaagcaataatgataacagttaacatttactgaatatttacttttccaggggtgtgttatattattttaccttcacacaaactatagagtagataccaatgcagatatatgaagtaaacacctgtggtggctcatattgtgtgacaacttggttaagttatggtgcccagttatttggttaaacaccagtctagaggttgttatgaaagtattctcatttttagacagggtcttgctctgtcacccaggctggagtgcagtgatgcaatcacagctcactgaggccttgacctccagggtacaacctgttctcccacctcggactcccaagtagctgggactacaggtgtgcatcaccacacacaactaacaaagtatttttttaaagatgaaattaactttt

SEQ ID NO: 43919 - DNA, 1030 bp, Homo sapiens
acttaaaaatttttcttatgatgttttgggatatacacaagttgataactattttttgagaagaatttataattcaattatgtcactgtagaagagtcagctttgtaaagattaccatcttggtaagaatgatgcactcccatcctacactgcataactccaagcctgaaatctaataattgttcggcctaacgatatctggtttagcaaaggatcactaacccttggtatgaatttaactcaatgttttatatcttcaggggctacttagattttaagctttgtccctaaacactgtaccctgttaaagaaatgttggtcattgaagaatagctgcaattctgtagttatttattgaacaggtctgatgtaaaagtccctaaataaatattaatctggctatgtgtaagtgtgaacacactgtactgcaaatcaccttttaaaaaaactgatgaatgaaaatgtatgcctcatttgagtatgaaataagattttatgtttatgtagagctttacaatgaaaaaacgccacattcacatactatttattttgatcctcaaaaactgatgaagtaaacagagcagtaatgctcaccacagttaaactgatgaggaaattgatattaaaatgcaggatgacccaccacaaattcagtgcttagtgaaggaactggtattttttaaaagcttctgaacattagaaaaagacaaagaaggctgggtgcagtggctcatgcctgtaatcccagcactttggaaagccgaggcaggcagatcggtcaggagttcgacaccaggctgaccaacatggtgaaaccctgtctctactaaaaatacaaaaactagcagctgggggtggtggagtgcacctgtaatcccagttactcaggaggctgaggcaggagaatcacttgaaccccagaggaggaggttgcagtgagcctagattgtgccactgcacttcagcctgggcgacagagcgagactccttctaaagaaaaaaaaaaaaaaggaaaaaaaagaaaagaaaa

SEQ ID NO: 43920 - DNA, 1073 bp, Homo sapiens
ggtaaagcctgagcatgcgtatttttaaagcaccaaggcaattctgataggcagccaggttgagaaccattgtcccagcaggcaagccatctggcctcacttggtgtccttggcaaataaaaggtgagccctccattgcaggacttgtaaactaataagcagttgaaaatagtattgggtttggaaccaaataacactcggaacaagctgctcaaaaaaactccaaggttgaggctagtcatttttgcgtatatgtgaaaaaaatgtgtttttgttttctggaaaatttcttgctacttcttacaaaagcaatacatgtttgctattgaaattttgaaaataaactgtaaaagagcacaagggagatttaaaaattacctgtaattccatcagccagatattaccacaacattgtttatatcctttcagactttttatataaatggaaatatattttatattcgattttgtaatatgctttttaaaattagcagtgtaccacgaggactttcccttgttaatattcttcaataaaatgatgttcaagggctacagaacatttcattccataattagctttattgtttttctattttagcttttcaatttatgaccaaaataatcgttcaatgatcctccttgaccaaaactccacatgcaccttttgaatacagatcctctttgacttacgatgggtttacatcccaataaacccattgcagattgaaaatattgtaagtcaaaaatgcacttaatagacctaacctactgaacatcctagcttagccttgcctaccttaaacatgctcagaacacttacattaacagttgggcaaaatcatctaatacaaagcctattttataaaaaagtgttggatatctcaagaactttattgaatattgtgctgaaagtgaaaaacagaatgattatatgggtactctctaggtacagtttctactgaatgtatattgctttcacatcatgataaagttgaaacaagttgaaccacaaggtggggaccatctgtacttcctcaggagtgctagagatggggtcattggattaaaaaata

SEQ ID NO: 43921 - DNA, 1020 bp, Homo sapiens
tgatgtgtttaaatttcaaggatcctcagatctctaagggtggactaactggctggcatcattgcttacaaaagtatcttgaccttcatggagcttattttgagaaataaaatttatatttttatctttatcttttaattccatttttccatgaactttttgaagtccctttatatagtttgttgtctaagaagccttatgtcttagttatcaatcctaaggataggattaatgttcttttgttgaagctaaggactattactgtcaggagaacatggctaggtagaaggccatcctacctcctcccttaaataaggactccttagcaaggctgagcttttctgcagaaaagagttctggatcttattcagggtatcaataaatttacagtcaaggtactactgtttcaatcatgtaacatcataaaaatagctttggtttaaaatgttctaaggcagttataaacatggtcaccttggccaaaccactgtaaactcttagttaagtatacatataaaatgaaaggttcacaatgagcaatgctaattctgtatttatcctcccaaatacattgtatggctagataactaaatgtatagatgggttatatggtatagttatttgtgaaacagaagaaaaaatctccaaagaagaataattatattttagaataatgaatatgtctgcaatcctattttctggtgataattacctacagaagtcagtaatctgcaaacttattcctaatttaagatagtaaaatacgttgtttgcatttttaaagcagttttacctggtctttgtagctggagttacaatctggttgggccaattctgtacaaatagagtaactcagttaaaacaaaataaaactgtttaaaaaattaaaatctaaggcctgtggtacaacacaaattttaggaaaatctcaaatgacaatgaattttagaaaaatatcacacccacctacccacacacacaccagattatcaagttctatttactctaaagctgcagaaa

SEQ ID NO: 43922 - DNA, 1056 bp, Homo sapiens
tgatttgcagataaacaacaaataattttttggcataagtgcgttcaaaatattgcaaaggtggctgggtgcggtggctcacgcctgtaatcccagcactttgggaggccgaggagggcggatcacgaggtcaggagatggagaccatcctggctaacacggtgaaaccccgtcactactaaaaataaaaaaaaaattagccgggcgtggtggcgggccctgtagtcccagctactctactcgggaggctgaggcaggagaatggcgtgaatccaggaggcggagattgcagtgagccgagatcatgccactgccctccagcctgggggacagagtgaaacgccgtctcaaaaaaataaaaaaataaagaataaaaataaaaaatattgcaaaggacgtacttatactaaaatattcatttttatctgaaattcaaattaaactgggtgtcctgtgtttttatttgctaaatctggcaactctagtaccaagccaatatgttattcacatggaccaaagtgaaaatggactcctacctcattttctatacataaataaattttaaatgaatcaaggtcttaaatggaaaaggcaaaaacttaaaatacaaggaaaaaattgcatgacctcagaatagggaataatttcctaaataagactcagaatgtaacccattttttggagaagatatataaatttgaccaccttaaaatgacatacttcttttttctcaaaaaatactccaaaaaaaaagacagctataaactgagagatgtttttgtaagacataatcaaaaagcattactattcagaatatatgaaaaatttctacaaatcagaaagatttcaatgataaaagacaacaaaaaagaaaaatgcaaaagacagaaagaggcaattttttaagagaaagcacacatggccaataattgtgaagatatgctaaacatcactaataatcaggaaaatgccaattagagacatcattttacagcatcagatggcaaacattaaaaaataattaatctgattgtgatattattacacaatgtatac

SEQ ID NO: 43923 - DNA, 1039 bp, Homo sapiens
gaagattaatcaggtaatggccacttatagaacatctcttataagtcactgaactttgacataaacccttctttgaaggaggctataactgaaaatgactctgattgataaatgtcgttgagcaagttggcttgagtagggaggaattattcctctttttagcactgagacctcctcaaaaatatttttcctggtcactatatttgtaaggtggctgtatcctacttcctcagtgatctttattccatttctccactttactgtcttcatttatcattctgtgaaactgtgtacatgtttgtttcctggtcactatctgtctttcttatcagaataaaactccatgaaattagggatgaccttcgttttcttcatcacaatatacccaatgcctagagtagtgcctagtacatggtgggaagttcaaaatgcatccagtggtatttcagacataatatttaattctataacttgaattaagaatcaatttattaagtcattatggtaagcagaaagatagaactcagggaggagagagaagatggaagagagacaatttacaatttgcatatctttcatgtttcttgactatggattaagaaagtatcaagactggactgctgagtgtagacaatctctgatcagtctggatgtctttgagaaactcgcatcaaaggacaagacaacatggaagtgatgtctttatttcaagtgagaccactgagcatgaaatatatctgtcagctcattcttatcccatctcttcctctctcctgcccccaacttccctgaacaaaaatactgaggattactgttctattcttagaaactagaacactaagttttctgccaaaataattaatctattcactcacttagtatatattatttgattacatactaagtaatggggcctcccaaagagattaagacatagttttaactttgcatgaactttatcattaatgactaacagatctctagctggtattgtgattggtgagattccaaggttattgttctcaaatgagaataatga

SEQ ID NO: 43924 - DNA, 1007 bp, Homo sapiens
tgaacatgggattttttgttttgttttgttttttggtgtcctctttgatttctttttttttcttttgtttttctttttttaactcctgatttgacacccaggctggattgcagtggcacaatcactgctgactgcagctttgacctcctgggtttaggcagtccttctgcccaagcctcccaagtagcttgtatgccaccatgctcagctaattaagaattgtttttgtagagacagggtcttgctatgttgcccaggatagtcttgaactcctaggctcaagtgatcctccttcctctgcctctaaaagtgctgagattacaggcatgagccactgtgtctggtcttaaatttctttcatcattgttttgtagttttccttgcagagattgctcacctccttggttaaatttattactaggtattttttttgtagctattgtaaatggaattgccttgtcgattttcttctcagctagatcattattggtgtatagaaatgctactgatttttgtacattaatcttgtatactgcaacttaatgaattcatttaccaaatctgagctttttggtggagtcttaaggtttttctaggtatcagatcgtatcatcagcacagagggataatttgatttcctattttctaatttggatgccttttattcatttatcttgcctgattgctctggctatggcttccaatactatcataaataagaataatgaaagtggacatccttgtctcctccctccttccctcccttccttccttccttctttccttccttcttcctccttcccatctctttcttccttccttctttccttccttcttcctccttccagcctccctcttttttgtctgcctttctttctttctttctttctttctttctttctttctttctttctttctttctttctttctttctttctttctctttctttctttctttctttctttctttccttccttccttccttccttccttcctctctctctct

SEQ ID NO: 43925 - DNA, 1045 bp, Homo sapiens
aatgactaatttgttgctctatggtacctaataacatgaaataatgtgtcaacttaaatataatgttgagtgaaaaaagccaaatgcaaaaaaggacacagtgcatgagtccatttttgtgaatattctattctttgttctgggcactggtcacgtggatgtgctgagtctgtgaaaattcatcaagttgtacactcatgatttgtgcacttttaatgtctgttaagcttaaataaaaggttaaaaaaggaatactctggttgcagaagagagaataaattgcagaggagagtggaagcagggggaccagttaggaagctattgaaattttccaggtggaagatggtggtggtggaaatggggagaagtgaatggattctagatctaatttgaattatagtacagtatttattattagatggaaacatatgaaatacctggtattcaacctcttttggccttcaaaaatgacaatttcatatggctcaacctactagaaatggattgtaaggacatccttgactcttgttattgtttctctgttaagtattataacttttggttttatatatcttttctttgtgatattaagaataaaagcttatggttttacttgagaacagatagtgagtgttagttattcctgtctattcacataactatattactttctctatgatgagttatgttgtagtttttttctattttacctatactaggattaatttatcaaaatgagagtagtttttaatgtaactgactaattaacgtactagtactatgtcttattatacttggttgtgaagattgtagtaacagtgactgtcaaaaatttgtattttagctgggtgtggtggtacgtgcctgcagtcccagttactcagcagcctgaggcaggggtattgattggttgaggccaggagttagaggccacagtgtgctatgattatgcttatgaatagctgctgcactccagcctgggcaacatagcaagaccccaactcttaaataaacctaaaaaacaaaaaacttttatcattttaaa

SEQ ID NO: 43926 - DNA, 1038 bp, Homo sapiens
ttgttctttctctacggtatgtatttctatcttatagatagttacttatcttagatttctaaatctcaaaggtcctgagggccacttacagtcatactcatctttctatgctctaccgcaccttgtccagtgacttgcaggaagtagttgttcaacaaatgtttactaaaaggaataaaagatgacatagtaggatttgaagaattaaaatgtattttcctgtgttagctatatcagtctttccagtacagatttctgcaatgatggaaatgctctatatctgggctgtgcaatacaacagctactgttggctagtgtgactggagaactaagtttctaatttatttaaatttaaatttaagtagctgcatgtggctggtggttaacgtactagacatagcagctctaaattgtaatgtatttgaactttgtcagatcctcacatcctgattatatttgggtccttccatatgctgattgttctcactatgttttttgatgaggagattgtacagccagccctaagcaaggcgataaaggagtgagctcagattttctctcacacctgcagtggaaggccctttctgctgcttgacctctggggaagggctggtgcttgcttctgaatgttttctggaaagtaggagtgacttgtctcttggagttgcaaagggttgacaggggctctagaaggtgacacagtgggggatttctcagtttctcaaggctaagtaatatattatctaggcctgtaggaaagaaaagtccgtcatgtcctcagaaaagcaaatttttccttagaagaaagaggagagcatgaagctaacatatggtaaatagatttcctcatgcataagtccgagtggcgctccactggggtaagaatctttaggctctgtctctctccttaacataggctgtgtacatcaccagcaaccattacattatgtattttttctaattgtgaaacttctaaattcctcctttgaagttgacagtttgggattaataataataataataaaaacctctctcctc

SEQ ID NO: 43927 - DNA, 1099 bp, Homo sapiens
tttttggccatttattacagtagcaatcaaaatgaatacagctttttgttcttccgaagtattctgccccttcaagctgttctttataggatagccagggtgaccttttaaaaaacaaattctaccaaaagctcaggcaacaaaaacagaaataaataaatgggactacatgaccaccttgtaaagatatctgcactcccatatcactgaagcattattcaaaatagccaagatatggaacaacctaaatgtccatttacagaaaaatggataaagaaaatgtggtatatatatatatgtgtatatattcaatgggatttttttttttttttgaggcagagtcttgctctgtcacccaggctggagtgcaacggtgtgatctcggctcactgcaacctccacctcctgggttcaagcgagtttcctgcctcagcctcctgagtagctgggattacaggtgcgtgctactacacccagctaatttttgtatttttagtagagatgaggtttcaccatattggtcaggctggtcttgaactcttgaccttgtgatctgcccacttcgggctcccaaagtgctgggaatacaggagtgagccagcacgcctggcctattcgatggaatattattcagccttaaaaagaatgaaatcctgctatttgccacaacatggatggacctggaggacattatactaagtgaaataagctagatgcagagagagaaatattgcatgatctcacttttatatgtggaatacacacacacacacacacacacacacacacacacacacacacttatataggctcaaatacacagagttagaaaatgaaacagtgattaccatgagtggaggggaggaggcggggaaatggggagatgtaggttaaaggctataaaatagcagttacgtaggatgaacaagtttagagatctaaggtacaatatgagtactaaagttaataaaattgtactgtattgatggcagcagtggcccatctggagtggctgctgccatgatgctggttgcagtgtgggaggctctgctggggctgcatgttccatggagccagcaagggctggaagcaggcagga

SEQ ID NO: 43928 - DNA, 1025 bp, Homo sapiens
attgtggcactattcacagtagcaaagacttggagccaacccaaatgtccatcaatgatagactggataaagaaaatgtggcacatatacaccatggaatactatgcagccataaaaaggatgagttcatgtcctttgtagggacatggatgaagctggaaaccatcattctcagcaaactatcgcaaggacaaaaaaccaaacaccgcatgttctcactcatagatgggaattgaacaatgagaacacatggacacaggaaggggaacatcacacaccagggcctgtggtggggtggggggagtggggagggatagcattaggagatatacctaatgctaaatgatgagttaatgggtgcagtacaccaacatggcacatgtatatctatgtaacaaacctgcatgttgtgcacatgtaccctagaatttaaatataattaaaataaaagacttgccttgtcctcagcattgtagcccacaaagacagtgcttgatgtgtgctgtatctttgagcaaaaatgcttctccatctaaaccatgtcgtttgataatattctttcatagcactctgtatttcctttcatagtaggaacacaactcctgggtggggttatttatatctcccactagactataaattctatgaggtcaagaaccatataaattttgctaaccattgaattaccagcatttcacagagtatctagcatctagtagatgctcaaaaaatgtttgctgaatggatgattgaataataatttttctcttagtactaaagcataacttagggaaaagaagtacatgctgctatttgggaagagggtctgcttaccttaccagtcagtttgcccatccagatgactctccaatccaatgtgggtcagattgtattacctgttatttaaagtacttactataactctgtgtcaagaatccactttcaagatatggtacatgtagaaaaagaacactgcctggtgtgtaatatgtatttgacaccctaaaggaagggagttatttata

SEQ ID NO: 43929 - DNA, 1002 bp, Homo sapiens
ccccagtagcagcctggagcctggtagctctgctgggcagctagatccagaagagaagtaacaacctctacagtttggctctcatgaagcctcatccctgagcacccacatccaggtaataccctatgggacaaaagaatctgaacaatagcccttgaacactggatctctgatgtagtctacccaaatgagaaggaaccagaaaaacaattttggtaatatggcaaaacaaggttctttaacacccccaaaagatcacactagctcattagcaatggatccaaatcaagaagaaatctctgaattgccagaaaaagaattcagaaggtcaattattaagctactcaaggaggcctcggagaaaagtaaataccaactcaaagaaattttaaaaatgttataggacatggatggaaaaatttccagagaaatagatagcataaataaaaagcaatcacaacttctggaaatgaaggacacacttacaaaaatgcaaaatacacagaaaatcctcagcaacagaatagaacaagtagaagaaataacttcagagctcaaaaacacggcctttgaattaacccaatccatcaaagacgaagaaaaaagttaaaaaataaacaaagcctccaggaagtttgggattatgttaaataacaaaaatctaagaataattggtgatcctggggaagaagagaaatctaaaagtttggaaaacatatttgagggaataactgaggaaaacttcccctgccttgctaaagatctagacattcaaatacaagaagctgaaagaacacctgggaaattcatcacaaaaagataatcacctaggcacataatcatcaggttatctgaagtcaagactaaggaaagaatctgaagagcgtgaggcaaaagcatcagtaacctataaaggaaaacttaccagattaacagcagatttctcagcagaaaacctacaagctagaagggattggggtcctatctttagcctcctaaaca

SEQ ID NO: 43930 - DNA, 1124 bp, Homo sapiens
gttcagctcagctgttgatatttgtgtccagtgctcagttagctcttcatgtgtttgaattctttttttcctagaggagagaacctggccagtctccaatttctgagactctaatttaggttatatatttctctgcaatgtgaatctatttcaaacttgatgtaagattgctcactagtgcattgccaaatacccgataggcacctcagtaaatatttattaatgttaatgatgagaataacctttttaaatatttgtgtttgaaatatgtactctaccaatactgcaatagggaaagctttcaggataattacattttgtatttatatccagtgatttattcctaagatctcaaattttgttagagatatgattatagtatatatattttttcagacttaaggttattggcaattgttagtcctgtttaatagatgaggagtgtaaaaagagacggggagtgatttgcaaaaagtctcactgtggattgaagtaagatatgaaagtttagatctatggttccaaatttcactaaaacgagtctagctctgggaactaaaccaatggtcaagaagttgcaatgggacattgaataactcacgtatgtggaactatcctcctgattaaaattaattttgaaaaatgaatttttctttgactctatctgtgaggtgtggcagctagagactgttttttccctattaaatataacccatgattgtttagtcctgatgattcaaatggtaatattatctatttatattactactattatttttttcaaatcagcctaataaatatagaaattgatcttttttgtttgtttgttttagagaggggatctcgctgtgttgcccaggctaatgtcaaacccctggcctcaagcgaacctcccacctcagcctcccaaaatgctgggattataggcatgagccaccaaatccagtcaatattttacttttgaatatacagattcataatttttaaaagcacagcagtggaagttacaatgattagtacttttcttaatcaaagtggaaaattgctttactcattatcttagaaataaattcagtagatattttagaaatgaagtgtccctacttacttttataactttttgc

SEQ ID NO: 43931 - DNA, 1052 bp, Homo sapiens
atgaacgcattataccatccatcaggataaattaacatgttgtgggcctttaaaaactataaagaaaataattttaatggttccaataacagctccagatgaatgctggaaaacagatattccaaactgtcaaatagcgtatgtattgcttggctgttttataaccgcaagtaaaagctgcttttgtatgaggtttccttgactgccaatggaagaactgtaacacatttattgtgaacaaaattggaatggaaatgagacgtgttacaacagaatggcacctaattccttcttgccagttgccctgaattaacataataagtcattaggacagtaaaaagttcttggttaaaagaaagaataatttaattaaatagatttacaaaaatgacaagttcatacatgtatcacttatgatatggaaactttgtttgaaaatatggttgtcttatgtgagagaatagaattataccctatataaatgtatatgttcaatggaaaaaaaatcataaacttcagaggagaatttatcggcggtatggaaaacaactgaaaagtgtttgcaacaaaggccagttctgactgctgtttactgcaggtaaggggcttcaggatgctgccctatgtttgaaggggtgactcatgtcattatttattgcggttaattgctaatgtttgtgaagagcacagtatgttgcatagcaggaccaagtaatccatggtgaccttttgtgctatcaaagctttatcaattagaagctcttgattataaattcataggatgcccagtgagtgccatcaaagaaagattatacttggcttcttatgcaatctgatttttttttttgttggctcctcttccttcaaaactgaaccctcaccagggaactatttctaaatctgcaaagtgaagcatattcaaaatgttttcagacttcaaggagtattgtggtttttataagcaattgcaggaattttataaaaatagtagttatattttcctgataaatacctttcttcttgagactcctacactggctatcttcctggtc

SEQ ID NO: 43932 - DNA, 1076 bp, Homo sapiens
tttttggccatgcagaatattttaatgtgcatatgattggacttatttatcttttctttcctggtttagaaagactttcccattctaatgttataaaataatttacccgtattttcttctagtagttttatgatgaaaaaattcaaatgtgatatatctcaacattaaataatctttttctgtctactgagaaatatttgtcttatttcttttcttttttttcatgggacagagtcttgctctgtcacccaggctggagtgcagtggcaccatctcagctccctgcaacctccacctcccgggttcaagtgattctcctgccttagcctcctgagtagctgggattacaggcgcccaccactatgcctggctaatttttgtatttttagtagagacagggtttccccatgttggccaggctggtcttgaactcctgacctcgtgatccacccgcctcggcctcccaaagtgctgggattacaggtgtgagccaccacgcctggcctatttgttttatttctggactctatctgtggtaccacattgtttccatttattcaagtgtatgtgtgtgtgtgagtgtgacctgcagtagtaacattttaaagcttttctttacatacctctgacatatttcttgctaaatttattactaggtatttttatcttactattgctattgtaaataaggtattttatcccactacattttttaactggctgtttgtatacaggaaggctgttcattttatgttaaagttttttacccattcctttttctaatctaattattatgtcagctgatacttctataacaatagcattaacaatgtaattatagtattaatagacattcttttcttaactttaacagaaatgtgtataaatgaaattgagacccccaaaaaaaaaccatacaaaggatcaagaaaacaaacatttggttctttgttttggataagcaaaattgatagaccacagagttatttcacttagggtaatggcttccagctccagtatggtagttctgtttttagttctttgagaaatctccatactgtcttcataggagttga

SEQ ID NO: 43933 - DNA, 1058 bp, Homo sapiens
aacattgccatgctttatgtctattcaaataattgtacttgttcaaacagctttacttggaataaccaaaaactggaagtaacccaatggacattggaacaacatggaattgaaaagtacattgtgatatattcaggcagtggaatattactcaccaatatgaaataatgaaatattgatacatgcaactacatgagcaaatctcaaaatatgctgaatgaaagaagcgaaagagtaaaatctttattattcagtttacataaaattctagacagtgctcactaatttgtggtgacagaaagcagatcattggttaccgagatggggtggatggatgaagaaggccatgaagaaaggactgcaaaagactacagggaaacttttgggagtgatctatatattcatcatcttgattgtggtgattgttttgtgagtcaaaatgtatcaaattatatgttttaaatatgtgcagtttagtacacttcagttatacctcagcaaagctgaaaaatccattcaactctgatttgaaatgccatcttcgtctgatgctgtttacatgtctctgagtgtgtttctaggctctcttcaagtctactaaacaaatatatttgactttatgtttctatattgacataaatagttagacagtatcttttcagtaaaagtgttgggagaactgggaagccacctgaaaaaaaatattgatagattcgtattcatacaccaggataaattccaagtggaacagtcatgagctccaaaccactcaagcccctgccttggcattacacttaatgacctatacttaagtcaggccatgacatgaactaaacactggtactaatatcagaatctttttcatagggggcttcctggaacttgacttggacctatgggctagaatttaccgaaagcagctgacccgtgctttgcttttactattccaggaatgcagataaagtctaacttccagctagacatggtggctcgtgtctgtattcctagctactcgggagcctgagatgagaggattccttgagcccaggagtttgagt

SEQ ID NO: 43934 - DNA, 1028 bp, Homo sapiens
ggggcatgttaagtttgtgtggaagaaacttccatggaggatgagttatacacaagacatgaaatttacttgtgacagatttagaagaaacgtttatagatttgttactttttgttaggaattttggcttacattttcacctatttttagtttgttattaatagaatttctgttgaacattctgtggcttattcagcctgtttaccatgatgctaatagtcctaagaaagtgcactgtctagtagtcttcacacttttttgattgtgtacattgtcaatagaaatatgcctacaatatatgtacatttgtttattgattatatatgtcttacagtacaatcatattgtttatattataaaacatatgtagaaagaatttttcaaaggctaagacaaatacaaattgtagttttaactattttcttcctccatcccattgtatcatcttggacctctctagaaagtactgatctgatttccagctgacgcattctgcccctttattccagtagaggtcagtcgagcatctggaagagaaaacaggctgttgaactatgcaaggtagagccgtcattcttcagttagaaggataattatattttaaagtttctaaattcatgcatttttggaagagtaattacagagtagtatgtggtattacggagaagtgaagaatagtgagctcagtagagtatggatcaatctgaaatgtgcttttgttgtttgatgtttatgttgtgagtaccttgcatttggctttgaacattacttgattctgtagttttgggatcttttcccaattctgtgagaatctgtagattatgtgagccacaggaatgttccctgcctgtaggcataatcaagttctagttaaaattggagtaattgaaaggacagacacaaagaggctttctttgaaattgatcttgaaagcagtatctttagcccaaagaggttagtagtgggttggaattatctatctctattttctgttttatgcttaattaggagaaggagaaaaaagaaat

SEQ ID NO: 43935 - DNA, 1893 bp, Homo sapiens
tattgaaaatctcctggaatttttaataattcatgttgttttatgtgaaaagaatgtcatctttttattatattatctgtacatttgctgttcatctaaaatgtagataatatcaccccaggctaaaaaggatgagaaagaatttaaactgattcttataactttttcttttttttagggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaatacagtctgtattcatgaattgta

SEQ ID NO: 43936 - DNA, 1032 bp, Homo sapiens
gctggtctcgaattccaggcttgaagcaatctgcccaccttggcctcccacagtgctgggattacaggcgtgagccatgccacctggccaaagaatcagattgttaacagatgggaagagcattagttctgtagcccaaattctgccccaaagaggaatcgtttctaaactagtaattatctggtttccacttgaactttactagaaatgggttgtgggttgttcagttaccttttatgatggctcattctatgtttggacagctgtcatttttagagccttatgttaaagctgaaatctgtttctttttaacatctcatttatagttggtcctaaccatagtctctgaacttatattgtatgaggtatttgagtacagatataatgtctcctccatctttttttcaatctttgtgttagtttcctagggcttctgtaactaattacaatatgggtggcttaaaacaatagaaatatattctatcacagttttggaggctggaagtgtgaaatcaaggtattggcaggaccgtgctcctccttaaggttctacaggagaatccttccttgcatcttcctagcttctggtggctcttggcaacccttggcttgtaactacattgttccaattactacccctgtcttcaacaggctttcttcttgttcatgtctctgtatcttaacatggcattcttataaggacaccagtcattggatctaagtcctaccctaagtcagggtcatctcatcttaaataattgtgtatataaagatcctatttcccaattaagatcacattctaaggttctggatggacttgaatttatggggggatatatgatcttacgttaatcttgttaaatatcacattacatgtctctaatttctttactcattcttttacctcgtaattgtgctgtttatttatgttggtgcatatagttcattcattttcataatattacattttgtgaatcatcagaatttatctactcttatgttgattcaattaggatacttcttgcttgttgc

SEQ ID NO: 43937 - DNA, 1050 bp, Homo sapiens
tgtacttccaacccaacgctggctcactggaaatcatcttgagttaaaataatttttagtttgcctattatctagccagtttttaaatatatgtacagatggttcttgatttatgtgattcaacttataattttttgactttatgatggatttatcaggatgtaaacctatcataagtcaaggagcatctgagtatcccatgtatattcatgctttattacacaatgatctgattatttgtcagcacatttttaaattctctaatgaaatgtgtggcttttgtttatagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctggtaagatgattatattttagattggaaatgtttgttctgataacatatttgtctctgtcaaaatattccgaattgtgtttacaaattatctctccctttcctcatagggacatttttgcaaacttttttaggagaagaatctttataagttggagaaaaatatttcctttgtaccaaatggaattgttccataaatccttatataatgcttcactacttcctaacctgtctggttttattaggtctaatttttatagaacatccttgttttcccttacaatggtatttaaagctctttgtggattctcttttaaagaaccattggagtcagcacaccattcagggaataacagattactagcatttcacaaaaaagcaaaggcagtcttttaaaattaaagctcttctcgatcgttagtcaacatttttgctctctgaatatccgtatgagaaaatggtctttaaatttgggcaggttgtgtgtaggcttgcaaatttcatttccagtaagatcctaaaataatttagctatacccttgtttctccagtaatttctctgtccattggttctctgtactgattaaactatatt

SEQ ID NO: 43938 - DNA, 1082 bp, Homo sapiens
ctcctgatccatcagccttcattcttcactttcctctttccgctttgggtccatggcatgtcgtttctgttacactcttggcaatactgtactttaaatttcctcgaccccgcatcttttcattgtgttcagctggcagaagtcacccttggaggcagccagttattgtctccttctgcaccagattagtttcttcctgattttatgattgcctaccttaatgatatttgaacactgctccacagtcctattatgttcttgtgattgggcctacttttccactcattacagtgactaattcaaaccttcacttttctaaacttctgaatctttctacctctccatcaaagcagatgattttttctcctgtttaggagacaatgattaaaaacgttgatttaggagacaattattaaaacattcaaagaaaacttcctcattttctcaatttcaaatatgcaaacctacttgtatttatatagtaatcctattctctttcttcctatcacagtaataattatcaaacacttactttatgccagtacttagtgctttacaaagatcatctcactgaagctccacaaaaaccctttcaggtatatttgttttatagatgacaaaactgagaagcagagaggatatataatttcttcttggactcactgctagacagtggccaagccaggatttacacatggtctgatttctgagcctatacttttattaatgataacaataatggaaaacaagtcattaagatgctaagtaagccaaggtactcttctctgccctgtatataaaatttggcagcagctctgtgaagaactgctattattattattaccattttataggtgagagaaacgaaacacagagagactaagttctctgactataggaccaaagtcatacagcaagtaggtggaggagctgggatttgaacacggacagtctggctcactgcgttctaccactttgattttattacaactatattttgcctcttatcggaggctgaactctccatccctcttttgtctcaggaactttttacttttatttgttttctcagtgtattgttg

SEQ ID NO: 43939 - DNA, 1006 bp, Homo sapiens
aagggctggcgtgggcggctccgtggccccgaccggctcagtggatggcaagggcgggggcgactgcggccatgcttggcgtggctttggtggcaggcgcgctgggggctggagtagtggctgcggcggcggcactgctgctggtggcgctggctgtagcacccgccattgccttgtgttggggggcggtgctggcctccccggctgtgtatctgatcctagacggggtcgtggttgcggcatttgtggttgtagcggtctgtactgaccgcagcagtggtgcccctagtggcggtggctggattggcggctgtgggtttgaacgacccggtggtcgttggggcccttggtgggggtcctgacggagatgctgttggcagctggcccgtcatcctggaggctgccctgtgtggttcagtgttctgtgggctgtagcagtgcccctaatggtggtttatacccatattaaggaggatgtgtagagtgtggtaatggtagtgactggagtgtggtaagggccttcctctgatgctaataatgtaacagtttctcggccgggagcagtggctcacgcctgtaatcccagcacttcgggaggccgaagcgggcggatcacctgaggtcaggagttccagaccagcctgaacaacatggagaaaccccatctctactaaaatacaacaaaacaaaacaaaaattagctggatgtggtggcacacgcctgtagtcccagctgcttgggaagctgaggcccgagaatcacttgaacctaggaggcggaggttgcagtaaaccgagattgcgccactggactccagtctgggcgacagaatgagactccgtctcaaaaaaaaaaaaaatcattttcttcaatttaacagccttattaacctagctttcaatctcccaaatgttatttgattgtgccttttacagtcagcaataagtagcttttgaaaactacccttttactgacaatgcaatgtacaaacttttgaccaagtag

SEQ ID NO: 43940 - DNA, 1088 bp, Homo sapiens
tggtctcaaactccttgcctcaagtgatctgcccacctcagcctcccaaagtgctgggattacaagtgtgaactgctgcgcccagcctcaaaaatgtttactcccattcttttgatgatcccacattgaggaccacctgagaatgagcttgctgcccccactttctcatttgctgtgctttactgatatttttccctacttgcctagggagtaaattgtatgcattacaattcagcaaggaaaaaatgacagttttctaacagcgccctaaaaaatggaacaaaattgtgtagtttaaaataatatagctggatgcagtggctcatgcccattataccagcactttgggaggctgaggctggcagatcacatgagaccaggagtttgagaccatcctggctaacatggtgaaaccccttttctattaaaaatacacaaattagctgggcatagtggtgcacatctgtaatcccaactactcatgaggctgaggcataagaatcacatgaacctgggaggcagaggttgcagtgagccaagatcatgccactgcactccagcctgggtgacagaatgagactctgtttcaataatagtaataatatatcctgccaaactaagcttcataagcgaaggagaaataaaatcttttccagacaagcaagcacaaagggcattctttaccactataccagccttaccagagatcctcaagggagttctaaacatggaagtgaaagaacaatgcatgctaccgaaaaacacatttaagtacatagcccatagacctattaagcaactacacaatagaaactacagagcaacctgctaacagctttgcaataggatcaaaaccacatgtaacaatattaacctggaatgcaaatggtctaaacacccccacttaaaagtccgcagaatgaggctgggcacagtggctcatgccttgtaatcccagcactttgggaggtgggtggatcacctgaggtcaggagtttgagaccagcctggccaacatggtgaaccccatctctactaaaaatacaaaaattacctgggtgtggtggcgtgcacctgttatctcagct

SEQ ID NO: 43941 - DNA, 1037 bp, Homo sapiens
gggagaatcacttgaggccaggagttcaagaccacaccagcctaggcaacatagcaagatctccatctctacaaaaataaaaaatagccaggagtggtggtgtacatctgtagtcccagctactcaggaggctgaggtgggaggatttcttgggcacaggggtttgtggctgcagtgagctatagttgcaccattgttctccaggctgcgtgactgagcaagcccccgactctaggtaggtaggttggtaggtagatgatagattaggtagacttgcatgcatgcaaggattagatgatagaccagataggcttgaatgcgtgtgagaatagatggatagagacacagagagagataggattgagtgcatgcaagaaaatattttctcaccaaaaatccatctatgatggtatgattctcatttgatgtttgtattcataagcacgtcagaaaacctctagaattatttatggtgtttggagagggagacataggcagactgtaaaggccctaaagcagaagcatcaagcttttggggatcttcgaggccagagtatttaagacaaagaatatctttcagacatcttagggtgtagatgagaaaaacagtttcaatacattgtgctaatttctgtgataaaaggaagtaccaggttgttcaggattcattggaagggcacccacatgggtgggaaattaggaacttatgtccccattatttaaattataataatagctactactttaagtgacacttactacactattggcattatttgaagcacttttgggatattaattcatttattcctgacaacaatcactatgaggcagatactattattcccattttacagataagaaaattgaagttggtttaaattactttccaaaccaatgagtggtggagctcagattcatacctcggcagccaaactccagagtataagtcagtcagatacatcatgtatggttataataaaaacataaaataatacttgttttctatctttaaaatcttaggagccatagtttct

SEQ ID NO: 43942 - DNA, 1043 bp, Homo sapiens
tctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccacataacactgttatttaaaacagttttctgcagtctataaacatttctcaacatttttttaaaagtcttagttaaaatgtaaatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataagttcagagatatagtcatatttaaagttgtcctacagtttgcagataatttttatattactattcttcacattaacttctgcttatttttaatggtactatatgtaggccttattaaaattaagattgtatggttaagtaaagttaacaagaaagcctga

SEQ ID NO: 43943 - DNA, 1034 bp, Homo sapiens
taattgagaagtaactatactacagttgtatttttttctgtatattgaactgttttgaagccatattaatggactgttttgtggcttttgaataaagaaatttcaggtgattgatttaaaagagaaggcagtttaaggtagtatgatatcttgactctgttcagtctgtaccttgataagtagctattttagtatatcctcctatgtataaggttatattttacaatataaatgtagatagccatttttaaaagatactattagtttttccttatacttaatgtatactcacataaattacctgtgtttcattcacagaacctcactttatttattttatttatttatttagacggagtctcactgttgcccaggcaggagtgcagtagcgtgacctcgggtcactgcaacctccgcctcccagacagaacctcactttaaaaatcccctaacccattatctttctggcacattcttagtttagtatttgtggtcaatattataagaattggtatttatagaaactgaatgcttctaaacatatgtatcttaaaaatgccatgaacactttctttgtttatatgtacacaaataatacatgtttagggcaagaaaatggaagttactgctagaagagaattgttattaacaaggatatattgaatgtctgcttatatacagtattatattaggaaagtgtaggaatcattaatactgctttataaatagttctgttgttggctggtccatgtgcagtagtgtttacaactctttgatcacaatcaattacagttcttctccactcccactgcttcacttgactatccttaaaaaaatagctctgatgaatttatgaaaggtatgttagtaattttttaaattatgcttacttttataataaatatatcagtgtacttattttcagtgggatgagattgttgaagtaaacatgttaacccagttgcataaactacaatctgaaagtactatgtaaatattcaaaagaaagatactgaataaagagatagctttta

SEQ ID NO: 43944 - DNA, 1056 bp, Homo sapiens
aatttcagctcactgtaaaacctctgcctcctgggttcaagcgattatcctgccttagcctcctgagtagctgggattacaggcatgtgccaccacacctggctaatttttgtatttttagtagagacgaggtgtagccatgttgcccacgctggtctcaaactcctggcctcaggtgatccaaccacctcggcctcccaaagtgctgggattacaggcgtgagccactgcacctggctgttaaatccatttagtctaaagtgcagtttaaatccagtgtttttttgttaatttattttgatccattcagtgttgagagtggggtgttgaattccccaactattattgtattggagtctgtcattccctttagatctaataacaatggcaaaaatcgcagttatttttgcaccaacctaatataaagctttttttttttctttaacttttagcattttaaacacatcatcccaggctcttctggcctgtagtttcttctgagaaatctgttgtttgtttgatggcaatgtccttatatgtgacctgatgcatttatcttatggtttttagaatcctcttgttgtctttgagttttgacagtttgactataacatgccttgggaaagacctttttaggttagatctgcttgggtatctttgagcttcctgtatcttgatgtctgcatctcttacaagacttagggagttttcagctattatttcttcaagtaggttttctttgactttctccatttcttctccctctaaaatctcagaattcaaatgtttggtcactttatggtgtccccacatgtcacattggctttcttcattcttttttatttcttgatttctttctttttttttttttttttgtctgcctgggttaagataccttcgggtttacaaattctttattctgcttgatctagtctattgttgaagctctcagttgtgctttttatttcatttattgagttcttccattccaggattatgtacttttgttatcttatatgtcttaagtcacactgagtttctttaatgtcattttga

SEQ ID NO: 43945 - DNA, 2081 bp, Homo sapiens
acttattcattctatctaactgtatgtttgtacccgttaactgaccctctccttattcctaccctaccctacccttcccagctctggtaatcatcattcaactctctacctccttgacatcaacgtctcacgtatatgagaacatagggtatttgactttctgtgcctggctaatttcacttaacaaaatgacctccaattccattcatgttgttgcgaatgcaagatttcattcttttttatggctgaataatatttcattgtgcatatataccacgttttctttattcattcatctgttgggagacacttaggttgattccatatctttgctattgtgaatagtgctgcagtcaacatggggttgcaggatcccactgatttcctttcctttggaagaatactcagtagtgagattgctggttcatatggtagttttatttttagtttttgagaaacctctatactgttttccataatggctctactagtttatattcccactaactctgtataaaagttcccttctgtctgcatcctcaccagcatttgttatgtttttgtcattttgataatagccattctaactggggtgggatgaaatgtcactgtggttttgacttgaacttccctgatgattactcgtggtaagcattttttaatatacttcttggccatttgtatgtcttcttttgagaaatgtctgttctaatcattgcctactttataatgggatatgtttgtttgctgttgaattgtttgatttccttgtaaattttggatattagtccctagtctaatgaacagtttgaaaatactgtctcccattcaccacattgtctcttcactctgtcgattgttacgttagctgtgcagaagcttaatagtttaaatagtcccatttgtctgtttttgtttttgttgcctatgcttttgaagtcttaaccataaaatctttgcctagaccaatgtccaaaagcatttcccttatgttttcttctactagttttataggctcaggtcttacatttaggttttttatccatattgacttgatttctgtatatggtgagagatggagtctagttttattcttgtgcatgtgggtatccaatttttccaacaccatttattgaacagggtgtttttttccccaatgtttgttcttggcacctttgttgaaaatgagttggctgtaaatacatggatttatttctgggttctctgttccattgagatctgtatttacaataacatcatgctgtttggttactgtaggtttgtgtagtttattttttgaaattagatagtgtgatgcctccagctttgttctttttttctcactattggtttggctatttggaatcttttgttattccaaatgaattttagaatttttttttatttctgtaaagcatgtcattggtatttcaataaagattgcattgaattacttgattgctttgggtaatattgctgttttatttttattgattgattgattgattttgagatagagtcttgcttcatcacccaggctggagtgcggtggcgtgatctcggctcactgcaacctctacctcttgggttcaagcagttttcctgcctcggcctcccaagtagctgggattacaggcttgcaccaccatgcccagctaattttttttttcttttgtatttttagtagagacagggtttcactatgttggccaggctggtcttgaacttctgacctcaggtgatccacccacctcggcctcccagagtgctgggattacaggcatgagccaccatgcctggcctatattgctattttaacaatattaactcttccaatccatgagcatggatatctttccaattttttgtgtgctcttgaatttcttgcatcagtgttttgtagttttcattacagaggtctttcagttttttagttagatttattctcaattatttgattttttttactagctatagtaaatgagattgctttcttgatttctttttcagctggttcattatcggtgtatagaaatgccacttatttttgtatgtgaattttgtgtcctgcaactttattg

SEQ ID NO: 43946 - DNA, 1060 bp, Homo sapiens
acttcatgaatacaaggtaagctgtttaatagaaatgaaaagacattttataggctagttgaaactttgttagtgttataaatattttaaacagaggtagattaaatttatagtcctgaaattaaaaatgtatcttctagttcacaatgcttgaaattgaaagtagcaagatatttttatttttagtaatatataatcttttactgaataccttcaacatgccaaatactgtggtaaggactaaagataaaaatttgaaataatatactatccatgcccgtgaagcaattaaaacccaataacatagacagtatttttagacctcaatttttttttttaatattaacatcacaagagaaaaagtactcctgatacaatgtgccataattttattctttaggggcaatcttgattttagaaactgcttagttgatctatttggattatcaatggtacattttcctttcatatctcttttatttttaatttaccttgtttgtttttagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggtagattttcagctcttttttaccaatcatgtcatataatagttaaaacaacagtaccaacctacatgaagaatttagaaatggcatatatacaagactgttcattgcaactcattcattacataagaggaagggggacactaaatcactgtcagtaaggcgttaatattatattacatttctgcattagaatacccttcagccataaaaaagaataaagagtatttttgtgtagaatgatctgcaagatacatttaatgaaaaagcaaggtgctgaacaatatgtaatatgctgcctactcttgctattaaaatgggaggaaatgaggatgatttttacataaata

SEQ ID NO: 43947 - DNA, 1079 bp, Homo sapiens
ctactgtattgtatgaagcatagttaatagaaaaatgtttcagtcatacaaaaatttaggtaaaattttgctaaaaattatccatatttataaactgatgataatatttgttagacaaccaggtcagcaaactatagcttatagccatattttgccaatttttgtatacctcacaagatgattttttttacgttttttgattgttaaaaaaaataactatttcctatcagcgaaatattttgaaattcatatttcagtattcctacataaagtgttattagaacactgccatacccatttgttgatgtatcacctgtggctttctttgtgctacagtgccagagttgattagttgcaacagcgattatatagcttacaaaacttaaaatactactctctgggccttaataaaaaaatgtttgccaacctctgctcaaaacagtaacagctcatttatatacaaatatgtagcttttgcttttcccatattaagttgttcatttgtaaaaagaaattgtagcctaataaccaaattatactttttcctttaagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaagtaagtatttaatattatgcatggtcttgtgctatgcttaagattctgtttaaccaagaaagtttaaaaatgttattagaaaatatttatacattacattggtttggaattaaataatataagacatagaatgagaaaaaatattatactaaagcattcttaaagttatactctccaattttacttttcttatatttgactatagtttgatatactttatatttttctttatctttctttatgcttaaataagttcactaaaacctgactcgaataagtagtaaaacattttataaggcagatgtacttaagaatcccaccataaaaactagttttatgttcagtctttgagagaaaaca

SEQ ID NO: 43948 - DNA, 1018 bp, Homo sapiens
gcagagcagctgtttagtttaagtaccatctcacaccagtcagaatggctatgattaaaaagtcataaaaataacagatactggcaaggttgcagagaaagggaacgcttatatactgttggtgggagtgtaaattagttcaaccattgtgaaaagcagtatggcaattcctcaaagagctaaaaacagaactcccatttgacctagcaatcccattactgtgtatatacccagaggaatataaatcattttgccataaagacacatgcacacacatggaatgttcattccagcactattcacaatagcaaagacatagaatcaatctaaaggtccatgataacagattggttaaagaaaatgtggtatgtatacatcatggaatactatgcagccagaaaaaagaacaagatcttgtctttgcaggaccatggatggagctggagaccattatttttagcaaactaatgcaggaacagaaaatgccacgtgttcccacttatacgtgggagctgaatgatgaggactcatgagcacaaaaaagggaacagcaaatactggggcctccttgagggtggaagctgggaggagggagaggagcggaaaaaataattattgggtactaggcttagtacctgggtggtgaaataatctgtacgacacacccccatgacaagaatttacctatgtaacaaacccgcacatgtaccccagagtctaaaataaaagttaaaaaaagaatagcaaaacctgagcaaaacaaatcacctgagtaaaacaaatcacctgagtaaggtgtaggatgaaagtgtctgatttggagtatagaaaagacatagtatttgtgaaggggaagaaaggaaaaacagatggaaaatcagttctaaaaatgggctgttttcccctcagatgttccatatctaaaaccaaaaccaagtttccattcctcctcccacctcaccctcttatttccacacaacaaattactttctacccttgcttcagagtgcagccttac

SEQ ID NO: 43949 - DNA, 1063 bp, Homo sapiens
ttttttttttccccctctaatgaaagaatggtaatattttcaactattacataaaaacaaaagcatggcattgtatttaatatgctttggaatgtacctatgtttcagtaccatttttagttcctaaaatattacctttggtaagttactttatgtctctaagggtctgtttctttatctatacgagatgggcttaaaaatggtaccttccctaatagtaaaagaaaaattacaagtaacgtgctttgagagcacataatgagcactcaataaatcttggcttttaagaataagtgttggccgggtgtagtggcccacacctgtaatcccagcactttggaaggccaagaagggcagatgactggaagtcaggagtttgagaccagcctgccctggtgaaactctgtctctactgaaaatacaaaaattagctgggcgtggtggcaggcacctgtaatcccagctgctcgggaggctgaggcaggagaatcgcttgagcccaggaggtggaggttgcagtgtactgagatcccaccaccgcactccagcctgggcgactgagtgagactacatctcaaaaaataaaataaaaaaataaatattgtaaaaatgtaaagattttgatgtctgaatctaaaatttattaatctgtaatattttcatttgcaaatttttgttacttgagtatgccaaggaaaagagttttatacttggataaattaattttctgtcagcttgataatcaagtttaatgtaacaggagtagtatgggtcaccttgcaatactattagttggatgcctcatttaattgacgtgaattcaaataatgatttaactattcagtaaagaacttaaatttatcttggaagtatactcttattcactaattggtacaaagaccgaggaggggacactgggctcttgactgtgatacagtgaagagactagggtttagtcctatttttgtaagacaagatattttacctcacttggtctcatttctcacctttaaaatgagggttttaattagattagtggttctcaaacttttgggtctcagga

SEQ ID NO: 43950 - DNA, 1034 bp, Homo sapiens
catatgccttgccttctttaagggtttgttgtaaagattaaaataaatacataaatatatataaatacatttatatgtatttatatgtaattacatacaacttgccttctttaagggtttgttgtaaaaattaaaagaagtatataaatatatataaatacataaaataaatacattcatatatgtatatgaaatcactttgccaactatgaagcctgattcaaatatgaaatgttgtttgtttttcccagagcacaggctgcaaagccctgcattcttttctttgatgaatttgaatccattgctcctcggcggggtcatgataatacaggagttacagaccgagtagttaaccagttgctgactcagttggatggagtagaaggcttacagggtaataattataaatacagaaatagaatgttataacaaaatgtcatcatgtcatcagattttggtaaaaaaatgttcttttttcctctaggtgtttatgtattggctgctactagtcgccctgacttgattgaccctgccctgcttaggcctggtcgactagataaatgtgtatactgtcctcctcctgatcaggtgacaatttcatatttagagtccaaaacccaacaaatgctacactctttccttgtgagctttacttctgccaggtaatggcaattgtccttagaagaccagctttcttagggaaaagctttagccactgtttgctcaaagcataaaaagattctgaattagatgcaaagcctttttttggcccagtgcaagtctgaaaactttgtaatccttctgtgttggctgattggggaaaaaaaaatgcaagaaacctaatgtattatattttcacattatcttctgttcaaagattacatacttccattatcctgtcaaaaaaaaaactctgatacagaatcaagcatgtgaatcgtaagcatgtaagcaggtttcatagagataatttttcaactcttccttgtcctgtgttgttccaactcttattctccaatttagaagcaaacaaa

SEQ ID NO: 43951 - DNA, 1106 bp, Homo sapiens
ctgtttttgtgttgtctttgtctggttttgctatccgtgtaaatctggcctcataaaatgagatgggaagtattctctcctcttcttttgtttttttggaagaggttgtataaaattgaggctgaatcttggtggttgccacaatgacaggaactatttctgtgactgaatatattgggaattcctataaagcaattattttctagggaagtggaaaatcaactttagccaaagcaatctgtaaagaagcatttgacaaactggatgcccatgtggagagagttgactgtaaagctttacgaggtatgagtatggtaacactctatataaatccctttttcattagaaagacaggaatgttatacataatgctgtcaatctaataaatacacatatcatctagtctttaacttttctgtttatcatttagtcattaaaatttctttggctttctaatgtttttgataaaatttctaaaactctccatatttaatggaggcctatttttttttctagccagaactttttgtagactacatttctggaagtgctcactgacaccactctgaaaaattagtacttagaatatactctaattggtataaatgatctctgaattgctatggaaaactgggagaatggttgcttcaggggagagaaagtaggaggctgtggacagcaatgaggagaattacagttcaccatataacacttttgtacttttaaagtccttaacatttacattattatctattcaattaaaaaatattgggaagattttactttgaacagttaatttttcccccatgggtaccgctgtcatatagttccaactaatcatgaacttgtgtatttcctgttctttgtaaatttaaactttgtaactcaccaggaagtttgaagccaaatttgtgtttcaaatatagcaactccaggatctctaggcagatgcatttgcatttgattttaaatgaatcttgatcccttactctcacttatgttttcccacatcctactttttttattttgttgtaagccatctaaaattctcaatgggatgaaactgggtataaatgaatacatgcatacaggaattatagtagcat

SEQ ID NO: 43952 - DNA, 1050 bp, Homo sapiens
aaattattaacaagaaaataagttacccataatcccagaacttagaggtgactaatgttgacagtttggatcaaatcttccagttttgtttctaatctttatttttaacataaatgaggtcctgtatacacacgtacagttttgtgtcctggtgtttttatttaatgttattatgagtgttttattttgttaaaaggtcatcattttaagttgttaattagtattctagcacaaatttgccataatttatttaattgtttactatgattgaccatttagattgtacttaatttttaggcattagaagtgataaactatattttaatcagacgttgaaaataacacatctttgtttagaaaacatcattttatttctggttgtctaggatagattcccagaattcttgggttagaggccatagataattatgaaagcagaaagattcacaagttgggagttaatacttgaattactttatttggggtgaagcattgagtgcataatacagatcatgcagtaatgggaagaagggttggaacaatggttttctggcctatgtcagacttaccttgaagcttttaagaatacagatgttctgatcaaccctcagacctattaaatcagacctaaaatcttagggaataggctttaggcatctctaattttaaaaaatttattcaggctacttggatgcacaaaagagttgagacctactgtcctagaatcatagaattttaatgacgatagagaccttaagcatctaggtcgtttctgtacttttacatgtaaggaaactggcattcctaggccagtaccattgccatgcagctaatttgccctcttgtctatagctcactctgcatcacccaacctaccgttctcactgtttcttctataaccaatctccttcccacttctgttctcttactcatgccattcttccctcagtcatttttcttccttccatacaaattccatgtctttaaaaaggaataatcctacctcctccacatagctttccaattctctgttgcccacatttgtctccc

SEQ ID NO: 43953 - DNA, 1025 bp, Homo sapiens
ggtactttgaatgcggacattggagttaaagagcagaatcagagatagcttagattctttgacctaagcaaaatgacagataagtagtgccagttactaagatggctgaggatttggagagaaaaatgaagcattttgttgtgctaatttcagatatgcctacgagacatcccaggtagagctgttaatgaggcacttatcgtcctgaggtcaaagagtaggactgaatataaagatttgggcatcattggttttaagtggaatgtaaagcatgtgactgggagagtatgtggtaaacaatggaaggaagccccagaaaagccagccagaggaagaagagccagcaaaggaaatgaagaggtctttgtgatagaagaaaaccagcagagaggtgtcatggaagctaagaagaaaatgatttttagaagagagtgctcagctgtccttttatgaaaaagcaacctatacccaaaacttagttttaaaagcccaaattacaagattttggactctgtaatattccctatgtacttcaaacatgtagtgagaaaagaatgttgaaaattagcttagtgccacagagtggtagaggcctttgagagaggggagagtagatagtgctgatagataggaaatggataggaagctctgctgttaccatccttataggtctcttcttttttgcttttcattttcttctcttgaatatcagtacactagcagcagtctctcatttggtaccacctttccaagtatctgtgtttctaaaagttctgcgttctataacaaaaataggagagtcagacttcagcaaaactccagctcccttcaatccactcacagtttaactacttctaccgggcattagtggcattttcttctaaaaatcagacatctgttttgcttaacaaagtagactttttaactatacattgatactttgtactaattagttgattttaatttaataatttaataattaatgacagcaacttcaagtagtgctgccagtctgagcagtacac

SEQ ID NO: 43954 - DNA, 1025 bp, Homo sapiens; identical to SEQ ID NO: 43953

SEQ ID NO: 43955 - DNA, 1025 bp, Homo sapiens; identical to SEQ ID NO: 43953

SEQ ID NO: 43956 - DNA, 1092 bp, Homo sapiens
ataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcacgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagtaaaaaaaaaaaatctaatttggaaatttgacttgttagtttctgtgtttgaaatcatggttctagaaatgtagaaattgtgtatatcagatactcatctaggctgtgtgaaccagcccaagatgaccaacatccccacacctctacatctctgtcccctgtatctcttcctttctaccactaaagtgttccctgctaccatcctggcttgtccacatggtgctctccatcttcctccacatcatggaccacaggtgtgcctgtctaggcctggccaccactcccaacttgacctagccacattcatctagagatggttcctgatgctgggcacagactgtgctcatggcacccattagaaatgcctctagcatctttgtatgcatcttgatttttaaaccaagtcattgtacagagcattcagttttggctgtggtaccaagagaaaaactaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagt

SEQ ID NO: 43957 - DNA, 1053 bp, Homo sapiens
tattattttgtgttattttcttccatgatatggagtacgacagaagctgtgatatctgttttttagcagatgagcagagattaagtggcctgcctgcactctgggatttatttgttaatcagttacagagccagcactaagagctggatcttctgtctcctggtctatactcctttccataacatgtggtaaagtgcttctcccttgttctgaagaaatccctacagggaacctaacactgccctgatctggaaacaacattgttacctgacaggccggtttgccagggtgaccattcttaagtgttttagggagctaggattaatctttttttcccaagaggaagtagcaataaactgtgcaccaaaaataacgctttagctgctaaattctgcttagtaggtggtttcccaaagatgatccaatgcaatgagtcatccctctgagcacttactgcacattatttctttttactaatcctcggtgcttttggttgcatgttttttaacctttagagccctcctgggaggttcagagtcttctcactatgaatataaaacagactctactacatccccccacatgtccctcttgtcctttacttcctatacttttcaaatctaagataatccatcacttaggagaacagtcaggatcatgtccaaagataaaagatcagcagtaagtttctccagagttagcagcagctccatctcattcccagtataaaaatcaaaaatgtagatggatgtaagtcaatgtgtagaacccatatcaagaaaactataaaacttgattgagatacataaaaatgactttcctagatatagagaatatttgattattagaaagatattaaatattccattttcctgaacaggaagattgaatagttgtaaggatataaaaggtttccaaattaattcataggtttatgcaactccagtcagaattccagtgggatttcctgaaatgcatttggaagagttaaactggtgaaaatagccaagaattttttgttaccaaaaaaaaaaagttatgaagagaaactcc

SEQ ID NO: 43958 - DNA, 1028 bp, Homo sapiens
tctggggtcaaggcgtggggtcagctgactcctccacaaggaggagttgggggctcctacttggtcttcccttgttttccatagttcctcacagaatccagagggcagtccccaaggctctcagagtcttactctgagccacaggaagaagtaccttacgccagctcacaggggaactccaaacagtcagcaggaagaaactcagtcactcagatgaaaatgatggtgtctcaccattcttctatgcagttttctaaggggcaagacagagacatttggctgtgagacattaattaatcgaacagaatgtactttaactgttacctttcttatctaaggctgtgtggccggctcactggttttagtcaagtaaagagcaatgacttatgcatttaatgatctcactagacataatttcctttcatattggtttgtaagacaggtgctatcctctcccatctcaggtggagctcagaaggcccatttgttctaatattcctgaaccatgtaggatcagcaatctggactgttttttaaaaatcttataaaaatctgtataatgtatgcatcttatgtaagattattttttaaatagtatgtattatgttctttcatttaacaaaaatatacatggttgttgtagagcttttaaaatacgagtaaagagtataagtctatagtatcttgttataccagaaagtaagaaaatgctcaaaaaatatgggaacataccagaaaggcacagaatttagcttgaaggagccactggacaaatataaaacaatttgggcatcaaaatacataattatagtaaaggattataacctcctgaataaaattaaaatccatgagtccatgctgatataaataaagtgggagaaaagagagctttgtcttacagtagactgacaatcaataataacagagtgaatgatggagttagaaaatcatcaatggatgatgctaaaactactgagtggaaatttcatcaagagatttacgtagtgtcaaaatggctctttacaaga

SEQ ID NO: 43959 - DNA, 1032 bp, Homo sapiens
cacaatctggaggcccacattggcagcctggggtggtgacagcttcggtcagttgttgtggagttccactggcagacaaagaagagtaggcgagtgtgctgatccaggttccttctgtatgatagaagaaacctctaaggtcctggtaatgtgtgaaccagtggaatacctgctccaataattaaagtatgagctttccttcctctttttcagggtggaccaggccttgggaaaggaattttggccttcccagactgtacacattacttaatgtgtccttctacacttattacatgcatcaggagcagatttcacaagccttcttcctatgagactaggttagtcactagggttaattattcagtagttaaaggaaatattgtgatggagggaaaaatagatttccagaagccagggagtagagggcctcagaacatcaaattgctccatgaagagagtacacagccatttttatttcagtctttgaacatgagatagtaatcgtgatttgaattctctaaacctcaaaaatattcccttcttagctgtaaatagccacttgtcccaaccccatatatccatggggagcttctgttctcccagagaaaatgcagttaattatagcaaagaaagggaccctaggtctccccttcctgccttaagagtaatctccagtatctctactcatgagataataaaatgtatcattttcagaaatttgaagaaggtaggtcaggactcaccagtgctgtttcaaaagccttttggttgtgagtgccacatctgaccactgcacagatagcactgagaaagaaaattggacccagttctctgcttttgccttccattctccctgtaagggtccacgtgaacagcaagtttggcctggtttccttaggtccctctgggcccatttcttttctttcatcatctttcctaaagctgatatgacaattccatggggaagaaacaaatagtacacttggatgaactttgcgaaacacaaagacctttcctcttatccctgattct

SEQ ID NO: 43960 - DNA, 1047 bp, Homo sapiens
tgatgcagctgcctggccttcttctcctgaattaatggtgcttgagctcaaacttgcaagtataaagtgtttatcgacactagtggatcatcctcaatatgtccttactttaaaaaatgcttgcacctggggagcctcattgtctctgtgatctttcactccacgtgacactttaagaaacaaaaattgctgtacgaaggatcaaagtaggagatttccatgcctgttagttttatttaattttaaaaaaatttaaacgaaaaagtaaaataacatagtctggttgtaaaaacacctaatgttaatacagaagtataaaatgtgaacattgtctttcctgtacttctccaaaactcccaaagatagtcccctcgatatacttccagatcttccttgttacaaatgagagagagagagagagagagagagaaagagagagagtttataaatgctaaaatacataggtacacatgtacatatgtaaatttttctcacagaaatgggcttacccgatactcttctgtacattgcttattcgctttattttatcataatatgtcagtacctagagatttaactcatttttaaacagattaataactgtcagttcatttatttcataatttaatttcttcttgatggacatttaggggttttttggtcaaaaaatacaaacaatatttactgcaaacagtgttgcagtaaaatctttgtgcttattttatggagcattcgtccaggtatttctgtacagtaaattccagaagtgaaattacagggtcaaatgacatgcaaattttttaaattgtgctagctaaaccaaattaccctgcaaaaagtttcaactaaactctgtttttagcttgaggtgggaggtaggattgagattctcaaagatgaagaaaggttgtcaagagtaaagcaagaaaagaactcttatgtaagccttgctaccttttctaccactacattaaaacaatatcaagtggaggttggccatggtgccttacatctgtaatcccagcactttggaaggccaaaacagga

SEQ ID NO: 43961 - DNA, 1052 bp, Homo sapiens
aatctgtcctgtattggaaaggttggccaattctctgtcatattattaagaggtgcatgtcttttgttcaaaaatgaaatacctaggaaatataaactcagtaaagagagtcatagggcagatggttgacaaagagccagagagtttaaatatcatctgtcactgttatctgggtttaataactgcccacactggcccacagaagtattctacaaaatgggtaagagctacatttttttatctttctcctttaattcttcatccagagtaacccatccttactccacattgaattgtattttaatactaaaaaaaaattgttataaatttggttagtggccaactagtcagcttaaaggatgagattggatggatggatggatggatggatggatggatggatggatgattggatggttgtgatagattgatttttaactatacagcaaaataaattcacagtattaactccccaggtatctattggttgccttgtaatcctagttagaactgtctgtagtttgaaagttatggggttttccaggttacagcaaagtcacataaaatgcacatttagaaaataaaacatgcggccaggcgtggtgactcacacctgtaatcccagcactttgggagcccaaggtgggtggatcacgaggtcaggagatcaagaccatcctggctaatacagtgaaaacccgtctctattaaaaatacaaaaaattagctgagcgtggtggcatgctcctgtagtcccacctactcgggaggctgaggcaggagaatcgcttgaacccaggaggtggaggttgcagtgagctgagatcgtgccactgcactccagcctgggtgacagagtgagactcagtctcaaaaaaaaaaaaaggaagaaaaaagaaaataaaacatgtttctttgaatacgaagattgtggcaagcagatagtaattcttagaagttctgagttgccagctctgccaatccatagctaagaaatgccaaatgccaccaggaagaatataacaaatagagtcactgttagaaggaaacaa

SEQ ID NO: 43962 - DNA, 1032 bp, Homo sapiens
gtaacacttggatccgcttgccattgcaggtcgtcacgctgtggtacagagcacccgaagtcttgctccagtccagctacgccacccccgtggatctctggagtgttggctgcatatttgcagaaatgtttcgtagaaagtaagaaatacattttgtttcactctgctttccttgaaaagagactgtggatctttgtgaatttgagtggcagcatggcatttctatcattaggggtcatgatggccagatccatctaccccaggctaccacttgcaagcctgtcctgaaaccgccttctcagtgcttacagtgttgttttatatgactgtagcttgcagcttctggaaactctgcctgggaaggaataccccactgttcttataagttacattgttttactggtgatgataggacatggtgaaaataacacatattttcgcatttttttagtgaagaaatatctcaaagtggactttatccataggaggagaaccaaggctgttaagtgtatgaaaacttttttgatggaattttgatagtgagaatagttgaaaaaaacaatatttaggctgaaaaagaataggcagtggggatgtcagtgctacttcagagcactttaaatgctgccgtgtacaggagagattagatatattcaggtactatagaggacagaaacaagaccaaggatacagaaattacaaaaagaaagatttttgttaaaaggggtagaaatctaatgattagacagttatctgaagagtggattggggtttgtgagaatagtgagttttcattgtgtgtctaagaagaggctggacctccacacattggtgatgtttcagtagcatttatagggttggtgcgtaggctagatgccctctaagttccctctaagagagcatgtgattcgtttgtttgattttcaggtcacaagaaatagccaaataatataataaagatctgccaggaaaataatccatatctgggtactaagttcagcctagtctaaattaaacagagaacctaatcat

SEQ ID NO: 43963 - DNA, 1050 bp, Homo sapiens
ttctgtcttggtaggttgattgcccagtaattattgatgaacttcaacattatactacaataaatgtcttctcatttgctgtacagacagccagaaagtataagtaattagaatttgttctgcactctacttttatcgtgaaaaagtaattgaaagtaaataagatatttattcagaaaagccactacctgaatgtgagcatatctgaactaataaaaatagtatagttaatacagatatatagcaagatgtcctcaccatctacatctgtaataatatatagtggtaattgactcccataatggttataccaaagccctgaaggattcttaacttttactttcatttttaatgcaaaaccaggttttcatatattttgcttgcttaaagcaagatatactagctcttatttttcttactaaattacatgcatacatatatttcaaattttattttagattatttgtgctcaaccccatacgttgtcatagagtagtgcttttcaactcgttttccaaggatcactaattctgtagaatgttaatagatgttatgtgagggggagaaagtcattcagctttgtaaatgctgaattaaatatttctttttgaacaaagctggaggcatcatgctacccaacttcaaactatactacagggctacggtaaccaaaacatcatggcactggtacaaaaacagacacatagaccaatggaacagaatagagagcccagaaataaaaccgcacacctacaactgtctgatttttaacaaacctaacaaaaacaaacaataaggaaaggattccctattcaataaacagtgctgggataactggctagccatatgcagaagattgaaactggaccccttccttatatacaaaaattatctcaaggtgaattaaagacttaaatgtaaaacccaaaactataaaaacccacaaagacaacctaggcaatacctttcaggacataggcacaggcaaagatttcatgacaaagactccaaaagcaattgcaacagaagcaaaaatggacaaacggaagt

SEQ ID NO: 43964 - DNA, 1026 bp, Homo sapiens
tctggacattaaagcctcaagtgtactgggggaaaaaaaagcacaaaaaattacagcatatatcaggaattttccagctaacgatgtgcggatgtggtagcgcgagggaaaaagagccaaactgagcttgctttgttcgctaagagaggcccccctgtaacattccttttagctgtgcatattttggcttcatttgtacagttttaactttatactgtgtgtggaggagttcagttgtaactggtggtgcctaataattctattgcaataattaaagttcatggagagctgttaggttattagttcatagaagctgcttcagaaaacggagtctaagctgaaaactttttaagtgacatgtcattactgtaaaagatggcaacaattattttctttgatttcacagcagttttttttttaagacaagattcatttatggagacaaataagaaacaacatcttaaaagctttgggtaggagtgaggggcccagactgggaatgatgagaatatggatcctgtagcctgtgaataaaacattttccaactggcttgtaaaacatgaaaatttgtgatagcataatttcatctgctacttttagattccatttaaaatgtgaaattaatatataaatgttagtaaatctattgcagaaaccaagtattgcagcttcttcacctctgatagaagtcatatgtgacttttaattcagtaatacgatgaaaaatctccaactgaacacagcctccttcttaaaagattgacatgccttggagtccccaataaaatagtaattgcaatgtacaccaattggttagagctgtgaaatatgtttcccgggggcttctctgcagtggtagagggctgtctgcctgcatggttgtcatactcagtggttacttgcagactctggagttagacctgggtttggattgtatctctgacaagtggctagttgtgggactactgtagttattaacatgtttgaatatcagtatcttacctaaaatatgggtaaaaaattat

SEQ ID NO: 43965 - DNA, 1049 bp, Homo sapiens
aaaccaatatagctttaataaaactgcataaatgttttaaaaatcaaatatgtaaaatcaagtaatttgcatatgggctttggcaaagtttttcaaaagctgcctatgcatttaaaatatgatttactagattaagatgcattttaaaagactttacaggtttatgtatattatgtaaaactacttatactgtctggccactgtagtttttacttgatatacattcaaaaatattgtattaggaaaagccacagatagcccattgtgaattgtaaagtgttaatgtcaaccgggcgcagtggctcacacctgtaatcctagcactttgggaggctgaagcaggcagatcatgaggtcaggagttcgagagcagcctggccaatatggtgaaaccccgtctctactgaaaaaatacaaaaattagccaggtgtggtggcgcattcctgtagtcccagctacaggctggggcaggagaatcgcttgaacccaggaggcggaggttgcagtgagccaagatcactccagcctgggcaacagagtgagactccatctcaaataaataaatacatacatacatacatacatacatacatacatacatacatacataggattaatgtctaaagaagagagaaactcacatgttcttatacccaaactgtccactgtcatgccttttattggcaagtagatgttaaaaatgtagcacaatatttaagattttgacaagattgaatagtccatttaaagtaagaaaagctttcaagagtgacctcagcaattttacacaagttgaaataaaatcttgtctttatcttttctttgtatttattgttctatctttatttctataacgacttcttggttttaggatgtggggctgaaaaactgcatttaaaggtcatgttgctgctactatatgcacagtacaatttgtattttccatcagcttatcatttgtaatttttgtactcctgtttttaaaggcatcaaattttttcaatagtcgattgtagttctcaagtattgttagtcccataatatttta

SEQ ID NO: 43966 - DNA, 1016 bp, Homo sapiens
ggatttttgtgtcctctttaattctttggacacgtgagctgcttgtattttagagctgtcactgcttccttttaaggaaaggagaggtggcaatattttgcttaggctttgataatatcatagtgtaagtttctgagtcaagataatgtttctcaaattctgtaacattggccatatccatttttattcactcagtccaaataatgtattttagcatttcctacagtgccttccttgcacgaggtgggcacttgagtacatggtgaatgaatgaatgaatccttacgattctccagtgcctagagaatgaactgtaactctacagcatggcatacaaagttttttgaagctcagctccaacctacctttctgtctttccatcgcttctacccaaagtggtaagcacataacataagcacatattctttatcagtttttcactattctttgaacttaattgctttcacaactccctgcttttacaaatgaatcaatgaatggatttcctactctgcattctccatgttgctgcttgtgtcattgcatcatcaattataagcatccaaaaaaatttttttaatttgttttagacacaactttcaactaatcttcccaattgcctgcgtcactccttgataataacttgagctctgagggagtaacatttacactttgaatgtgtgtctgggcagccattcataaccttcagataattattgtgcttcatccctctttatttgagatcacaaaccttgccagatctcctgacttgtgcacttagatgttctgtatgttatgcttttattttaaagctaagatcccttgggatctttggagaaaccatagtgtcccaagaaggggttgaaaatctctgcattgcagtttcccttagtcattttatctagtccatttgggtccttgagaagattaaatttatgatcctgttatctgtgtaggtctctccaaaagttgagctcagacttttatacaattactttgtagtgccggattttctg

SEQ ID NO: 43967 - DNA, 1038 bp, Homo sapiens
atgagaacaggttacagggaagttctttccattgtacatagctgataggtaaaaatcatgacatgtgaagttatataatgtctctggcaaaagtgtttcaagaatatacacctgttcggtacaatgactgttgtgactagctgaaactatatttagagtcactctgaagtcaacatttctaagtccttctcatgtgaaatgtagtgcatggtgcaacttatttttgtgaagataagggaaaaagagaccagccactcagccagcaatttcagtcctacctcactgtgcacccgggtctgacatgtcttagagcagagccaggaacatcatcagcagccctggtgagggctctgacagtcatgaagcactgtgaccagcaagctcaggaagggagcagtcttgtcttcccatttatgatgcaaaatctttaattttttttctaaacctaatcatacagcttggagggtgatattgttgccattggatttggtgctcttggaactctttatcaaccatttcattttgaaaagtggggaaactgccattcaaacaggcagtgtgaccagcttaagtctgaatttaccaaatagattgtaaatggcttggagaattctaatgtttatattctggctctggcccactatccccactcctcttttctccataccaaaaattcagtacccaagagggtatcaaactgtgttctgtggaactctcagattctacaaagggtatttagaggttccacaaatgtttaggagtccatttttaaagaatattttttaagtcttgttaaaataataaaaccaaaaacagacaactagctcatgccacattttgacacagtgaggaacactgggtcatgaactggtgcctcctggttttctttttttatgtagacctcaataaaacttttgccacattgtgcacctgaatgtcttataaaagtatcattgcttaggaaaaatgaagcattctcttgattcagtcctatctgtgtcctctcccttaaaatcacccaagtccataattgcaaca

SEQ ID NO: 43968 - DNA, 1023 bp, Homo sapiens
cacctgaaagggatgattgccaacaggaaaagaatgttggtacaggccccattgggtctgtacctcaccctggggtgaatcatggtggctataaatgaaagataatgttcataacatatttaagttaatataattttaattaagttagatttgttagaataattttcagctgcaaattacagaacactcaatgaaaagtggatccagataagggcattattatatacataactacaaggctggaggcagacagccctaaagttgatgcagctattcattgatgtcatcaaagacccagactctttccctgtttacactctggccttttatgtgtacagatgatgtttcaagatggttgctacagctcggtagcattcagtataagacgtgggtgaggaatgggagatgaggaagtacagcagagagcattctactgtgcacctcttatcaaggaggaaaatgcttcctgaaactctctagccaatttgcccatacaggactgggtgtcatgttcatccctggatcaattcctagcaaaaggaaatgtgattgccttcattggcctggaccaggtcttcatggctgacaaccagcagtatcttctatatcacacaaataattatctgttctactcttgtggaaaaccagctcctctaagcattacctcatttgaagaggaaggaagtacagagtgaggggaaaattctcaaaagagggaattgagaggaagaatgtggaaagataagaaagtattttgtccaattgcagccattagaaagcttattaaaatttcttcttctgtttttgagagctgtcgcccaggctggggtgcagtggtgcaatcacggctcactgcagcctcaacctcccaggctcaagtgatcttcccacctaggcctcccgagtagctgggtccacaggcatgagccaccatgcccaactaattttttgttttttgtagagacagggtctccctgtgttgtccaggctggtctcaaactcctggtctcaagtgatcctccc

SEQ ID NO: 43969 - DNA, 1031 bp, Homo sapiens
tatgtataacgtgccttgttcgattcttggagaatataaagatgcattgcattcctgttcctcaaggaatttgcaatctagctggatagcgcttggcagtttaaaaaacaaatcaaatctataatataaaataatcaaatgtctaggttctctccacagttctatgacagaggcagggcaggatttattctggtttttataagtgaaaacctgaggctccaaaaaattgggacttcatagacactggggactactagaggagcggggaagagctgaaaaactacctattggatactgtgctcactacctgggtgatggaatcatttacacccttagacatacaaaggtatgaaatatacctttataacaaacctgcacatatacccccgattctaaaataaaagttgacaaaagtaaaaaatgaaataaaaaatctgtactattacaaaaatgataagaaggaaggtggaacttgcttaatcaactgactagtggctgagttgaacggaacttagtaacactggagtaagagactgtactttgagaaactctgatatgatcatatgaaattaaagtagtattaggggatttggccaatagtccaattctgcatccaagtgaagactcaggcaaagtgatttgatctgtggaatacttctcttagagatgggagaggataaggtacttaagctagtcctaccccaagctgtggaacaatgtgctgaaatccatgtctcttgacccctgggcaagttgcttctgaaagagatggtaagataggaagcatccttcattgtttttgttcagtgtgtcagtgttcattatagtcatgggagttttatatttctaaaataatgagcccaaagtctcaacacatatgaacatgttttaatggctaaaaggtacgaatactgatttatatgccatgcctcttttgtccctatcccgtaatccaaacctgctctttctgattcccctggagttttatcgcattcctcctaaaaggagtcagtgagttctttttaagctaa

SEQ ID NO: 43970 - DNA, 1026 bp, Homo sapiens
aatgatcaaatatgacgtctgtacaggaaataaatcgtgtagtagtttagctggtaatccatgttctgcctcaaaacctaggaatgaatggcttattagctgttgaaaactctgtcattaagtatcattaaatcctttttttaaaaacttcctttatgccaggtaaatttttatattgcgaaaactgaattaagccaaagaaaggcttgcaaaaaccaattcagatcacactgtgactataacaagacattttcaaaaccagcattccagttgttctgtcaggtcattccatcaggtctcaaaaggtgactaggatgctgaaaaaggtttgccttccacattgtgacgtaaattcatttatttgtgttacttttgtttagaaatggcttgttacaataaggttttatcactgtgactcatagatcatgtaaagtcagcccattcccgttttactctttcttgtaattttcaaaatatggcgtagtggcaacccaaattgaaatcttgagaagctggcaaggttgatcaaagtggaatccacaaattaggattgtaaccaaaactggaggaatcatttttaacctactcaggaggccattttagagtcctgaaggtatcacttatacacaaatcagtgaaattataacatttttagagttggaaaattccttggaatatatgtagcccagcctctccccactttatgtttaaggaagtgggtcccgaagagggtggtgagttgcccaaagtcatgcagttagtactgtgctaggactgtaaccaagttcctattattctagttcggtggactttccaaaagccatataaatgtgtttttctcactcatgtagaattatttcctagaataaagacctatatttaaaacatcttattactggtttgaatgtgttactatacttgcttgtacattgctctaaaaacaatgttagtttgaactttgccctcatttgactgacctaccccagaatcagtaatgctctcttcactagaactttcattcttaac

SEQ ID NO: 43971 - DNA, 1105 bp, Homo sapiens
tgctggcaaggttgtagagaaaagggaacactatacactgttggtgggagtgtaaattagttcaaccattgtggaaatcagtgtggcggttcctcaaagagctaaaagcagaactaccattcgacccagcaatccctttactgggtgtatacccagaggaataatgaatcattctaccataaagacacatgcatgtgaatgttcattgcagcactattcataataacaaagacatggaatcaacgtaaatgcccatcagtgacagactggataaagaaaatgtggtacatatacaccatggaatactatgcagccataaaaatgaacaagatcatgtattttgcaggaacatggatagaactggaggccattatccttagcaaactgatgaaggaacagaaaaccaaatactgcatgtcctcacttgtaagtgggagctaaatgatgagaacttatgaacacaaagaagggaacaacagacactggagtctacttgagggtggaaggtaggagaagggagaggagcagaaaagataactgttcagtactgggcttaataccttggtgatgaaataatctgtacaacagactcctgtgacacaagtttacctatataaaaaatcttcacatgtacccccaaacctaaaataaaagttaaaaatcaatattacagtactttgttatcagaaagcacagatccttaaagactatattggcagtgaacttttttaaaaggctcgggttgcattatatagtatattttggaaatgtatttgtttaagagattagcatttccaattccatgacttcttcctttgtgtttttttccaggcctgtgtttcagttctgggttagaaacattttaaacctttcctaaattcagtagctctctcacaaattatatttagaaaagaaaagccccaccaaagttattcccagatcccttatccagtggaggtgggtatgcatactccgtttcttccccctctggtcttgcgcttcttgcccaattgaaatggagaattttgttaatcccatttgttattggaaagatagattgcctgtccctttaacaggatggccaaagaatgacaatcctgagccc

SEQ ID NO: 43972 - DNA, 1034 bp, Homo sapiens
tatgagagcatcacacatgaagagaaaggacttcttttttgtttcaactccaccatcactttctccacagtttcactggacttcttactttatttatcaccaagttctataattaacatatggttcatgttattgatttctcaggtttcaaagtaaaataaattgagctttcttccacatttagaatatacagtttttttaaggaactctaaacaaaggcacacattatttgtaagttggagagcagctgccagaaaacagaaaattaggaatggagtcatgagtgaaataatggagatactgttcagaggtaaccctttgtacagcaggaaattttccttagaaaagaagacagctgagtttgcttgtaaattttgctagaaacaggcctgatttagtaacatttagtgctggttaggaggctgaagacaacactttcagctttggataccaaacgagtggcctgttttatattttgtacacagtctaaatactttatagtttcaaaagatatgtgtgtaggagagagctattattaattttttaaatgatataataatatgtaaacaaatatttttcagatctggtagtagagttttctaagtgcgaaacagtagaaaatatcgcaaaggaaatgattcatgcattagactataaaaattttagactgaaaatattataaataaaactaaaaagcaaatgataaaatatttgcaaaaactatggcaaaggtttaatatccttaatatataaaaagctcttacaaaccactaagaaaaaggagattacccagtttagatatggataagaacatgaacaaatttgcaaagatgtacatatatacagaacgctggtagacatgggaaatgctcaacctcccaaataattagagaaatgaacaataaaaaaatgtaccataggggatgattaaatacattatgaaaatttatctagcaaaatgaatacatctcataggatgatttttcaaaaaatctcatattgttgaagaataattgcctaaagaaatacatata

SEQ ID NO: 43973 - DNA, 1115 bp, Homo sapiens
aatagcatgtagttagcataacagagtgatgctacagccttactcttttctctgcctttcattcagataaaatgcattagcagtttgaataattgtgtttgatgacgtagaagtgcctgtagtgcttgctgtatgtaggactatggaagaagctgaattctattatttaatgtccagttcaggaattgatctggaatgaggagaggggtacataggcatcccatatacccattaagccatcctaaatagcttgtttcaggcccagctagtagtacatcagttctgttgctgatcgtgtggtaggaatgtgtttccatatacatagttttactgtttgctctattttcaaaatttactatagtgcaagagtcacatcttgtaaacttgcccagtttaggggattcccattccacatgtaaaacattttttggttaacagattcagaagatattaactcctagagccacagtgccaggtctatatagatagaagctgaaactagattaatagcaactctaaagttggaaagaagataaacaatgaaactttcttatgaatactctcttaaaggctgtaggaataaaatgatttagtaaataagcaatgttgattttgccttcccttgtcagataatagcagccataaacttaacagtttaaatacaaaggatttctgtgctttagagttggtttgacatccctgtccttttccacttttcagcaacagctagtgggaaaggggttgtttaattgaaggcttcaggagaacacaccttgcacactggattcaacctttaaattaattgaaccctgtatctttgtattatttttaagttcttttttctccttgcttcctcttaccattgagttcttttctactctatgttttacattcctgtttgtgataaacttgtccatctgtcttcttccttctgtgctttcctccatccagtgtctctatggtcagatcaggaacctcaagtagggtctgagaggaagctgcctggctccttgggaaggatggattgatctggttctctgctgtcggctacttttgcccagtggacatgcgaatggaggagccatttaaggtgaatagattcccagccaagtcag

SEQ ID NO: 43974 - DNA, 1050 bp, Homo sapiens
gagaactaaatgttgaaagttgtccagaatgttccacactctatctgacttaagccagagctgttcgctttgcttttaaaaatacacttaactcacttatttctgagatcagaatctctttttcaagctctgtcgggtgaattgaagtgtgccttttttctaactagtcaagggaaaaatgtaagagggtttgggatatcagcagtcttcgctttttaacatttttcctgtgaattttctgaacttctttttttcagcccaccatgtaaagtatgtattgggatcttttaatttaccaaaaacattttggctttggcattcccacaatgcctgtcagcagggtatctcatttgtcacaaagtctccccatcactgacctctgcttcactgcagctccaaatggtgtgctgcattcagaggcagaataacagagtggttagaaaatcagattctggagccagacagtctgatttcaaagcccatctccactacttactgtctttgtactttaggcaaagtattaaacctctctaccactgttgctgtccattttttgtttttaaacagctttattgagatgtaatttacataccataaaatgcacctgtgtaagacttcaggtcagtatacttactgagttgcacagctatcaccatgatctaaatttaggaaattttcatcactccaagaagaaacccagtacacattatcagtccccattcctccacactctcccactgctcattgtcccaggcaaccacaaatccactttcgatttctatagatctacctgctctgaatatttcatataaatgaaataatggaatacatagtcttttgtgactggcttctttctcttagcataatccctttaaggtttatccatgtcatagcatgtatttgttcttcatttctttctattactaaatagtattccattgtatggatataccacaccttgtttatgcattcatcagttgatggacatttgggttatttacagttttgggctatcacgaatgatgccgcagtgaatatttgtttaccttc

SEQ ID NO: 43975 - DNA, 1029 bp, Homo sapiens
ttggttttcatagtttaattacaatgtgcctcattgtggatcttttggtctcatctgcatgtacttagtaaacactcaaataagtgatcataataatggtgcagaattaaatgattataatttaatggtaacagtaatgaccatgaatcatctaccagttaaacataatattgtgcttaaaaagtcaagaaaatgttcaatgcatgttaccaagaattccactaaaactttaattttaaaaaatagtttagggaattaagatgggtaagaatcaattatctaaaatattcacttacatgggacaaccagatgactaacagattattagtatatgaggtgttcctgtggttctttgcaaaagaaaacgtctgccttgaaatagataaacttgcagttacatttacaaattatctcccacagttttcattaccgttaacaccatgaaacattttccttattatctgagatacttctagaacaaagatcaaactctaaaataaaatggacttatagaaatatagcaaatcataatttaatttttataagtgtttgcacctgaacaaaacaacccaattttagatccttaagtttagaagttggtagaaataccagtttttccagcttctccaactgcagtgtgttttctaatattttaatatagtttgccattggtgatcttagaatatatttctagcatttttcttagttctcaacacaataattcccagaaattttgctctaatagatctaatttaaaaatataagatgttatattttaatttttataaggatctttatttttgaccaagctttattttggttgcttgcaccttgttacgttacaaagggtactgaattctaccatgtaggattttttttcttggtttatttaagaaacattagagtaatctgaagactttgtgagccatcgttgtttctcttttgtttcgtggtagtctgttactttgacctttttcaccaagtatcagaaaaataattttttctcatattcttttttgtagagtcact

SEQ ID NO: 43976 - DNA, 1056 bp, Homo sapiens
cttgcggtgctcctgctcacactttctttggtttcaagtgccctttctttgccacttgcttgggtaactcttgatactctgacagttaaattgtcatttcttctacaaagttttcctccacatatggatgggttgcttcttttatcatttcttaaaattccataggtatatacataagagacagaaagatgtatgtgtatgtgtgtgtgcggatttgaataagtatatgtgtatacacttatgtgtatctgtgtataccgcagacatacatacctcagcatttacagaatagttgatactttgtctacttttcccactagactctgaataacttaagaaattttattttaccctttgatttttctatacctagcatctaatctaatgcttagaaaataacaaatatttaataaacgtttgctggttaaatgcatttgttcaatgctatcgatcagatttttactgtggaaggctcactgaccagagtaggggatgagtacaaagagtctcagggcatttgggaaacaggataaaggccctttgtagaaaactggccaagggtgttgagtgcctgagctcagggaagtggcagtggatggaaaaatatttaggtggtggaattggtggttgattgaacatgtggggaaatgaaacaatctacgattatttgaaggcttctgggtttagaaaattatttggatgggggtgtgattcaccaaggggaatgaactgtgttctagacattttgaaattgagatgttcagagtattggttgaagttgtccaagagataactgggtatggagtttggagaaagtactattttggagagagaagttggagatttaccaacctctaggtactctttgaagctgtgaccataaaggagataactgtcatctgttgctgattagattgtcatagtggtggtggtacattggggaagaagagaataggtccaggagatcttgatattgaaggtccagatcaagaaggagagaggcctgtgaaggtttctaatttaaatcttggttctgcctcttgtctctgttctatg

SEQ ID NO: 43977 - DNA, 1052 bp, Homo sapiens
gagggaggggaaggaaaggagaagggaaggggagagaacgggggggaggggaggagagaagaggagacgaaaagagaggcggggtggcgcagcagctcacacctgtaatctcagcacttttggaaagctaaggcgggtggatcacttgtggtcaggagcttgagaccagtctgggcaacatggcaaaaccccatctctaccaaatgtacaaaaattagccaggcatgatggcgcacgcctgtgggcccagctactcaggaggctgaggtgggaggattgtttgagcctgggaggtgggggtgacagtgaaccgatatcacaccactgcactccaaaagaaagaaagagagaaagagagaagggagggaagaaggaaggaaggagggaaagagaatattctttctctcttgaaattaattttgggaggtgcttatgtggccaagagtggtatggtggagggagcagttcagagagatcctgggcaggacaccttaaccattccctgcctgtttcctcattttcaaaaagaagggctaaggcttgatgacctctagctttaaaattctatgtccctgtaatttcagatagagagagagagagagcacgcatgtatgtacagttatttaagaaagaaactttgaaggcaatttttccagttcatttcttagaaatttcagaaatattccattctctaaaagcttaattccagtgtttaaagaaaggaattcctgttataaataaaagttgttctctgctcccaatcaaaataaaaagagtgaaataaaatttacaattgattcaaaagtgtcgttattagctaattttgaaatttttatctattttcttttgtttatatttaaatataaataaaatattttaataatactgacttttctcacacaattcatgttagaatttcttagatggttccacatctgagaagtttcttgcttgtaaaggtaaaacagatttggaagctttataatgatttttaatccatcatttcggaagttactggatattggacaaaatgataaagtgttattttctgg

SEQ ID NO: 43978 - DNA, 1079 bp, Homo sapiens
aacaaacaaatttcaaaatgctgatagtcctgagattcagagctctgcatttcaaaaagacactagttaacaacaatttgtagaaggcaaaaaattataaaggtctgcagcataaattggaaaaaacacataagtccaaccatctagcattaacaagctcacattcatataattagcactcctaatattagtatttttcattaccatcaataggcaagaagaggaaaaccaagagtaaggatagtcttttcccacaattgtttgattgggagcgaggtgagatggctgaaatggacggagttaaagacaactggaaaatgtgagatttccttaagagtgtggctcagaactagaatccacggtgaaggttgttgaaattgttgttgatttgttttggttggctaaatttgtgaattagttgtatttggaccctgctagggaatcaggggtttaaaaaaggaagctaactagaatgaggcctaaggaatgggttagctcagtgactggttcttataagaggggatgcataccctcaagtgaaagggtctaggtaattccaggcaaccaagacctcaaatcagagctccctctaaattatgaatgcattgcctcatctctgttctcaattgtcctaatgtatatggttggtatattatgttttatatttttcttttcatgcctccatttataaaatgtcactaatctatatgaggtgatcaaatgaaacaaaccagtggagaagtgactcttaagattaattaaggtaggtaatattgagatctatgaatacggtagatggcttatataggttgaggctttacttctttttctactcatccagacttgaaccttgaagattaatttatcctacttgtcatagtttgatattaaccaagtctaatagattttccctttaaaacatttcctggtgcccattttttcccccttttcatactgtcccgggagtcaatcaatataaacctgtatgagtaacttttttctctctctcgtttgggttatgttccagttcatatgatgccttcttcccacatcacacatgtgccccaaaatggtcttga

SEQ ID NO: 43979 - DNA, 1064 bp, Homo sapiens
gtttgaggctgcagtgagccatgatcacaccacttgaccccaacctgggagacagagcaagaccctgtctcaaaaaaaaaaaaaattgaatgagaaaatttaaattaaaagtctgaagctacacatgggcctcagaaataacaaacactattacttattgattattggatattattgattacctaagagaggaggtcaaatgtgggttcacattccagttctgccacatgactatgtgtcttaaccccattatgcttcctacctctaagcttcaatgtcttcatttgtaaaattaggacacatattaagtgatgtctctgaagttaggtaccttttaagtgttttgttttgttttgttttgtttttttgagttggagtctcactctgttgctcaggccagagtgcaatggcaccatcttggctgattgcaatctccacctcccaagttcaagcgattctcctgcctcagcctcctgagtagctgggattacaggcacatagctaatttttgtatttttagtagagacagggtttcacagtgttggtcaggctgatctcgaactcctgacctcatgatcctccagccttagcctcccaaagtgctgggattacagacatgagctgctgcgcctcgcccttttaagtgtttgatacttgtcaagtacttagttgccttacttattcctctccttcagaatattttgtaggggggtggttttgttaataggattggtggcagaacttgacaaaatcttcaaattctaatattatgtgcatctctcattctcttggacaaaatgattaagtccattaggaatctctcaagtctgcctactttttctctggttaagtgtgacattatatcaggtagtagttgcaagggcaaggcataggtactacggacataggagctgttcaacaaatggttgctattagatggagttacactgtcatcttgaatgccaccttctgccatcttcaagtgctataattatttccacatttaatctcaagactgttcactcgaagccaccccagtttgttcttccttctgagagtcaaag

SEQ ID NO: 43980 - DNA, 1052 bp, Homo sapiens
aaacttcaaactctgaaacctggtgatctgaaagtagatgaaaattctgccatatttagaaaaccctcaaaccagtgcttatggaacgagtaaactcagattatcattcttacaattctgcaaaaataaaatggcattgctgtctgctttttcttgggcaccttattttaatcatttttgcattgccccgtgtgcctagcactcaattacctgttgaatagttgtatgaattaatgttgaatgtcagcttcccattagaatataggctccctgagggcaaaaatttttgttttgctcacgcattatctccagcatccagaacagttcctagtaaatatcaattgagtaaatgactgagtgaataaatagttaagccatgactcaagattactgttttcacagcaactttattgacagtaaaaatgtaaattaacactacaatttattagatattttatttttctattcactcagtattgcatttaaaactcttcaaaattatgtagtctctaataggtagtaaattggattctgacctgggaattaggagttatttaataatgtaatgattggcaagtagattggacaatgagatataccctttctaagctaattcatccactactgttttcattaaattacgaacataattttatgccaataatattgatattttagtgatattttaaatcatcatatcagtttttgcagattgaatttacatgttttgatggaagtttgtgaacatggtttaagattctctgggctgtgactgctcatttttgttttactgtaaaattagttatattaaaatatgacttctaaagagtcatattttatatttccctaaagagccttatattaatggccatagctgtccttacaagtagggatgtccatgtaatatgtatgtcatattaaaatattgacatgcattcccctaaagagccttgtataaatggctatcactgcctttataagcagtgaagcccaagtggccagtcccattatgaaccttgtcccattacttctgtttggggctaccattccaa

SEQ ID NO: 43981 - DNA, 1101 bp, Homo sapiens
ccactgcgccacgagcccccagccccgccggggggtgggtctccggcagagttggcttcgcgggtccctgcccccaccccgcacggtcgccccagctgcctccccggctggggcccccagcgccggccggagcccagcggcccccgtccgcccccagcgagcggcgcgggcggcgccctccgccgtccctccgccctccgccgctgtgcccaccccctcgccggagagagtgctggtaactccttccccagagtctgattacctgctccgcgaggccgcggacacgtgcggagagccgactgacactcgcagccccctcgggaggcccgacgcgactgggcccctcaggtgaggagctgtgcgctcgggtgggtgggctgcggggtggggggtcccgggggagatctgggggattggccggggtccgaggcagaactgtgggtggggtaagtggagggtggcggggggtgggggggacctgtgtttccttggaatcggctttggttaaccccttacgaactgagacgggattggttatgggggccagttttggggagctagaggattctccttatctgatgagagggggagatcccagcctagggacacccgcgacaccgagatcctgcttccacgtatccgtacgcacacacacccacacggaacacgcctcatacagtttctccaaacggaactggaactctactcggacactcacataataattcacatttagggtttaaaatgcactgcctctagggactccatgctggagaatgtgcttgcatttccccctcgaaaactccctctccagctcgctgaggtgtgggtgtgggctccaccttcccctccacgagataaatgttaacgcaggcttcctgcgggcgtgttatacacagaaaagtgcacgcagccggccagtgcccaggcttggagccccgcgaagacgcacgtttgctgtagtttccaagtttacttttataatttaaaatattggagttaaacacacgccccgcagtgagcagccctggtccccgcagcgcgcccgtccgtgtgcatatgggcgcatctgcgtgtgcgcacacgcgggagtcgcggtcc

SEQ ID NO: 43982 - DNA, 1021 bp, Homo sapiens
tgatgatgctacaattatttggttgcaagcaacagagtaagatgttctaacttaagcaaatacagagaagttgtcagaatctagcgtatctcatggaatctaagggcagaaatatagccaggcaactaaaagggctgtagcctgggagcagataagccaggagctctctccctctgccttttgtctttgtttttccttgcatatctgtttttacccttctctttctttacaggccatagaccatagggtctctgctccctccagttttcatagtaaatacatcctgccccaaagtttcctgagtacacatgtttctgttccaggcactcacagaaactaaatgcccatctttaagttccaattctgaatagcaggacaagaaaatctgattgatccaactgaaggcaggtagcctaccctggttcaataaactgtggccaagaaaattgagggggatgttgtcacatagtgtgaacatgtctagtgattgtgaaccctccagcaaaggactgagaaaggggtctttgtgaactgtacaggctgtctaggatattcaccagatcacctcatctgcatggctgctcccttataaggagagcagcgctgcaccctgtttccttaaccatccagtgaggttagaaatcaggctatcactatcctgctggttccacatcaggtaacaggttctcctgctctttcctgtcctaaaacaggtcaaaatttactcaaaatggtcttttactatttttttttttctcttttagccccagccttccacagagactaatctttcctttccctggccttctcatccgtatgtacaccctctcaacaatttctagatttccaaatctggtcatgctaagaatagactggatacaatttaatcactgcaatggcaattctgatcatcacaatcataataattggtgttgatcaaatgccttccagtcaaagacctgaaaataacattccaccccaaacacacacacaaacacacacatactttctgccagattta

SEQ ID NO: 43983 - DNA, 1057 bp, Homo sapiens
ttttttttctttcttttttttttttttttaaaaaaaagctcttctgtgattgagaggagaagtaattacctaggtaactactattgctataatttacattggtgtgaagtgacaaaggcttttgttacacattttttcttttctttttttttaaagtatgaatgcatattgacctgaaattttaaatttgggatcatagtgaatctgatacatatccataggcagaagctgccacacttcacatgaatctctaaatggttttgttagcttactgatagaacctatccaaaaaagtagcgtttatctaaataaacaaaggctgaggatgatcttcagtactcactagcttttttacaacttttcatagcagtacaccaccagaagagaagtggctttgtttggaatagcaattctagcattttatttggtttttacttttgtcattgtatttgggatgggtcatagtttgagggaagatcaactctttaataggaatgtgcattgatatatttctggacgataaatacaacaagaatttcactttgaataaatggaacagcatggaagaactctaaaattaaaattaagataggcaaaagcaactaaacaaaggaaagaaaaaatagcagttaatttataatgaattccttggtgaagttgtcaaatgtttgaattcaaccagtcagtaattacttattgggtaaatgttatatactcagaacctcagccacacaaaataagaagacattctttctttaagtatcttggcccttattaaactacagtttgcacagagtatcattggttaacagagtaagaatgcatttttaaatggtgattttaatatttgactgagcggaaaaatatgcccactccttgagttcttttataataaaacatgtggagagcttcatggatagtgtgtcatggatagtgtgtcagcagcaaaattcagatagtacaactctcttctgtttggaaaatacttcttcaatattttgttgtggtttttgtggtggtggagattgcataggtatctgctgcatataaagtactc

SEQ ID NO: 43984 - DNA, 1046 bp, Homo sapiens
tgcccagctaatttttgtatttttagtagagatggttttgtcatgttggccaggctggtctcaaacttctgacctcaggtgacccacctgcctcggcctgcaaaactgctgggattacaggtgtgagccatcacacccggcctctgtttttaatttcaagttctacctgttcatgctggtatataggaaagtgatggactttattatattaatcttagtatcagctctatcagctcttgcctcatgtattttgatgctttctgttttggaaggttattactgattcctgcaacgttgctgtaatcactcactagttttaggagtttttaatcaattcttttgaatcatatcatctgcaaagaaagacagtatttaatcctttcaaatctgtatactttttattttctttttgtcttttattacattagttaggacttccagtatgatgttaaaaaacagtgatgagaggcaacattcttaactttttcctgatactagtaggaaaacttcaagtttctcatttagagtaatgttagctgtaggtatcaaattgaggaaattcccctctattcctagtttactaagaattttttttttcacaaattgccattggattttgtcaaatgcatttcctgcatctgatgatgctgtcatgtgatttttcttctttagcctgttgatgtgatattaactgatttttggatgttgaactagccttgcataactggggaaagtcccagttgatcattgtgtataattccttttatacattgttgaatctgatttgctaatattttgttgaggatttttgcacctgtgtttatgagagatgctggtgtggtgtgtagtttcttttcatgtaatgttgttttctggttttggtattaaggtaatttgggtttcatagaatgagataggaagtattcttttggcttttgtcttctgagaaatattgtagagagttggcataatttctcccttaaatgtctagtagaattcaacagtgaacccatctggacctgatgctttctgctttagaagattat

SEQ ID NO: 43985 - DNA, 1216 bp, Homo sapiens
agagtatctaaaataaaaacgaaatcctgcaatttaataagaaacagatatttcactaaagaggagacacaaacgccaataaacttaagtagcttgctcttatgggtaatgaggaatattcagatggagatcacaatgaaaattttgccatcagtaaaatgcattgcaggtggatgtgggagttggcatcactactttggaaagcagtactgaatatctcatacagttgagtatccctgtaccttattatctggcagtcctacttctagcaatatgccccaaagaagtacttgcaaatgccctcctggaggcaggtacaatcatgctcatcaagcaacatttgtatagcacaacactggaaagccacaaaacaatagagacccaaaagtctatcagcaagagaatatattaatcttggtgtattcacacagtgaatgttcagagcaatagtgaacttaagcttgcccagcaatatggataagtgttttaaacacaatgttcaattaaaaaaaagtactagaagaccacctgtaatagtttgccattttggtagagctcaaaaacaggcaaactaaaccatatgctttaagcattcatgcaattataataaaactgtattttaaatgaatggatcgttaaacaccaaatccagaatgactacttctggttggggagaggtaagggcttaggctaggagagaaacacatgtactgggatggtttcataagagttcattgtgagtgcattcattatatactttatgactaacatactgtgttatgaatatgtataaaaatatagtaaaaagataaaaaaaagaaagtttaccatatctttcatataatatagtgacttatctgtaaatagctcattttcacattcatttatagtaacaggtatagtattttaaaatattctatttagtcaagaatttttgtatcttaaatatataatatttaatcatataagtctactaattcattcagtagatttttatctgaaatatttagattttaagtatctaaaatagatcagctctgttttagaaattggggaatcaaaaataaagtatgcacacgtagacactcacattttcttctgctttgacggtcttcacatcatcataataagtaaaatctgaggatattacagcagttaaatgtctcattggaagtgatagaaggactacattctgttatagctgttaaaattaagc

SEQ ID NO: 43986 - DNA, 3530 bp, Homo sapiens
cctgctggtaagtacattgttcttgagtagaagttgggtactgtaaatgccacaggggaagatcacttatgaatactagtacaaaacaaatcaggaaagaatagatctctctgcatacctagtttaaacataacttgtagcttccttccctctgttacacagcctttgaagttatgtttttagtagtaaatctgtagatacgtgaagctacaagtcaaatattttagctcagttcccccttttctggcagccatccaccgaactgcagggacaagttttcacagataaagaaacattttgtgggagtttttatttttgtgctgaaaaatgtagttcagtgatcttgctatccaaggcttttagtaagttgtgagcttggagtgagcagccttgtggttcataaggttaattaccatatttacaaatccattaatgacttaaaagaaagaactggcctgatagggtttatctctctaaaaattgcagccactagccaatcaggaatatagaaacccaaaagagatcgtagaagtgacaagagtaacggcaataatgtgttagtggagaagatgctatcagagcaaaaacaataagtggaaactaatcaaaacaattggtcattttaatgtactcatatcatatgtcttaagtaactggtaaatcatgaaatttgcttatttcacttaaattattttgcctgaattttattatgtaattgttattgcttatttaggatgcagcataatataatagattatattgtttgaattattaaatatcaagatcagagaaaattgaataaatcatttctacaagagatgcgaggaatgaatacccagaaaaagtatccaatgcatttttataagtatacgtaaaaaccgcattacatgtattgatagtgttatatagtctgacatgctttgtctagaaaacaattagtatagtatggattcttaccacttaaaaattactctgtactttgctttaaaaaaaaggaaagaagaaaaaaatctgtagcaattatgtagctggtcagttctcatgatgtattttgttggtaataacttcaagtaaaaagaaattaccaaaaagatattatggatagcttcattatttgataacagtctaaaatattaaatgtgcataattttgtctatgtagtgtttgaaaaggctgtaaacacaaatcaaaagaattttttcccattttgtcctgaaatcacttccatttaaaacaaattgttattaacagtttccttgcatgttgcttcagtttttccagaaatgtctacatagtgagacccctctttataaacagcgtaagctgaattatcaagggcgtatctcattatttgtctttctgtcacttatctttcctctttgttttcagtgtacagtattttctccaaggtacactccgatcggaatgtatacccatcagcaggtgtcctctttgttcatgttttggaaagagaatattttaagggggaatttccaccttacccaaaacctggtatgttctttgtgaggaaaaaaaagcagttaacgtactaaattttttgtttaatttgcataatatagacatatatgataaaatatcattaacattatttcaaatggtctaaatatgtgataaattgttgtaggatatttctcatttacagattagaaatttaattacagacaaaaataatttatttttgaatgttaaggaaagcatatttctggattctcagtcttgagttttatgtctctgacaagtgatctacctatattcacatggaaataattatagctgtaaacttatgattttctatattaagacctagattctcacatagtacattgatttttggaaaactatacatatgttgtagaggagaatgaaaaatggcattaggtaagagcttttaaaaagcttttacaataggagataattttatataactccataataatattatggagattaatttttccttttaagtgataccaattatgaagtcttacttaattcactattggtttaaatatgttattttgagtgatcataaatgccatcaagttaatgaagatatacaaagaatagcaagagaaaacatatcattacagctcttccttaagcagcaaataaaagtgaattttctgaaaattatattgtataagaatgtttttagcattagaattgatataactattctttttgaagattatatgatgaatactgtacctgaaaactcttccacaatatagttagccatgttcctaatagtattcaagaagatgaaatacggcttgtaaagcatttaacacagggccaggatgtgctaataaatgatgctgttattattgcttgtgattaataaatgctgtcgttagtacagttgttatggatttgtaacgtctttttcatcctatcctccagtgttttaaaattacattatttttgttttgatgagacttttataattttggaatatctttcatactcatatgatagtgtccagagtttcatgaacggaatatttcgcaaaagaatgagtacattagcatgattagggaattctcctgaaagatagttgtctcactggcagaactatatcactgttaggtgaccaaaaatatatttccaagaaaattgtatgaatctgctttctttgttgcatcagattttgaaacaaattaaacaaccaaaaggattttttttaacgtggtgccctaatttaaattcccagatgggttttgtatgtgtgtatttagttggctacaaatgtaagaaaaaaattttagacagaatgttttgattgaaactaccaaagcaacatgtgtgaaaataactgtcttatgtcttaattctctgtttcttatctaggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgaggtaatttacacctagaaagagcaaaactatacatatatgtgtgtgtgtgtgtgtgtgtgtgtgtattgtaatttgagttttaagtgttgaaactaaagttacctgatggtggtttttaatattttgtgcatggaaacacagtagataacatttggaaatgtgccattcttctctgtttataaagtttttgtttcagcttttatattaaaaatgacagtctaaatttgtgaaaaaaatatgaccttaaaagagattattataatatgaattctatttgagaaaataattgtagacttgatagacttatttgctctgtattttgaattcaagttttatgttcattgaaatatagccatcaacagacatatacccctgctacttgccaagcattgtgataggtgcttagggatagaatgataaataataggtgaatcttgcccagtcttcttacaattcaggggttggaggactgggatgtaaacaaatacttagccaacactg

SEQ ID NO: 43987 - DNA, 1059 bp, Homo sapiens
agaggccatatgcaggtaggaaataatgttatgatctgtctcttaataaagaaatatatttggcatgcccagacaggatgacatataaagctcttttcaatgtagcatgctatgacactaagcttattgatcaccaattagcaatggtttgcaacctttttccgattgacatttaaaaaacacacacatgaaatcacacaataatcaagatgtttagttccactttggaaaaactgaaagtaagtggttttagttggggaaaatatcatgaagaaactcttctgcttttttgtagaagattcaagtaatggtttcctctcctacttcatgtaaagaaaagtggccatatctcctagagaaatgaagtttacaaagacactgtaatgccttcttagtgatggattccacagccaaggcatggactatctgtgactgaaaaaaaaacaatagctggccaatgccagatgaatggcctgcagtactttgatgttgagtgaattaaaggtgaagggcagactgctgagaaaagcttttgattcaaagccaagattcataaagttgtattgataaaacacaaggtaaatcttagtgagaaaaacaaaaacaaaaacaggttgtctaactggctggatattgatctctcttaaaatatttctctacagcaattacctggcttaataattaaatttcaatttgactgtagtaacaacatgttaaaaaaataaattagaaaggaatccataaatgtatcaggctatgcaaactttgaaatgagttcttttgatgcagagacagcaagtgagatttgcctcttgttcaattcctatgtatacagggactctgaatctcataaagagtttttagatgttaaaactataaaatatgagacgagaagtattattttttgtcagtacttaacatttttaattatcagggatgatgatacctagttgcttaggcaacaatttattttaaaagatacagcagataggtggctgtttagtactctctttgtatcctcaacataccttaaaaccttcttaatcattcttatccaaa

SEQ ID NO: 43988 - DNA, 1085 bp, Homo sapiens
tttaaaattttaattatggatatgtaatagttgtacatatataaagggtgcctgtgacattttgatacaagcatacaatgtgtcatgattaaatcggtagcctcggttttagccggttgcagtggtcccagcagtggttgtagtcctagctacttgggaagctgaggtaggatgattgattacttgagcccaggagttctagtccagcctgggcaacatagtggaccccatctctaaaaacactactactactactaataataataataatctgggttttgaattgtattcttttctcattttgaagggttggatttttcataatttagcttaagttcagatttttactgaaaattcagtttgaaaaggaaatatgccttttacttctgatttattaaggtggggagctcttttaaagttaagtttgctatactccactaactgttgctgtcttcactttcctttccttttctcatgcccaaagtattttccttacttccacatgcttggtcctacccattctaccttttcttggattgtatcttatcagttatgctcctgttctttatccttaatctcttccccccttacatcttttcctctatttagatacaaaatatgtcatccctactaaaataaccaaccttctgtccaccttgctactcttcagtctatcatttgatctttttgcttccctattctgaccagtgttcttgaaagattaactgtaatttctgcatctacatcttgaccttttgcagtttggcttctactctcaccactttatcagaactccactttcaaggagtcaccagtaacttctcacttttcaaatctagcagtcttttctaagctctcatcctctttgacctttttgcagtaagtgaggatgttgatcacactctccttcttgacatctctcttctgttggcttatgttactcttcagacttcatttttcaacctctgtgactgcttctctctttctttgctgaatcatcctctgcttttgatatgttaatgtatttattaacatgttgttttgcttttgctgtccctcttaccttttgagcattctttcttact

SEQ ID NO: 43989 - DNA, 1032 bp, Homo sapiens
ccaattcaatttgctttttgaatcctgtaaaagccaactagactgcccttatgcaggacctggaaagtatgagcaatgatgcattgattcactagccaaggacatgtagtggtgttaaatcttatgctgggttagtaggattctaaaagcaagagtgtaagaaaaaattccatagacctaaaattatcctagtaaatcctttaaatagcccataaggtataatatgtgtaattttgtatataaaactctgaacaataattcttatgcacaacatagtctgagaaccactgagctagaataaaggaaggaacaaaagagaagctgcctgggcactcaccccattctttctttatggtaactacccagttcatggagaaatggagagttctatagagtgtctgcttgcctgcaggatttacttcattatgctttaagattaagcccctataatcttcagacacattaatagatgatttggttttgtaaggattgaattagacagtatatgtgaaagtaccttgctcaggagctggtgatgggaagcagttaaatctaaatgttgcttgtcatatccacaaatacattgttctttggaacattgtagagaagaatttggccacctgtttcttgtccttctagttgggatattccactatccagcaaggtcttgcatgtttttacaaattggttgtacctgtaaatcagttggaggttggaatgggtagggttttcaggtaatagtttatatttctttgggttctgtaatggctcctctgtcttctagagttcacagttttgtatgtgaattacctgacggaattgtgtaacccatctacctagactctccatggtggagtcatgaatatgtgttttagaattttttactatgtatattttgggggtacatgtgaatatgtattttgggggagctgcctacgtgcttcctatgtaaccagcatgttgcttttggaacatagccatcaggaaaaaccctgggggtggagtattttgccacaagagactattagcatt

SEQ ID NO: 43990 - DNA, 1086 bp, Homo sapiens
tctagaacaacaaacattttcaaaaccaaaaccaaaaccaaattaatagataagaactttaaacatattttggatatttaatatctatgtgaattttggattttctcagatatttatttctggtgttgactatttctgcccattttgcacagggttgcatatacagcaaagaggagttaatgtgtattatttattttatcaaataataactgggcttcgtatttagacattttatctatttttatgagaatttgctgtagatctacgaagctgttgatttaacacctatatttaacttctagtatgttaagaaaattgtatttcaaaacaaagtgggattttcacttgttagataataactagactttctctttggacattttacccatttaatgaaaatttgccatgtatttataaagctgttgaatttaccttatgtatttagcttaagttctagggttttagaaaacgatttcaaaacaaactggaattttcacttgtaaaatagtaattgtactttctatttggacattttatccctttttaatgacaatttgctatagatctatgcatctgctgacttaccacatatatttggcttaatttctaatatagagaaaatatatttctaagcaaagtaaaattttcagttgtcaaataataactggactttctatttggacaccttattcatttttaatgacaattgctatggatttacgaacctgctgacttaccacctgtatttggcttaagttctggtatggtacggaaaatttatttctaagcaaagtacaatttccagttgtcaaagagtaagtggactttgtattgaacattttatccatttttacaacagtttgccataaatctaaaagctgttgatttgcttcatgtattttacttatcctatagtatggtggataaattgcatttctaagcaaagtggcattttcacttgtctcacagacattgaaaataagggacaacaccagaaaaaactggttagcgacaacctcaaggaaataaagataacatgtatccagtttctaacactagttttccactggtgaaaatcatgcagta

SEQ ID NO: 43991 - DNA, 1050 bp, Homo sapiens
ccctgaataggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaaagactaactaaaatcccagttttgtctgtgtttaattctgaaggcatatggctaggagaaatgggaaagcagctgcttccttatggagtttggataggcaagcatggccatattaatttctcttgtggaaagctgaaagtgaatggactcttaatttgaaacaacaacaacaaaaatcaatgaaatattgcaactcaaattcccagttcctaaggaggtttccatcagctctcttccttaatgggagtccactttagagacaaagaggaaataagggttgggacaggaaggtcttgccacctcctcattgaacagaactgtgaactaaagccaggagaatgaagtcagtcgtccgtgaccacatggttaagcagcagcaatgctaggatcagggccgcgtgcccagctcacagagggagagtttttctgct

SEQ ID NO: 43992 - DNA, 1040 bp, Homo sapiens
tgcccaggctgatgtgcagtagtgcaatcatagctcactgcagcctgaactcctaaactcctgcgctcaagaggtccttccacctcagccttccgagcagctaggactacaagtgctcaccataacactcagctaatttttttttttttttttttttttttttttgtagagacagagtcttgctatgttgcccaggctggtctcaaactgctggcctcaagcagtcctcccacgtcagcctcccaaagtgctggaattataggcatgagccaccaggcctgacctaaagctgtagtaatttaaaaagtgttatattggcacaggaatagacatgagacattaaaataacaaaacagagagtccctaaatagaccaatatgtaaatgtcagagatctagcacatgataaaggtgatattttgaatcagtgggagaaggatggactgtatgccaggcactgttccaggcactgggatctagcagtgaacaaatttccacagtcagtatgtagatgtcacttttctccaccctcagctctccctggaatcacctagtccaccaaccttctgattactctctgaagagaataaatccctgatcttcttttcagttattttcaggctttcagtattccacctccccgttattattttttctgttatcttttctctgttttttgagtttttgtggctttatgccactactttaaccacaatctctatttatccttcatgtacagttcccatgttagtccataaaaatacttaagcttttgtatttaacatttttcaccgttttggaaagggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacggtaagagccaatgggctaccaacatttagtaacgtgtgatggttcacaaatgactgtgaaaaatagatttg

SEQ ID NO: 43993 - DNA, 1033 bp, Homo sapiens
tccaaacacataaatctacagccattttagcttgggggcatgttatagttacaaagatcttatagccatatcaatagaactttttctgctttttttctgttaccctcctttgctcatttgactttttttaaaatttagaaacattcccagtttgctgctgtttttcatttacttggcattgtctctaataaaacctagagtgtactctcttctaaataaagaggtcctacattgtggaggttgttcattcttcttcctagcattttagctcatctaacccaacctattttacagttatgggttgagggtcacctcaaaactaatgtcacacttcatgaagaattggatgacatagaataaaatataaaaaatgtaaacaatgtgagtgtgcttaacaccactgaactgtacacttaaaaatggtgaaagtgatgaatgttgtatgtattttatcataattaaaaataaatttttaaaaagagaaaaaatacttaaataaataaggagtgcgaacataaccatgactagttatcaccatctgatagtgcttcctttgcatgtaaatcatgcttttgttttggggacattcataaagaatagggattaactgaagtggcactgccatgtaacaatagcataattccagtttgttctacttaccaggcttgccctccatgaaaatatacaattgtagataatcttttttaattggagagatttcctcttatgtccaattttatacataaagtaagacttttttattgtgtgcctaaatttgtgtaaatatgactgcatcgtattagtaaactgaattaggtagtgcattcacataaaatttaacatcaccaagaaggctttaccttaagaatgtaatgatgaatcaccattttagatagactgataggtaatttattaactgatttaaaagagaaaagacctatatcatctcagtgagtaccaaaaagcatttaataaaattcaatactcattcctaaagttccaagcaaactagaaagataaggaaaattcccac

SEQ ID NO: 43994 - DNA, 1027 bp, Homo sapiens
agccaaagggaactttttgcccattttattgcttgtatgtctttcacagtcacagtctgacatgcctgcccaccattgcaaggcggcttttattgcatgtctaaagcaggctgtcttgctaaactctttctaaaccaggaagtaaaacaaaatcggtggtgtgaacacagtgggtttctaagcatttttcttgtttccttccattatgttggaggataaattcctggcccaaagttaaaataattcctacaaatgaacaggaatttcagtatgacttatccagtgaagcactggatataaagtgagctttttgcatgcagaattgtgatgtattttataaaacctcttgagattaatgtttgaggagctaggtaaagatggaagagatactccttcagtaatataaatggaagcgtgtagtatgcagatttacaccccccttccaactcactgtaactttaaagctgtctgttagaaggatgaaatgtagttgtgagccagaccatgttggtttggacagaaattcttacagaattattaagccttaaaaaaagcaaaggagatttatgcatctgcatttgaccaatttggtttggaataagttcataatggaaaagtaataaaaccataagagacagtgtcttctgagtacagtctcgcttttaaaaaatctaaacatgcactgccctattttggatacagtgactgtagaaaaatttcccattggtaactttgggagggttttctgttgttgttgttgttcctttttcattgattatcagccagtataaattttaagctttctgtcaaatatttttctggagatgtcagtcttagggaaaagaaatcctaaagtgttatctgtaggagtctccttctcccaatttcaccccctccccgaaacctccacctcccaccccccaacacacatagtgttttttagatatcagtaaagtctttttctggtgtaactggagaggttggggtttggagagtagggggtggttgaatgtgtgagagaaagcac

SEQ ID NO: 43995 - DNA, 1054 bp, Homo sapiens
attcttcattcttgcataattcatggggataaaataaactttaaaattctggcaccaaaataaaatgattgaaatttccatgactgttttgcattacttaagaacacatgcatcttgaaacaaaccatagttaatctgtgaactgcactcatgtccatccatgtccaccaaaacttttaatgattgcaaaatggataggtttgagtctttattttcttggccaatttctgcacgttttcatttagagcattaagctataaaaatatcagaagacatgtatttggttataggaagccacataagaatgagcagaagatttcaacagatcatttgttgggttagccaatctccagaaatctacagtgagctaactttagtgagcacagggcattgtaatctgagactgaggcgacacacactggatctaaggtgggtgagagaattgttagagacttgagagtgctacagtaacaactgatgaccttagaaaattggaaaaatatgacaaaaagatagacgtgtaggtatcctagagaagaggttaatgaatgaattagttccacacctcaaaaatgataatttataaccagctactgttgctgagactaaaacaagggagatagattaaacctcagtaggagggaaatagtttagatagaagaaaagataaccaggatcctgaacgttctcatgtactatggtgaaaaactgcaggagtatctgatcgttttccccaattctctttacttctagaaagccccagaatagaggagttgaggaactgatttttttccagaccataatcataatcacttattttatgttttaacactttgtctcccaaaggcatcctgagccatagctaagataacagacagtgcttgaaattttgagtgtaaataatttaacctagataaactggcatttaaatcttcatttctgcatttgtccctggctatttccccagctccactgtacagccaccttggggtagcagcccaaagagcctgtcagaactgggttgtaatgaaggctttgaaaggcgatagtgtag

SEQ ID NO: 43996 - DNA, 1051 bp, Homo sapiens
aagatgagtaagttctagaaatctcctgcacaacattgtgctgatagttaacgatattattttgtacacttaaaaatctattaagggtagatctcatgttaagtgtttttttccaccaaaaaaaaaagattttattttcattttttgaaagaggtgaggtaattggtcgtgtagatatggggatggaggaggggagactgtcgcaggcagaaaataatagccatttcccgggttctaagcgcggagtctgtttgatacatttgaggaacgttttagggagagagactataaacaaatacaaaaaatatgatgtcagaatatcctgtttgtatgtaaagcaggctaagtgggtagaaagcatggaagctatctgagcagatctagaggagtgaccaaagatgcattaatactgaactggcatgatatgggctttgtattccatgaagggttggagctgtgggggtctggaagtgatggccactttggaagtgccacaaacagtggaggctgggaataacagaggcctggactggagtcatatctcgggaccccacctgggccattccttttttttttctttcttggtttctttcttttttttttttcttttgaaacaaggtctgtcacccaggctggagtgatctgggttcactgcagcctcaacatgcctgactcaagtgatccttccaccttagcgtcctgagtagctgggactacaggtggcgctaccatgtccagctaactttatttttattttcgtaaaggtgagtttaactatgttgcccagactaatctcaaactcctaggctcaagcaatcctcccgccttggcttcccaagatgctaggattacaggcatgagccactgcacactgggctgttcctgagagctaatctgtatgacttggctcccgattggccatgggtgagaggaagggggccaaaggaaaggaagaagaaccaggtggtagctactggtcttgttctgttcccaagatatgtggttttacataatctcatgagagaagtaaggtaaccatcatttttatttt

SEQ ID NO: 43997 - DNA, 1026 bp, Homo sapiens
gcatttctaatatcttttcgtaagcagagatggttaaggcattgaataatccggccctgactatgacagtatgctcagtggcaaaggagaaaacactttagtttgattcctagccatagcattacaaggattcaaagcctttcacctcctgtccatttctatgttagtttcccctcaaaacactccccattctcctgttacaataccagcttcagtgtaattttatagctcatttcttatgtacctagattcctttcttttttcagatggcatatttgcctctgatatctggggaatgcttatcattggaattattaaatgtacaagctgacacaacaaaccaccaatttgttattttgatgaaaatatttttgtattttcagcagatggctaaaaaatgttgcctttgttatacagtctttgttttgacaaagacaaaaaagagagagaaagaaagctctggatcatttttccagtgaaacttaatctaaaaccaaacaatttagcacgtgacttctgagtgtgttccatgtgtttctagagcccatttccctggcaacctccacactctcccagctgtagaggtcaacacaatagacttgtcacaggttttaagtcgggtaaccacttttaatttggagaaattattacccggggagaaaataggctggtcctatacttcaaagaaaaaaatagaaatcaagatgcacacggcctcctgaattggaccgacttaatggtgctgtgtgcctcataagcagctgttcaaataagtagctgcccagaggaaatgtatattcaaatgcttcttgtcatttgcttctccttgcttcacacctaaaagccagatgcaagctcttccagggctaacaaatagatgccttctggtggctcattatggtaattactggccatatattactgccatgtgaaaagggttgtaaggcaggccagcccaggggcatttacaagtggtttatttgtgttgagctattaagaatccgccagttatcagatcaaccactg

SEQ ID NO: 43998 - DNA, 1043 bp, Homo sapiens
tgttacaccaggagctaaggcgtgcttctctgttcaagaaacgaaggctgaataaactgatactactgttttcggctatagcttgcataaaatataagttgtagcaagaagcagcagcaaaagtcaatcagaacattcaggtctggaaagagcttcttgctgcctgagtgcatggatcgttgtattcacagttcatcttgaagctggagctaatttaggacctggttctacttctgggctgaggaactttatctagaaaactgcttagagcagagtgagaccaaagaccaaaaccacaaaacaataaaaacactttctattcaaggtgaaactacaaaccgaaatttaagagcatattaggaaatttaatgttaagaatgaaactaagaaaacaaagtataaggagataaatagataaattcacacatggcaaaatgtaaacaatggaacaatctctatatgactttaaaataagaatatttaagatcctcaagtagatacagataagaatgttacccagcaagagaattttgaaaatacagtagatggatatgaataaaaaaccaagcaatctcacttctgcacatatatccaaaggaattgaaattcgtatgttgaagagatgtcttcactcccatgttcactgcagctctattcacaatagccaagatatagaaactatggaagtgcccattgatggacaaatggatttttaaaatgtggtatagatacaaaatggagtactattcatcctttaaaaagcaggaaagtctgtcatttgtggcaacatggataaacctagaggacattatgctaagtgaaataagcgaggcatagtgagacaaatagtgtatgacatcacttatatgtcaaatctataaatgtcaaactcaaagaagtagataatagaacagtggttaccagaggctgggtgggagtggaacaggcagagaaaggagagacattggctaaatggtacaaagtttcagctggacaggtcttcctgttctggtgatttattgcagaacatggtgactatagtt

SEQ ID NO: 43999 - DNA, 1027 bp, Homo sapiens
gcactctttctcagagaagcttatagaaaaacaaattaattggtcatttttaatattgaaaaacaccagtgtgacttcaaaaattcagatcagtaaagaaattaaaagaccatatgccagggatgttcagccttttttcatgacataaaatgcattttccaagcatttctgatcttccaagtgagtgcatagatcaaacacagaaaaaagagagcattgagatttagttttaactgagcactcacactgtgctcaggactgggctggcactgagcactacacttcaaaggtacaagaggaatattagcaaaacaccaccctggcagtccctgggccctgcagcctggagagttgcaggccactgaatcacacatcccatcctctaatttcacttgggattcatcggcctaagtaacctaattgagtgtcataattgatttgggagactcatttccttccctggaaatcattaaaggtggctgcgtcatgcttaaaatagcactttttctaaaggaatcccctggactcgttcatgaggaagaaagaccctgtcagcaggtggcttctcagtcctgccggtccatgacctgcccagacctgccctctgcacaaaggttgctagtggctcctcgggcctccccaccaggcgcctttcagagtacacaaaaagggcatactgccattcctaatggaggcagccaccctgggcaaagggctggccactggcgttgttgtggtcatcaccccaattagcaagacacactctgtgccactaaagaatttttagcaggaaattcttttgtgagtgactcaacttccctgcatgaaatacctagatattgtgacttctttttcgaagccaatgttaaattcctaattaaactcttacctttgaggttttccaaccgagaaaacccactagaggtggccctaaggaatttgcaattccttctgttggatttcaccagtgagaggtgaagctgggaatagccacactgctgagaatacctttgtagtcacaggaggt

SEQ ID NO: 44000 - DNA, 1155 bp, Homo sapiens
tgaatagtcagttttttaaaaaattatttttatttcactttaagttctgggatacatgtgcagaatgtgcaggtttgttatgtagatatacatgtgccatggtggtttgctgcacctatcaacccgtcatctaggttttaagacccgcatgcattaggtatttctcctaatgctctgcctccccttgcctcccaccccctgacaggccccagcgtgtgatgttcacctccatgtgtccatgtgttctcattgttcaactcccacttatgagtgagagcatgcggtgtttggttttctgttcctgtgttagtttgctaagaatgatggcttccagcttcatccatgtccctacaaaagacatgaactcattttttctggctgcatagtattccatggtatatatgtcccacgttttctttatccagtctgtcattgatggtcatttgggttggttccaagtgtttgctattgtaaatagtgctgcagtgaacatgtgtgtatatgtgtgtttatagtagaatgatttataatcctttgggtatatgcccagtaatgggattgctgggtcaaatggcatttctggttctagatccttgaggaatcgccatagtgtctgccacaatggttgaactaatttacactcccagcaacagcgtaaaagcattgtgattgctccacagccttgccagcatctgttgtttgctgacttttttttttttttttttttttgagacggagttttgctcttgttgcctaggctggagtgcaatggcatgatcttggctcaccacaacctctacctcccgggttcaagccattctcctgcctcagcctccagagtagctgggattacaggcatgccccaccacgcccagctaatttttgtatttttagtaaagatggggtttctccatgttggtcagggtagtcttgaactcccgacctcaggtgatctgcccgcctcggcctcccaaagtgctgggattacaggcatgaggcaccacgcccggccccctgactttttaataatcgcctttgactagtcagttctagtcccaagatatacaatgttacttttgccatataaaagtcaattgttttgtgggtctttctctcttctctattttattcctttggtctaatttatttctggtt

SEQ ID NO: 44001 - DNA, 1033 bp, Homo sapiens
tttttgaactgtgtaaagtaagacatattgtcttcatctcctgtgattctaaacatgaacactttgtgtaattgcatacaacttttattctttctggtctttttacaaaggtagtaaaatagaagcatatttgctatttcttatccttaggaatttaattctgtcaatgttaattttctaccaatatcaaataactcagcagaaattagaatcatagagtgctgggacctaatagattggtgattctcaaactggaatggagattggggttgtgagaatgtactgtgtcatattcatgtataaatctacctgatttcatttatttattgaggtaaaattcatgtaacataaaattaagcatttgaaagtgtacagttcagtggcttctagtacatcctcaatattgtgcaaccatcatctctatttagttccagtattttcagcatcccaaaaggaaacacagtacttgttaagcagtcattccacgttctttcttgccctaatccctggccgctgctgatctgctttctatctctaagtatttgcctgttttggaagcttcatataaatgaaatcatacaatattgtgaccttgcgtgcgtaccttttttcacttagcataatgttttcaaggttcattcatgttgtaccatgcatcagtacttcattcctttttatggctgaataatattcatatacatgttccatattgtatattccaatttataataatactatatggatatgccacgttttatacattcatcagttgatggacattcagactgtttccaccttttagctattgtggatagtgctgctatgaacgtacgtgtacatatatttgagtacctgttttcaattcttttgaaaagaaattttatatatatatatatacacacacacacacacacacacacacacacaagtggaattgttgggtcatacgttaattctatatttaactttttgaggagctgccaagctgttttctacagcagttgaacaatttatgttctcactagcgttcgta

SEQ ID NO: 44002 - DNA, 1064 bp, Homo sapiens
acatgtatgtatagtatagagaatttgtaagtgttggacatactattttggggcattataccctatcacataagctttttatgtaatatagttaagtacataatccaggttaatacactgtttaaaatatccatccaaaatagattctggtttgtcagtgttagcactatttttcttaacagtgctcatattaattttaactgcttaataagttgtaatagaaaggttatttctcagattcctcatctatgataattggaagggtggtatgctattacgtagacattagtgcttcttactgcttaagataatggtattaaggctacaaagtttatctagatttatcagataattaacgaagaatttggccagctctttcgtctttgtttactcagtagtgtcataactatgaagtactgtatagtaatacgaaagaactatagaggtattgttatgaatcttttttatatgttctacctaaaatgttgctcacagtattctttttccccctcttcatgagccagttcctttttcctgggactttatctctactttttcctttcctttcccagccattaaaatagggtgagatggttattagacgagggagagatgctttatctttgttgtaaatgatcatcagagtttaactttataaactaaaaaaattgtaccattcttaaatatttttcccctctctaagttaaaagaagtaaagtcaacttgaagacatcacttaataactattgaaataacattttgaatcaaatcataattagatgaaaaattttgtttcttaaaagatagttgctttaaaagataaggctctacagtatttttcaaagacttacaaggttagcagaaaagtgtaaaatattattttatatttctggcttgaatcttttgacacatgattatttcctttttagggaccaatgcagatggaagcgacctacttaacagtttaggaagctggttatttggaagtggttcaagctgagtagaatctgcttgttgtcttagaaccttgaaacagttctgttgtgattttgagttatgtcacc

SEQ ID NO: 44003 - DNA, 1053 bp, Homo sapiens
cttgggaagggatagtgagaggtgtgaaccaggatattaaacactgaaaaactctttgaaaaactatttggttagctatttcattggttctatggaatgagcaagcagtaagcaattgtggtttaagtagtgtttaatgttactacttgtttgttaaacattactcattgaaagatgtgatgaactgcgaaaacattgagaggaaaataagtttcaaaaactgtatacagttgaccctttaacaacatggtttgaagtgtgagggtccatttatacacagatttttttcaactaaatgggaaaaggaagtacgatattcacaggatatggaacccacctgtagagagggctgactaccacttggctaaccatgggacctgaatatacatagatttgggtatacttgggctgtcctggaacaagtaccccgagtataccgagggatgagtgtactcttcttcataagtatttaaaatttaccaaatatccttaatcctttgtctggttgtgtactctggtgtacatgtaatgtttggtggaaattgtattgtttatattctaggacatgtttctctactcacctctctcatcccacaaattgcctttccagtgattagcatgtatgtaataaaggatttattcatttgacatgtatttgttgagtgtttcctataaatctggtactgaaaagtacagagagaatggtattagctgccatttatcagtactaagtgctttacatacacagtgtcattgagtcttcatagctctttgaggtataagttttatacctagggatcagaaaaatttaatttacccaaggtcacagttaattagaggctgtcttgaagcaaatttgacttctatagatatttgtctttgaacttagtaagtagtagttaagggagagaagaatcagtggttttaacaccaagctagagtgctttagtattttggaagtgtttatcctggggtgggactcaaagcccttttctccctaccaccaattaaaccatagcaacattgcctttgtttctcttacctgttgggctt

SEQ ID NO: 44004 - DNA, 1028 bp, Homo sapiens
tcagattgtcccatatttgaacatgcagaactccttcaggctgtcttctgtgtccttttgccatgtctccattattctttgtgcatttcctagcattctggcacaaggtgtattccaaactaattttatatgtgaaatcagccgttgctccaatgtgatttctttttagtggagaatggtatttagaatgcagggtcttcactttgcttatgtttattgcatttgggatattcctgctcccagaccctctaagtggaaggaactagggatgtacaggagtgtgtgtgtgtgtgtatgtataaaaccatgggttcacacagatgtctccaattgcagttcaacaccactggattcattctagttttttccctttctacatttgttattcccttctccaatagtgagaaacctggcttccattatcttcaatgtattgtctatttggtcatcccccttcctaaccaatctttgctgcccccaacaggtgcccttcttgcccaacttgggctccacattttatgccaggccaccctcccatcctctagtgtgggtgacttcgttctgtccaggctctgacacaccagccacaccatgctgcccctctccaggaatgccctccttgctctacttgggcttagacacctcatcttagacctggcatatcttaaattttgacagatactctcaaattgcctttgagaagggttatgccaatttatgttttcatctacagttcaccttttccctcataagcttgctacactagatagtaaacatgttagtcattactgacctcatgaatgaaaaataaaattgtatcattttgatttggattgatttttttaagtaagattaaccattatgtttttctctgagctgttaccatcttaatcctcaatttcattatctgtaatatatggctaataatatttattagagtcatgaaagaattacattattgtaatggttggcctgggctaccataacaaaatagcatagactgggtggcttaaacatcagagatttat

SEQ ID NO: 44005 - DNA, 1048 bp, Homo sapiens
acagcaggatttgtatttagcggtttatttagatccctaagaaaaaaggcttatgtgacatagattcataagacacaaatgtgtccttggctgaccatactaggcttcactcccaaaggagaaaaagaatggtcggcgcatctcagattaacaccaaccaactgtgcaatatttcattttagaaagcgtttccttgtattatccatgattaaataaaaagagacctagtgtatttgattgcttctgtggcaaggcttgagaattacaaacctaggtttccctctgggaatgatcattggatttttaaaattaagtaagtggaaggagattaagatttatttccatcatttcaaatcatgatctgcacctttggaaacaaaaaggaagttggaaagtgggaaggtgaggtaggtgtgcaagaatggggagaaagatgctgcaagccaaataagactgtataatttctgagaaaattaaatgaacaatagagtttgaaggataagtgggtaatgaggaatatgagataataagatattaaaaaatagcaaattacttgggaaagtgaggatgaatgatggtagatagttaagggatttgggatggcaaggaagggaagagatgactagggtgggaaacaaaacatgattaatggctgtaaaagggcaagtttggactctcgatggcatatcttcccaaactttggagaatgtgcagaacttagtaataaagaaggaaaagattaaaagagttcatggttaacatgaaattgtgaggacaacagaggaagcaataaatgtcattagtcctcaggaatgaaagcatttctagagaaacgtactagtctatgttcttcatttatgagcagaatagttttcatctactttttaataaaaggttaatgtataaaatgaatgctattaaaggaaagaaaagctaagcattatcaggaaagttgaagaaaagattgcacctagaacaactgaagtaaaccagcaaacctattttacagccttttctataaaattttgaaattcatcatcttaatgaa

SEQ ID NO: 44006 - DNA, 1030 bp, Homo sapiens
tgtcccttttacctactctgaactcttctttttctttttcttttctttcagacagagtcttgctctattgcccaggctgcaactggtgtgatctcggctcactacaacctctgcctcctgggttcaagcgattctcctgcctcaagctcccaagtagctgggattacaagcatgcaccaccatgcctggctaatttttgtatttttagtggagacggggtttcgccacattggccagggtggtcttgaactcctgacctcaagtgatccacctgccttggcctcccaaagtgctgggattataagcatgagccactgcacccagccttatactgaactttcaatgggttcaattccactaggagcataaaggccactgcatatgagttgtggaaagaagagattagaagaaggaagaacttgagatgagttcctcccttcaacattctgtctcctcctacctagcatcttctttcttttagtctttctagaatgtccatctgtttttggccattgcggagagagaagctgagctttaaaggagtaggagcttcaaaggcgtaggagcttcaaaattcttgtttcttcatgtttgatcacccttctaaacctgtcttctgttccttctgctattcttttttcttagagcataggaaaggggagcttttaaattaatacttaaagcatggaaaaaaagaacttgagaagaaagtaaaacaagggagatgaggctagtaaagtaaggaaaatgaagaggaagaggaggaagggttagcttctaaattccaagtcaaattgatatggaacaggcaagccgcttgtcttacttaaacttcagaaaaggatctgctgaaacttgatagaaatggaaagggaaatccttggggtggggaacctccaaacattagtaatgatattgaacaactcaaagtattgaggaaatctgcaggctacatgcctgaagattacccatgcagatagaccaaaaggattagaattatctgttgatattagtaatatttattgacatc

SEQ ID NO: 44007 - DNA, 1029 bp, Homo sapiens
tccagcccaggcaacagggcgagacactgtctcaaaaaaaaaaaaaaaaaaaaaaaaaaaaagacaacaattcacacatttcattgctcaactttttatccagctgtggtaattagcatatttggtctttgtcaaaaaataatcactcatttttcttttgggggagaaaaagacttactgaacatctattaaaacatactactgtcccattaattttacaaagataagtagaacattgtttttgttctcaatgaacttaccatcaactagtggcaaaaaggtgtacataagtaactataatacaatgtagataacattaagtaccaaaagagactgtaatcccagcactttgggaggccaaggcaggaggatcacgaggtcaggagatagagaccatcctggctaacacagtgaaaccccatctctacttaaaaatacaaaaaaattgccaggtgtgatggcaggcgctagtcagtagagcatgagactcttaatctcagggtcgtgggttcgagccccacatcgggcgccagatatcgggggaaattcacccccgatatttcatgtaggttcttttctattttccctaagtgttggccagtctgagaaataaagggaaagagtacaaaagagagaaattttaaagctgggtgtccggggaagacatcacatgttggcaggttccgtgatgccccctgagctgtaaaaccagcaagtttttattagtgattttcaaaaggggagggagtgtacgaatagggtgtgggtcacagagatcacatgcttcacaaggtaataagatatcacaagataaatggaggcagggcgagatcacaggaccacagaactggggtgaaattaaaattgctaatgaagtttccggcacgcattgtcattgataacatcttatcaggagacagtgtttgagagcagacaaccggtctgaccaaaatttattaggtgggaatttcctcgtcctaataagcctgggagtgctatgggagaccggggcttatttcatccctcagc

SEQ ID NO: 44008 - DNA, 1016 bp, Homo sapiens
tctgataggatgtccctatcagagagattcagagtctctgtaaacaattatctcttttgtaagaattacgtaagaattaagtagcatgaaggattataaagtagcatctagaatcgagagagagaggagacttactactaatcatcactgattttcatttatcagatttttgggcacctgctgggtgccagatcttgttaggcacaaatgactaaaacagagccaccaagtattaaaaatatgcatatgagtgttctttaaaaggcactgcagctatccatattatgaatactttagcattttctaagtgatgggtgattcaaagggtctcatacaagttacagtcacgtcttaacattttctgtttcgtgaaatgagactaaacacaagtatttcctgccattttaagccattttgctcttatatgcttattcttacaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaccattgctgtagtcatttatgttcatgcagtctcttcataagaggtaactagaactgttttgctgtatcacagtaaagtggagggtaagctaggaaaagggaaaatgatcagatgtctgcaagaactcacagccctctcctggcagagctgctttagatgacatttgcatcttgtgcccgtgtggcttccttccagtccttgcctcatcttagggacgtcatcaaaggactacac

SEQ ID NO: 44009 - DNA, 1079 bp, Homo sapiens
tactccaacttgagttacactatagctatgttattggtgttaagagtgagtcagtgaatgttctttagaattctgtgtagtgatttttaaccaattcaaatactactattatcacagtttatatatttttctcttgttgaagttgatttcagtttataaaacttggcggattttaaatagtaaaactatgatcttggtgtttatcaggaatatacatcttctgtccctgtcttatgcaaggcacataactaggacacttccacttcctcttttgcatgtagggggcttggactccagcttggttgctgccactctgttgaagcagctgaaagaagcccaagtacagtatcctctccagacatttgcaattggcatggaagacagccccgatttactggctgctagaaaggtaaggtgctgtctctgtcccttgtgtagtgtagttagagtagacttgttattagaatgaaaatggagtcaataatgggtgattctactgctgctgtattgactgggtcaattgttttaaattgattgtattaaaatagaatgaaatggctgttggatatgcactgtgttgtacactgtcctctgtgtacttttatctgttatgacccatgcaattctcacaaagaccctatgatgataagtatgctcttttgaaagtaaaggtgtctgggcatggtggcctacacctgtaatcccagcactttacgaggctgagggaggtagattacctgaggtcaggagtttgaaaccagcctgagcaacataatgaaactccatctctacaaaaaaatacaaaaactagccaggcttggtgacgcatgcctgtagtcttagccttatgggagcctgggtgacagagtgagaccttgtctcaaaaaaaaaagaaagtaaaggcataagtcaggtgcagtggcacacacctatagtcccagatacttgggaggctgtggggggaggtctgagctcaggagttcaagtccaggctgggcaacgtagcaagaccccatcttgaaaaattaaaaaaacgggttttttgttcgtttttttttttttttttttttaaacgtaaa

SEQ ID NO: 44010 - DNA, 1053 bp, Homo sapiens
ttttggtaaaaataaagtttaccactacaataaaatacagccagaggtgtactgggagtagaaggagactgaatgaaagaaaggaggaatggggtaaaggctggggcaaagagcaggccctctccctgcaggggagtatcagggcctgcagccaagtcaaatgacagcatgacgtcaggaggcaagatttgagggcttttatttaaggtgcagcattggagtttggttttaggagagtaggaagtaatacatccgttacccaaaggacccttctcctttttaaataagttacctgcaaagtttaggccaaagaggtgggtaaggtagatttgggaagctgttgcttactaatatcaccgaatgctttatggtcactaacccttcaggcagttcagcccagaagagtcagcagaagactgtttacaggcccccacctgctagttacagatcatccctgatagagcagagaggggtgaccaggtagtgactttgtagtcactggaggcaaagcccatttttggacagttcagtgaggacttatagacaaaagattcacaaattatggagtgagttggatggagtgtgaagcatatttatgggtcatgcacatacataataggtttactttttgaaatttgaaagcatgttttaagcttatctaggatttccacctgatttaaacctcttctttctctaatgtcagccaaaaacccgagtacaaagaagaaagaggaatacatcaaggacttttcatcctcatagtttgccattaatggctcatagtttgccgttgatggtggagagtgtcagaattggggagtagcctaatcaaaccttcttactctgcatgcagtggcagacagtccctttgctgttcttttggggaatgcagactaataaagcgccaccgtcattttatctatcagtaaggagtagctttaatgctgctgcagtggtggaagcactgggcattgtcatccacccctggggaccagcagctttgttttggatcatgtatctgttattgtgatggagccatttatttttcaggga

SEQ ID NO: 44011 - DNA, 2174 bp, Homo sapiens
tttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagaggtctgtttagggacacaggcgaccaagtacagaaaaaggcaaaagaactagcatgcctttttcaatggctgtcattttgcagggctggcttcagatgattgttatagctttaaataaaaaggacagttttcatctcggcccgtggcctacattatttctttactgtccattgccctgggcgcttgactaataatttaacagcagtttttttttttaaattttaaatcatgattcatagcattgctgtaagagtaattagaggtaaagtagggcttgaacctgtctgtagttggttacttactgagatcttaatataaaagtaaagggagagggtgaagttgtaagtagcactaagtggaatagaaattaaatgcactgaaactgccatgtccagttcggtaggcgctagccacctgtaactgttgagcacttgaagtgctggctagtcctaactgagatgtattgtgttaaatacactggattttgtcgttggagtaggaagaacagtgtaaaatatctgctcgataatattttatattgattacatatatgttaaaatgttactatttgggacatactgagttaagtttatttaaaattaatttcacctttttcttttaatggggctactagtatatttaaaattacatatgtggcttacatatatatttattggacagcactgttctagaagtttaggaagaaataagaaaaatattgagaacaggtagcggcagtaggaactttgccctcctataagactgattccaataaaaataataggttatagttttaattggctttttcctactagaaaaaataagtgtactttacatgcctctttgttctccctttttcccctccagtttagtggttagaatgtatttattatagcaggattaatacagggattcactaagcagcgttaagaagacttaggtaactgattccctgatgaccatacttgattttcaaagcactttcctaacccgttttaaattgatatagagtcaaaggcagatggcttattagtagtcatctcatttaaatcttatggaatttttccagtaaatctcaaataatttgttataggctatttgggctatttggtcaagtgcatggaagagacagcataggacatgtggtacttcatttccaaattgcttgagatgattttcattctaaccatatattatttggttctggttttccggaaaagccagctaaacctttggttcttttagatataaatgaaatatcatcaaagaatagctcaaagtgacttatgcaacttgaatgtatattttttccttagggtgtttatcccaaactatttgggcatttgctgcaattcgcagtttttttaaaaaaaacaccaaaatagttatttttcaagttagagatgttttaattaaaacatcttgtttttggtgtatccattgacattctcaaaacggaatgtatctggacctctgtgtacaatcttcgtagcactcagacactgaacagaaaggcagtcatcactgccaaacagggcccaaatgccacacatggtgcaatgtgtcattttgagctggcagcagccaaataaaacagccctttatttcacagttgagaatttgaaattggaaagtaattaacgtatgtaagggtgatttatttgcttccgggcttatagggatgagctaagttttttattagggatgttgttggtgtatatgtctcacctactttgcttccttactgaacaatgcaactttgagacagaaatatttgagaacatttttgtcagtgaggacattttgatagtgaatattttgtatcttctattaacttgaaatgttttatttgttataaagccaggatatctgatatcaaattaaattgttttttttttccctttagattttcttcaatcacatctgaataaatcacttgaaggtaacctagatgtaatatagtgaaatgcttgaaagagctgcgtatcttttacacttacagcagtatgattttctgttgtacccattat

SEQ ID NO: 44012 - DNA, 1022 bp, Homo sapiens
attatgattattttttccattttattgatgaggaaaccaacacatagaaaggtaaaggaacttgccaaaggtgacggtcacacagccaaagagctgtagaagcagcacaggaataccagcaaactcacagccaagctctgcttttcaccttcacatcatacagtcctcagactaaaaccctaactctgaccttccaaatcaaaaatcatactcaaggccgggtgcggcggctcatgcctatcatctcagcactttgggaggccgaggcaggtggatcacctgaggtcaggagttccagaccaaccaggccaacatggtgaaaccccatctctactaaaaatacaaaacttagccaggcgtggtggtgggtgtctgtaatcccagcattttgggaggctgatgcatgaaaatcacttgaacccaggaggcagaagttgcagcgatccatgatcatgccactgcactccagcctgggcaagagagtaagactctgtctcaaaaaaaaaaaaattgcctaataatagcttggaagtgcacatgtcttctgtgaaggttgatggactacaattagcttcaaaacacaaataagtaactgtgtttaaatgaggccttctgtgtaatatctagggaaaatcaatgtggctattcaaatttgtttccccttccaagcacagagaagttgctcatgactctgtgatccgttttgtccaatgaaccatgagcagcagcagcaacttgagtcacctccaggtggaagtgttaagaggctctatgatccaccacattccgtttcccctgaagggtgatcaaggacacatgcagagatggggcttttgtcagcctggatccctgagtgaacacaatgaacagaccaccacacaatgccctaacacagcccagacatgcaacgtgaccaagaataagcctcactgtggccaggcatggtggctcatgcctgtcatcccagaactttgggaggccaaggcgggtggatcatttgaggtcaggagttcaagaccagc

SEQ ID NO: 44013 - DNA, 1053 bp, Homo sapiens
cttggttgttgctaccttttggttattatatatattacatgattccatttatgtgaaaggcccagaataggcaaatctatagaggcagaaagcaggtaagtggttgccaggagctgggggaaaggggaggggatggagagtgcttgatggatacagggttattttttgggggggcggggggtgttaatgaaaatgttttggaactagacagagatgatgattgcttaacattgtgaatgtatttaatgatactgaagtgtatggtttcatacagggacttgtatgttatgtgaattttgcctcattaaaaaaatactgctaggagcaatggctcatgcctgtaatcccagcactgtgtgaggccaaggtgggcagatcacctgaggctgggagttcgagacctgcctgggcagcatggtgaaaccctatctctattaaaaatacaaaaagttagccaggcgtggcggtgcacacctgtaaccccagctacttgggaggctgaggtaggaaaatgggttgaacccgggagacagaggtagcagtgagctgagatcgcaccactgcacttcagcctgggtgacagaacaagattccatctcaaaacaaaacaaaacaaaacaaaaacacacacacacacacacaaaaaccaaaaatactgatgcccatgtttcatccccaagggattctgtaataattgatctgggctgcagagcccgggcactggggttttaaaatctccccaggtgattctgatgtgcagctgtgtttgagaatctccttctggaatgaacttgttcatgttttacttctgttgttttctagcctgccaatgtctttctgtttcccttcacatctttggggggtaatttttacaatgcagtcttaacaaccagctgcctcaaaatgcactgggatccctcgtaaccaggtagctccccatctccaattctgacctgccaagtcagaatcttgtgcgtggggcccaggactgtacatattgaaacaggcagtgacctgggaactatttctgaacacccctaggtttcccctgtg

SEQ ID NO: 44014 - DNA, 1059 bp, Homo sapiens
agcacaattgaatgcacactttccaagtttttggtcatacagattaatattccagtggccaaagctagacacaattcaaaactcaacattagggactggagaaatatactccgattcttcagtgggaggaactgcagagacaaatgacagagtcttggatacagggaggacatgcatccattaatgtaccttaatcaatcgcaaccctctaaccaccaatacaattaagtaagtattggttgaatgcacttgtgcctgaatgcttctggctgcagcccaggcaatgggggcctgactggggagggaccatagcagggactcgatgtcctgcaggtctgcatgtaattgtgcacggccgactccacattggtcatggatgacttgctttatcctgcgtccccaaggggcaacgattggctgattatatttctgaacaattttgacaaagttgttttcaggagcccaggaagcaaatcagttgtagatttgaattttgcagggggtcagaattgttgaatatatatatagacttttacatgctgataattatttccacatcacaaagatggccggctattaggaggctgctgttcaattcctttgccctgtgaactcatgagctgtgtctatgtggggggcactcagttgttagagctgttttccttcataataacatcagccaacgttctaaataaattcaggaaattaaatagtcttccccagacaggtactttgcccttctaaagtgaattacacattctaaaataaaacacagtcacattaaaaaaccaaaaggtctttgtgtcaggttggtctggcttcagcaaagataatattagcctccagagtagaagatccgtggaatccacagtattgcatttggcagccccacgtcttgttttcttttcttttttttttgtttttaactaaaggagttggcaattttattttcacatttccctatacaaatgaaaactgcatcttttttggccccacttctcccctccaaaactattctctttgatagggcaagggggcaagtcttccttatgctgttaa

SEQ ID NO: 44015 - DNA, 1070 bp, Homo sapiens
atggcctgcaaagctgaactatttaccatctggctctcaagaaaagggaaaaaaatgcttatctttgtaccccgacagtcttagattaagagtactttgtaccaccctgacgtcccaggcagccatgagtccagccacccctgaaatgtacacaagtctgggctagggttgcagcaggtgagtcccaattttgcagatctttggcatcaggggcacaacccaggattttgagtggggtttcctcaccactgtggctgggcactgggctagtgtgctttctgatttttgtatggggaagagaaaggagggaggaaatggcaacttgttgccctgttctaacattttcctaagatgggtctccaggcaagggcttgggatctcaccttacacagcttacaaaacccagtgaggccggctgtcttggcgctgccactctgagggatggagcccccaaattactaggaagggagaaaaaagaatggtttctgcaagcacaagaagtggcgttattgaaattaacatttcccccaagttttataatgtctaggcatgcatatttaagtgtctgtctcaaaagctcttgctaataaccagatggtgcatttaatttcctttttttgttctctgagcaacatgcagcttcctacacagccctccttgcaggcaactgcactgaggtgacagtcctcctgactgccagcacagatccccagggcctctgagagccctgtattctgggggcagcctttcccccttctatttggccccagctggaagggggcaggttacccacagtgcagcacagggctcctgccttagcttagcttagctcctgcctaagcacagggctcctgccttctctagggagtctggctccctctgaccctctagacctcaccagctgaggatcagagccccggggcaggagccagggccggggggcattggggggtggtttgagagtacagctctggaggggggcaggacgggcccaggaaaagctgctcaggggagactgccaagagatggcagagttaggacaagagggccaggcatggtggctcacacct

SEQ ID NO: 44016 - DNA, 1050 bp, Homo sapiens
gaaggtacagggagggaaatctcaaaaaccaacaacctgtgtattcccagactattaatcatagaaaatcacttcaactggattacggtcttgtacctggcagaaaggctgttatgaacattggaattggatttttacacttgatatgacacttccttgagtcagatcagattcgtgtttgatagactcttgccaaaaaattgctccagggtctgtgcagtagctaaagcctttttgttgttgttgttgttttaaaagtagcattaaatgttttcatgaagaccttcccagtcgtgattttattgggaatatggtctttagctctggtcctgaataactcacactgaggaaacctctaacaagtgttgtattggaagatgtctgatggatggttggttttaataacaaatctcttccctttttctgtcccctgtgttctattctcttttctctacacattattctgggaggattcacctattcccaaagtcctttcctctttatttccatttcagagctctctgtataactccaggctgacgaatccaacggcccagtttttatctccacttggctgtctttcttgcattgacctcatcttaccttgcctctcctgatttcctcttctgcctgggctcatcacatcagattcacaccaccatccacccagcttccaaaacacctgggcctcctccttcattcctccctctgtctcagtcaagttagtctactgtctcctctccatcctcactgccacagccttggtctagccaaccatcttgtctcacttggcgtattgcagcctcctacctggtctactcacctcccactctcctccagtcagactgctctttttatagcacaaagtggatcattactcccctgcataaaaacatctactgtctccctttgtctacaggataaacacgacaaataacctttaagatttggctccaacttacctctatattagtcaatttttataattatataaacatctctcagctcctcaccctctcacgtctcgatttgtgcacatgctcttccctc

SEQ ID NO: 44017 - DNA, 1061 bp, Homo sapiens
atcattgctaaaaatagtgttcagattattaatattactgttaattattaggagctaatatgacagttttctaatgaataagatcaatatcactctttaagaccaggcgtcattaatcattaatattcatcatttattgttatcgtgagtataactctttaatacgaattatcattattatcggtattgattttaagaattatatgatcagttattaatattgataattatcagtatcaattaataattgagattattaattgcggtaagtaacattgcgccattccacccctccctcggcaacccgtttacgacccaaaacagggatccaaacgcccctgagagagcagcggtatactgggagagaggaggatggtcacgtggtggagagacgtgtttttgtgtaccagcccttcacctttgccgaccttctcaactgggaaaacaataccccgtcctagagcgaaaagccgcaagcactaattgatttgctccaaactgttatccagacccacaaccccacctgggctgatcgccaccggttgctcatgttactctttaagagagatgaaaggcaaaaggcggagagggctccacgtagcaactaagtggctagaggaacatacaccagctgattatcaaaaaccccaagagtatggaaggacccagttaccaggaacccacccccagttggacccacacgaaagagaggatatgcaaaggctaaactgagacagggaagctctcttggaaggattcaagaggggagctcagaaggccacaaacgttaacaaggtctctgaggtcattcagggaaaagaagaaagtccagcacaattctaccagagactgtgtgaggcctatggtatgtatactccccttgatcctgataaccctgaaaatcagcgcatgattcacatggctttagtccgtcaaagcgcggaagacgttagaagaaaactgcagaagcaggctgggcttgcagggatgaatacatcacattgatgagaaatagctaagcaggtgtttgtaaacagggatgcagtaagccgcgagggaaa

SEQ ID NO: 44018 - DNA, 1035 bp, Homo sapiens
agccaggagttccagaccagcctgggcaacaaagcaagacccccgactctaccaaaaaaaaaaaaaaaaaaaaaaaaaaaatcgaaaaatgagccaggtgtggtggcacgcacctgtatttccagctactcaggaggctgaggccagaggatcgcttgtgattgaggctgcaggtgagctgtaattgggccactgcactacagcctgggtgacagagaccccatctccagaaaaagaaaaaaaaaaaaaactcgtcagttcaaatgcttgggaactggctggatttaattttcagggagctatgtgtctgcagatgtgcaaacctttatttcttacaagcattggtgtattacagattagctctaggaaagaaatatggagacttgagttttcataaaaattacctggtgctacttcagatgtgacttattgactatcgaaattgccttctgactgttgggcagtatttgcacaatgatgagataattcctgttattattttaaatagagacgaggtctcacggtgttgcccaggctggtcttgaactcctgagctcaggtgatcctctcacctcggcctctcaaagtgctaggattacaattcctgtttttctaaaaccggtttttctttggttttgtcattagcatgtgcgacacaagaggtcgacactgaacttagcgttttcaatagctaagatgaaatgtttctattcatgatgtgcttctgtttcctcatgtttcaggaggaaaataagattttattttatcatccaaatgaggtagaaaagaagaagaggccgggctcggtggctcaagcctgtaatcccagcactttgggaggctgaggcgggcggatcacgaggtcaggagatcgagaccatcctggctaacacaatgaaaccccgtcaatactaaaaatacaaaaaaattagccgggcgtggtggcgggcgcctgtagtcccagctactcgggaggctgaggcaggagaatggcgtgaacccgggaggcggagcttgcagtgagcggagatcgca

SEQ ID NO: 44019 - DNA, 1006 bp, Homo sapiens
ccaggacgacatccacctttaaggccccagcgtccaagcccgagaccgcggctcctgtgagtaaagccgcagcagggcgtcctgggtcctggactcgccatccccgactgggaggcgcaggtcctgtggtgaccgccttgctctgctctgtccccagggggagagtggtgtccccggggaggagggaggaggggacttgctgcctttgatcctctagattcccttctttgtcatgcagcctttcacctccttgacttcagcccttctttcatgtggactctatcttgtcagtgagagtttacacacagtcgcctctagtttgctagattttattaggtttcttatctttcctgcctggctgcagtcttctagccattgaatcaccattttctttcattttcttattttctgaagagaggcttacattaaaagtggtaacttcatctttcttcagaaagtctttactcccaggcactgtggatgttatctttaaccctaaaccttctaggcacggcgtttagggttaacgataaccctgaaagataaccctaacgtgcctctgggggcccagcatggaggtcctgggctcccggaaccagttcatccattcccgccaccgcacagaggccctggtgtgggctctccagctagaggagaacaaggccggactctgcctgcctcttcagaacttctgttctagtgataggaagcagacaataaaaaataaacaaaaacactgacactagaagccatgcagagaataacacaaggtgaggtgatggcgtggtggggagcagcgcggctggacatcactcccgggctgggttggctgaggttagtgcgccctggtgtgagacctgtgggtgaaggggaggaggctgggtggtggtgtctgcacccctcgctccaggagctgtcttgctttggggcgaaggagccaggcccctataccttgtgtccggggccttagttcagctgtgagtggtgcccaggtgtggagtgtctt

SEQ ID NO: 44020 - DNA, 1322 bp, Homo sapiens
gtctgccctgagctctcaccaggttgttcagggaggttgccgtccacatgtctactgctgatagggtcttttctccctctttgccggtaggaggggttggttcccgtcgtcgtacacgaagttgctggaagaaaatgagacagaagcagtgaccgtgcccacgccaaggtagccctgaacgtggctgagctctcccggtgacagaaacccctgccttgtcgtttctgtaacacaccaccatctagctgtgtcgcaggccctgccctaagcctcagctctcgtggactagtcagagatgagaccgcggctcacagtgctgtctgccgtgatttctgttgtccccgagctttgctgctgtgaggagacccagcccaggccacctactcctcgcagtcctgcagccctctgaaactccctccctgtgccctgcccctcctggtcgctaaacccaagccatgtgttttccgtccttatcttacacttatcttaccgttcttatcttacagcccttaacgctgttgtatgctttttctggaatgttctctggccccggctgcttgacctgtgctctgtttgtcttctgcctcaccagctctttgcacccctcttctgcccatcaattaaacatcagtgttcttgggagtcaccctgggtccatccttcctgcctgtgctgggccatctcatccactcccatggcttgaaatacactgatgggctttgctgagcacctccatgccgaaaacccccaaatccgtattccagatcagatactaacagtagttattgcctagagactgtccaaaggactttgcattgattttttcacttaattctcacagcagacccatgaggtgggcccccactttaaaaaatgaggaaactggccgggcacggtggcttgtgcctgtaatcccagcactttgggagatggaggcaggaggattacttgaggccacaagttcaggaccagcctgcgcaacatagcaagatccccatctctacaaaaaaaataaacaattagccagggcatagtggcatatgcccattgtcccatctactctggaggctgaggcgggaggatcgaagttcacagaacccccataacccatccagctagccaggtagaaggcctccaggtccgacgttgcattccccagggtctgatgctgtctgcaatcttcatccctagcagaagagctaaaatgccattgtgctggggaacaaaaactgagtaacacttttaggatgttaaaatttcaagtgtttacattttttttttttttaactcttagctcattgctcactccagcttttgctagt

SEQ ID NO: 44021 - DNA, 1028 bp, Homo sapiens
aaactacattatagatttgtcttgctgatactcagaatccaatctgacagtctttggtctaaaaattagagcagaagccaggaacggtggctcagcctgggtgcagtggctcacacctgtaatcctagcactttgggaggccgaggtgggtggacctgaggccaggagtttgagaccagctaggccaacatggcaaaaccccatctctactaaaaatacaaaagttagctgggcatggtggcgtacacctgtaatcccagctacttgggaggctgaggcatgagaatcatttgaacctgggaggcggaggttgcagtgagccatgattacaccactgcactccagcctggatgacagagcaagactctgtctttataaaaaaaaaaaaaaaaaaaaaaaaatcagaaaaaaatttctgaaacatttttgaaatgttactaattcacaacaatattacaaatatattcctaagatctggataaaagaattcataccacagtagggaaagagctgagctgagccacagcagttataattgaccaaaatcacttatcttttagttacaggttagactcactttaaagagattaaaattcttccacaaaaatagcaaagaaacaagaggagattttatttactgaacactgtacctgctatatgccaggcacagttctaagcacattataaatgtaatattaactcctataatcatcatgacagcactgtgaggcccatgcttgttatttccgttttatagatgaggagactgaggtacaaaggcagtaacttgctgaggtcgcgtatctggtcagtggctggttcattggaccccaggctacctaccaggtatatgacctagtctgccaacttaattttctatatgtccaaaagatgtgcttttttaaaaaataaaaaattttttttagagatgggggtctttctgtgttgcccaggctggtctcgaactcctgggctgaagcagtcctcccacctcagcctcccagagtgctaagattacagacatgagc

SEQ ID NO: 44022 - DNA, 1043 bp, Homo sapiens
ccagatgtaccttaactgcaggggtgagcaaactacagccagggatgaccagggcctgcttgtaaagaaagttgtttgtttgttttttggaacggagtcttgctctgtcgtcaggctggagtgccagtggcgcgatctcagctcactgcaacctccacctaccgggttcaagtgattctcttgcctcagcctccctatagctgggactacaggtacccaccacacccagctgatttttttgtatttttagtagagatggggtttcaccatattggccaggatggtctcgatctcttgacctcatgatccgtccgcctcggcctcccaaagtgctgggattacaggcgtgagcctttgtgccggccaggaaagttttattggaacacagctgtgcccatttgttcctgtctggggttacattcaggatacagtagcagggctgagtggctgcagcagagacgtttggcccacaaggcctaaagtttttgcaatttggcccttacccagacagtagaagatctcttgtgtcatacagttgcttgcttcaattgggataatcttgtgagggatttggtatccttttctccaaagaaaaagcacttctttactaccagctagctaagtgtctggatttaaggtgcattaacgacataatcctaacaaccacagtagcatgggatactcaagtcctaacctcttcgtcttgttgggcagagcaaacaaaccgtcaacccaaatccagagatcagtagtcagggtttggccagtaacatattttaatccaactgtttatttttatttatttatttattttgagacagagtctggctctgttgcccaggctggagtgcagtggcgtgatcttggctcactgcaagctccacctcctgggctcaagcaattctcccacgtcagcctcccaagtagctgggactactggcgcctgccaccacacccagctagtgtgtgtgtgtgtctgtgtgtgtgtgtgtgtgtgtgtgtgtgtgtgtgtgtgtattttttttttccagtagagacagggt

SEQ ID NO: 44023 - DNA, 1440 bp, Homo sapiens
taaaaatcctaccaggagtggtgtaaatagggcttaccaccttctcatggcttaggatagggcgagcatcttttctatgctttagcaaattgccatactccttgccaaatttggatcagcttccaacatttcatccttgcaattacaatgttgtgaagtatcttcaagagttcctttaaggtgaagttttgttttgttttgttgttgttgttgttgttgttgttgttttgctggcatcgctttccctgaaacatcttcatccttttcatcacagccacttggctcaattatgttggtaagttttggcctcactcagttcctgtggccgttcatccagtgccacaaaggccaacagtgtcagcatttccagtcagctgtttcttctctaattccatctacgtttgactcagtgttgctacttttcccatttcatttctgtgtcttcagttttgttagcagtttctcttgtagttactcatttttgtaacatcgcctgggttatcactgggagacaaggaggcaacgcagctacacactcggctgtctgtggggatgctctgctgtccttgcaccaatagcagactgtcttaattactgcaactgtctaatcttggtatctagtcgcataagtcctctagctttgtgtttatttgagagtaccttggatattctaggacctctgcatttgtttatatcttagaatcagcttgtcaatttccactttaaaaaattcacttggaattttgattggaatacattgaatttacgggtggatttaggtggagttgacatcttagcaatattggattttctaatccatgaaaatggtagatgctttcatttatttgagatttctttcgtttctgtagcactactttgtattttttattgtggaagtctcctccttttttatagactcattctttatgtgttttgtcctattgtaaatggtatttttaaatttttatttcctaactgctggttccattgaattgtttagtgcctgtctttcgttactggaagtcctatttagttcttttctgaaatctgcaaattaattttttgttgtatttatttttatagcagcttgagatacagtttacccatttaaagtatacagttcactggtttttagtatattcacaaagttgtgtgattatcaccacaattaactttaggatattttcatcaccgcaaaaagaaaccctcacccattagcagttgcttcccatttaactccaaccgtatccaaccattcatttgctgtacatctttaacacttgttattgtctcttttttttttttagtatagccatcctataaatgattttacacatcctgtagtgtgaagtgggctctcattttggctttcgttcacatctccctagtgactaacgacattgagcatcttttcatgttcttactagccatttgcatatc

SEQ ID NO: 44024 - DNA, 1239 bp, Homo sapiens
acactgataggcctcagccaagtctaatacagcatggggacaagtttaaggtagataaacagaaaactaagcaaaggtggcggggcggaaagaaacaattgtccatcccaggaaaaacagccaggctttactgagaaagggaaccatcagccttagtgcaaagtcataatgaacactgactatagtttcatcagcaaattgccatctaattgcatagaaagtccattggaaaggaagagtgagaggtatagagacctgaggcctcatctgctgtcgtaggaagctgcagttactccccaaaatcaagaaatcaagaatatttaaaaaaaaaaagaatattcaaaactgcagcaataaatacaaaaataggagcatagttgaaagtgctctcgggcataagaccagggctatggaaaggtcgaggcatgggttgtttttcattgttatcacagtttgattaaaaacaagagtcgtcctattctctctctcctcctgattcatttattctgaagggtatgtgtgtaaagcacctgcctctttgaatgttgggtagttgttcattcttttttgcatctggtcgtctatataaatggagcatgcatttggggaaggggtcggtgagacttgaatggtctctttggggtgattaatatcatgaagcttattgttcctagatggaacaaacacataacaatcgccacgtgttgtgagtcgtgaagtctgagtaccgtaggaatgacttattgtctgtacttcaaagttagggtattttaaaatttagacccacgtcctaaatagttatttgtcttatacttgtcctagcatttgtctttatgactttctgctgatacaggaataacacgtgttgaaatgaaacctggacactggctgcaccatgaaatccatgagagggaaactgtgccttctaatccttagctgtgtgcacagggtctggcccatggtagttactccacacaactttggtgaataaaccaatcagtgggaaaatgccagggaggcagggcgcagtggctcgtgcctgtaatcccagcattttgggaggccaaggtacgcggataacctgaggtcaggagttcgagaccagcctggccaacatggtgaaaccccgcctctactaaaaatataaaaattagctgggtgtggtggtgggctcctgtaatcccagctactcgggaggcaggggcaggagaattgcttgaacctagtaggcggaggttg

SEQ ID NO: 44025 - DNA, 1034 bp, Homo sapiens
tcagggggctgaggcaggagaatggcgtgaacccaggaggcggagcttgcagtgagccgagatcgcgccactgcactccctgggcgacagtgcgagactctgtctcaaaaaaaaagccaaaatttctgggagggaacatttctgtagctgaacctacgtacagtaataaagaagtatatatgttgaacttttcaagcttaaaaactcagtattgactacaaactgtagttgcaaatctttttttttttttttttttgagacggagccttactctgttgccaggctggagtgcagtggcgcaatctcagctcactgcaaccccgcgtcccgggttcaaggaattctcttgtctcagcctcctgaatagctaggactacaagcacccgccaccatgcctggctaatttttgtgtttttagtagagatggggtttcgccacattagccaggatggtctcgatctcttgaccttgtgagccactgcgcccagcctagtctcaagtcttagttgaacttttttttttccccctctggtagaatcatttggatagggatttgtgtatggtgttaactgtggaagttctcattcatttgttgttcttcgtattttaagatgttagggttatatgtgaacattttaagaattatatcaggaaattggttgggtatgatggctcatgcctgtaatcccagcactttgggaggctgaggcggatgaatcacttgcggtcaggagttcaaaaccagcctgggcaacacggtgaaacaccatctctactaaaaaaacaaaaattagctgggtgtggtagcaggcatctgtaatcccagttacttgggaggcggaggcacaagagttgcgtgaacccaggaggtggaggttgcagtgagccgagatggcaccattgcactccagcctgggcgacagagcaaagctctagctcaaaaaaaaaaaaaaaaaaaaaaaaaattaggaaatcaaatgagactttcctcctattgtatttggagaaggaatatccgcaggaaagaacagatc

SEQ ID NO: 44026 - DNA, 1063 bp, Homo sapiens
atcatgacccgagaggtgcagacaaatgacttgaaagaagtggtcaataaattgattccagacagcattggaaaagacatagaaaaggcttgccagtctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaagagtgctatttgtgaaaaaaaaaacaacaaaaaaaagaaatgttgattcctggctgggtgtgggggctcctgcctataatcccagcactttgggaggctgaagcaggcagcttgcttgaggtcaggagttcgagaccagcctggacaacatagtgaaaccccatgtctacgaaaaaaacaaaaaaattaactgggcatgggggcgtgtggctgtaatcccagctactctggaggctgaatcgcttgagtccgggaggtcgaggctgcagtgagcagagattgcgccactgcactccagcctgggcaacacagcaagaacctgtctcaaaagaaaaagaaatgatttccccttactggtatctgagaaataaaagtaaagaatttaaactgtttttaaatcatttggagtttttgaacaattcctcagatcgcaaaggccgcaattttattttatttgagacagaatctcgctctgtcacccaggctggagtgcagttggcacagtcttggctcactgcagcctccgcctcctgggttcaaataatcctcccacctctgcctcctgagtagctgggattacaggtccctgccaccatgcctggctaatttttgtatttttagtagagatggggtttcaccatgttggccaggctggtcttgaattcctggcctcaagtgatctgcccacttcagcctcccagagtgctggaattataggcatgaaccactgcacccacccagctgcgatt

SEQ ID NO: 44027 - DNA, 1042 bp, Homo sapiens
aaaaacctcaggtgacaaatcaggaaagtcacaatgataattcctcatacttaggggccaggattttttggataaaacttgaatggtttgttttttgttttttttttttaatttcttagggtctctgttgtccaggctggagtgcagtggtgtgatcatggctcactgcagcctcaacgtcccaggctaaagcgttcctcctgcctcagcctcccaagtagctgggactacaggcacgtgccgccaagtctgactaatttttatgtttttcatagagacagggtttcactatgctgcccaggctggtcttgaactcctgggctcaagccgtctgcctgcatcggtctcccaaagtgctgggattacagatgtgagccactgcatctggcccagttgtgattatttaatggactaaatggtatgtctcatcatagcatgggcttatgttacactttgagcagcttaagatacaggacatcagttatgtctgacagtacaatatgtgactgaacaataaatgcaggaacaatatgcctgtaaaccaaaaagtttaaacatgcaaaacatgggtttgttttgttttgtttttgagagggagtctcgccctgtcactcaggctggagtgcagtggtgcgatctcggctcactgcaacctccacttcccgggttgaagcgattctcctgccttggcctcccgagtagccgggattacaggcatctgcttagagactcagtcttactcttatgccctctgagaaggcttcttcagctaaccagtgcatcctttgtgtcatccccgatggttgtatgtacttgataatgccctattctttcatttgatgtgctttagtctgtaaataaggatgataatagctcctagggttgctgtgaagattaaacgcagtcatacatgaaagctcttagaatagcatctggcgcatcgtaggtattcaattagggctaactgttagtaggcatagcgtgtgtttactagactgtcactccccacccccaccaagagcattgattttcatctgtttat

SEQ ID NO: 44028 - DNA, 1013 bp, Homo sapiens
gtgtgaagcacctgtcctttgctaggctcctggcgccctccgatgatacttttcatagagtgcttaattctaagtaaacatcagccatccaggtgaatgtggattgtgttggcttaactatttttatttatttatttttgagacagggtcttgctttgttgctcaggctggagtgcagtggtgcaatcgcagctctctgcaacctccacctcccactttcgagcaattctcccacctcagcctcccgagtagctgggactacagccgccacgcctggcaaatttttgcattttttgatagaagcagggtttcaccatgttggccaggatagttgttaaccaggttgagaaactgagtcctagagtctcttagtgaccggctgccacatcccacttaccatgcctttgtttgtatggtaatttagtttccagtgaccaaagatgcacaaaccgaatacattttcataatgtggcgatctaaggtgtcactggaattttctgtcattctgttaattcatcatcattggcatgttttgaacaaactctcttaataaaatgaggctaggagcggtggctcatgcctgtaatcccagcactttggggggtcaagataggtggattgcttgagcccaggagttcgaggccagcctgggtaatgtagtgagaccctacctctacaaagatacaaaaattagccgggtgtggtggtacgtgcctggggtcccagctcctcagtaggctgaggtgggaggatcacttgaggccaggaggcagaggttgcagtactgaaatggtgccactgtactctggcctgggcaacagagtgagaccccatctcaagaaaaaatgattattttttgactaaaaactgtgtggaatgttgaagaaaataaaaatccaatttgttttaattccatgcacattaggtttcccttggaggtctgtgcaagacaagaattaatacccaaaactgaaatagtgtcacaaatgtaaatcaaaagctacaggcatgta

SEQ ID NO: 44029 - DNA, 1112 bp, Homo sapiens
cttccctgtctctctttcccgccccgctgtacctctccctctgcccctccgctccccgttcactctccctcctcccctgcccctcgacactgtccctcccctcctcctggttcttccttctcccccgtgtgtctccccctcctcccctgtcccttcttctccccagtctatccccctccctccccctccccctccccctcctcttggttcttcctccttccccgtgtgtctccccctcctctcctggcccttctccgcctcccctgtcccttctcctccccgtcccttctcctcttccctgaccctcagagctctggagaccaccccccatcccctgaccagctacacattttacaactagtgcacttaagttggggaggggtctgttgtgcgtcggtggggcccacgtcctcctcccaacttcttggaatcagtgacccgtgctgtcctggctgccgggcttaagccctccgggaccaaagacacaagctcgagtttcctctaagaaaagaaagcgcccaagaatgtgggggtgaaactcccctgtaattaggatcgccaggtgagccgagctctgggcgttctcccgggaaacgccctcctccttagacccttcctctcccacctttcagttgaacttggcttttatatatgggttatttggtgaggttcttgaagtcaaagaacaaccgaggttttaatgaaattgacctaaccttaaggaatgcgttgatagccggtctcttaacttgcatgtattaggagagaatttttccagacacagacagagacttaggattagtggcctgtttagtttacatacttacaaatgaattccaggtgaaataagatatctgttaatcatctgctattaatagaacacaaaacaacttttgttttaattcagcctaggcgcttcgaacccttgaaactttaacgttctctaagttcatgtataggcatgtttaaggttataaataaatggttggtcggttggttggttggtgtgttttatcttttttctgtccctggtgcttgaatcaggaagtttagtcattttgatagacttttttaaacctaaaattttagtttctgggttttcaaggtctgaa

SEQ ID NO: 44030 - DNA, 1827 bp, Homo sapiens
actcccaggttcaagcgattctcctgtctcagcctcccgtgtagctgggattacaggcgcccgccaccaggcccagctaattttttgtatttttagtagagatgggggggtttcaccatgttggccaggctggtcttgaacttctgacctcaagtgatccgctcactttggcctcccaaagtactgggattacaggcggagccaccgcgcccggctgggttgctggagtttgaattgcgttaaatttaaagcacgaaaaatttcttaagtgcctcgttactgaatctacatctataaacacgtagcggcttctgcttcaagtgctgagtgtgagggaatagcaggctgatcacatgtgttctgtgctgtgcttaagccaccttatgtcttacttaaaatctttttgccttttgactcagtgggaaatcaaatgtgatttttcactttagatataaagagaggctcagaactctcttagcattcagactttctaatgtcttgattttggttgcgatgcacaagttgtttatagtgtgcattgaaattaatttatacagagaagaatcaaccctagtgagttttgtccttaagtccttggtgattcactgaaaacagacacgtgtttccctgaaggttagtgtttcctggcatcgtgtttgttttgttgttgtctcagagggagaaactgagaaaaaagatgatggaatatactagatgccgaagaaacattctgatgaggagccagataaaacttgaattggaatggatgcgtgttcttaaccgggctccattatcaatgacctttcataactttaagaataagaatgttcttctctctgaaactgtgatgttgctcttcaggagtcttaccgccagataatgaagatgcgaccgaaagacttgaaaaaacggctgatggtgaaattccgtggggaagaaggtttggattacggtggtgtggccaggtgagctgcttgttcattcaccttctctgctgtgtggatctcagtcttttcaagagaagtcatttgcccttctccagtgctcatcaccaagcactcctgggcagggctgatgtctccttggagcagtcgggccatcatgcactggcttcagccaccctgcggagaataggaattcctccgagcatgctcgtgccagcctcttgccataacctaccagaatatccgtgattgtcaccactaattgacttcttgtaaagctagaattaaacttttaaattcactcccttcttttgaaacatgaggagcatgctcctgaaatttaacacaggaggcagccttgctctcctctgtagaggatttgctgcagggagcagggcagggattgcatttgtgcatgtaaattgcatttgtgtcaaaggaattttgtaaaatgttaaaattttggtcaaaataattcaagaaaatgatattaaaaaacagaatagaatgatgaaaaactgctatttcatgtcctgcttcttttcagcttcaagacaattttttttttttggtcttttttgagacggggtcttgctctgttgcccaggctggagtgcagtggcacaatcatagctcactgcagcctcaacctcctgggctcaagcgatcctcctacctcagcctcccaagtagctggaactacaggtgtgtgccaccaggcctggctaatttttaaaaagttttttgtagagatgaggtcttactatgttgcccaggctggtctcaaactcctgggctcaagccactctcccatcttggcctcccaaagtgctgagattgcaggtgtgaaccgctgtgcttggctaagacaactgcttcttaa

SEQ ID NO: 44031 - DNA, 1035 bp, Homo sapiens
atcttggctcactgcaacctctgcctcccgggtttaagtgattctcctgcctcagcttctggagtagctgggattagaggcatgcgctaccacacacagctaatttttgtattttagtagagatggagtttctccatgttggccaggctggtcttgaactcctgacctcaggtgatctgcccacctcagcctcccaaagtactgggattacaggcgtgagccaccatgcccagcctgtgctaagttcttaacgtgcattttatcattttttgttcacactaccctgatgatggccccatatttttttttaccaccttccccttgcttactattttccaacatatcaaagtttacatttacaaaattgtattacttatcagaataaaaaattgcatagcttcttctgtcattagcggtacctgtaaggataaatacttcaggtctttatttgagttggtttttatgtgatcatatgcagtataagagaatatcggtaggctgggtgcagtggccctatctctacaaaaataagaacatttagccaggcatggtggcgtgtgcctataatcctagctactgggagggctgaggcaagaggattgcttgaatcacccaggagttcgaggctgcaatgagctatgatcatgcccctgcactccagcctgggcaagagagcaagaccttatctcttaaaaaaaaaaaaagtatattgatcaacccatctgaatgtgtttaagatttttagtttaaagcattttgtatttgttatagctgatcttcagtttgaggagaaaacactttttagatggttgtccattttttgtttcatatgatactagatttgaaagtcaaatcttcggcaaagctaatttttagagtctttttgttcgggtgtaaatatagattagctattatggaaatctcgtctttaatgctaacctgagtaatttttctttgtttttagtgttatgtgccaagaaccttgcaaagaaagacttcttcagtaagtaaacacttatttttttccctcttata

SEQ ID NO: 44032 - DNA, 1047 bp, Homo sapiens
ttcagtggagctaggcattaagaagaatgcaaataaagaaagggtttaatttcaggctctgcaaagagctatgatgatgccgcattaatgtagagtgggatgggggtgcagcagagatgccttcacccatgaattaggaaaaaaatccatctgtctgtgtgtccatgtccctcatcctatgagaataagaagagaatagtgtttctagaagagctttctggactagaaaggatcacacagatagtattaatgtttggtgctggcagggaacccgtggggacaggcagcaggtggcacatccccacctcgtccttggggctcagttgtgtctcacagaagagacagtttttgccacaacagctctgcctaaccctgccacgtttggggtatgatctgaattctgtcacacttctgatggcaaatagttcacatgattttgtcatttatttttaatttagtgcaattgtagaagatgaactgtaacatccatattttaagcaaacaggtgttttgaaaacttacctcaggactgtcactttaccagagatctgttcccacctccaaagccaataggcatggccggtgggtgctaaagtgtgttttgttaacttagacagttttccccgcaggaagaaatcatttgatcatttaatggtgtctgaatagtggaaacatgtgtgagtcttgtgtatgcataaacttactgagcaagattggaaagaagtgtttgtttcagttgcagataatggaatggagttcagttctcctgtatgggcttaacatttttggcatttgaatctgttgatataactgaaatgtgactttttttccttcaatgcaaatttgaagatatcctaaatttgtatcagaattgacagatcagtggctctggtacagtggccttggaagtggcacagcacttggggaggctgaggcgggaggattgcttaagctcagtttgataccagcctgggcaacatagtaagaccttgtccctacaagaaattgaaaaattagtcaggggtggtggtgcatgccctgtagtcc

SEQ ID NO: 44033 - DNA, 1025 bp, Homo sapiens
ggtgtgggggcccacgcctgtaatcccagcacttcggtaggctgtggctggaggatcgcttgagcccaggatttgagaccaggctgggcaacattgcgagaccccatcgctataaaaaataaaaaattagccaggataaggtaatgacctgcaggacacatgaagaaggtgactggggaactggccatgctctatttcctgacctgggtgctaattatatacgtgtgttcagtttgtgagaattcagtgagctgtacactcagatatttataaatcaatcataaacatcaatagacagaatagaaagtccaaatatagacccatgtcaactgatgttcttcaaaggtgccaagacaattcgatgatggggaaaaaaagatagccttgtctagactggaaaataggaaatccagccagaatgaatgggatatccttatgaaaaaagaataataataagtctcaacccttacctcacatcatacacaaaaattgacctgtgtgtgatactctgagctgttgttacacatgacactgatgacacctaatgtgtgggttttttttttttttccccacatcaatcccaattctgatgctaactggctattctacagttcgattcaatcccaacgcttaattccccagaattagcaaagaccccacaggttaagggctcagtcccacaagactactcctaccttatccatgagttgcaaatcaaaggttgtcacctatatttctgactaataaataaatcgggggttccctttgcaggttcagtaatttgctagaggcctgtaatcctgtaatcccagcactttgggaggctgaagcaggcagatcacttgaggccaggagttcaagcccagcctgagcaacagactgagattccagctgtacaaaaaattaaacaaaatgagccaggcttggtggcgcatgcctgtagtcccagctacttggggaggctgaggtgggaggatcgcttgaacctgggaggttgaggctgcagtgagctgtgattgtgccac

SEQ ID NO: 44034 - DNA, 1031 bp, Homo sapiens
cagcctgggggatggggaggagggtgcaggggagggggggttgaggacccctgttttaaggattccttttgtgagtagagctgtgtatatgtttatcttaaatatctattctgtcattactattggtatagcaaagaagaggcagtccacagcatgtgttcagtctgtcagtctcaaacctaattatctgtcaattttattcaagttggaagtgtgaaattaagctctcaattcggtgccactttttttttttttttttcgcccaggctggagtgcactggtatgatctcagctcaacgcaacctctgcctcccaggttcaagtgattctcctgcctcagcctcccgtgtagctgggattacaggcacccactaccacgcctggctaatttttttgtatttctagtagagacggggtttcaccatatttggccaggctggtcttgaactcctgacctcaggtgatccacctgcctcggcctcccaaagtgctgggattataggagtgagtgactgtgcccggcactggtgccactattttttttttaaataaagacatgaaaagccacaagatttcagataacgaagcaaataaccgagtaatagaatgagccctttcaggattctgtaaaagctgttttatttgtgaattaatttttgaaaaattttaccctgagtcttcaaaactttgtatttttctgtggttactgacattagtgacatttctttttgatttgtccctgtcttctgtaacatatttatattatacatcaacctggaaaaatttcatattcagccctttagagttgcctgatggtggaaatcacaaatgacatattaataatctgaacaaagaatagaaagtgaaccagacatagcaccagtgcctgtgcttagaagtggattaagaggccaggcgcagtggctcacacctgtaatcccagcactttgggaggctgaggcaggtggatcatgaggtcaagagatcaagaacatcctggccaacatgttgaaaccccatctctactaaaa

SEQ ID NO: 44035 - DNA, 1057 bp, Homo sapiens
tcaaaacttactacaaagctaaagtaattacgacagaatggtactgacagtagcgtagatatagaggtcaatagaatagacttcggaatccagaaataagtcctcatatttatggtcagttgattttcaacagtgatgacaagataatttgacaggggaaataatagtcttttcaacaaatggtcctggaacaagtggatatacacatgtaaaagaatgaaattgagctcctacctcaagaactcctaggagaaaacaggaataaatcttcaatactttggtctagacatggaatcttagatatgacaaacaaagcacaggcaacaaaaggaaaacagattaattggatttcatcaaaattcaaagcttctgtgcttcaaaggactcttgaagaaaaagaaaactcacagcatgggagaaaatgtttgcaaattatgtttgaaaagggtcttgtctctaaaatatataaagaacccttacaactccacaatgaaaaacaaataactcagtttaatacatgggtaaaggatctgaacagacatttctccaaagaaggctaccaacatggccaataagcccatgaaaagatgctcagcatcaaagtctcagagacatgccaatcaaaaccgtggtgagataccccgtagactcactagatggctaaaattaaaaaatgcgatcaggccaggtgtggtggctcatgcctgtaatcccagcactttgggaggccaaggcaggtggatcacctgaggttaggagttcgagaccagcctggccaacacggcaaaaccccatctctactaaaaatacaaaaattagctgggcgtggtggcaggcgcctgtaatcccagctactcgggaggctgaggcaggagaatagcttgaacctgggaggcagagatcgcagtgagcctagattgcaccactgcactccagcctgggtgacagagcaagactgtctccaaaaagaacaaaaacagaagtgagatcataataagcggtggctagaatgtggtgaaattggaacttttatgtattgctgttgggaatgtaaaat

SEQ ID NO: 44036 - DNA, 1060 bp, Homo sapiens
ccgcctcagcctcccatagtgctaggattacaggcgtgagccagcgcacccagcctttttttgtgtgtgtgtttttagtagagatagggtttcaccatgttggccaggctgatctcaaactcctgacctcaggtgatccacccacctcagcctcccaaagtgctgggattacaggcatgagcctgatttacaggcactgatttctgacaatacatccttactatatatccaaaacttacctgccctttgaaacccagcctgtctcacctctacaaaaacaaacaaactaccttcctaaccattcctacgatactattctatttctgtgaattcttaaaatctgcttgaacagcccattttgacatttgattctctgtgtcagtgtttattgtcttagatttaccccctgcatgcagaagtgactgcatagtcactacttttagtgagtttgaaatctgtttggagagctatgtaagtaccaatggaaaaaaaaaaagaagtaggtaactttacaggacagtaaaggacagattgaagaagggggacgggggacttgaactaggcctggaagcgcaggggtaaaggaggtggagcatgttggttgccaggggaccctgagcaaaggagcacttaaaaaaatgcatgaggggaaaggtcatcagtgacgtcagtagttcgatccaaggggagtttgtactctttttaatttttttttttttttgagacagagtcttgctctgttgcccaggctgcagtgcagtggcacgatctcggctcactgcagcctccacctaagaagttcaagtgattctcctgcctcagcctcccgagtagctgggattacaggcgcctgccaccatgcttggctaattttttgtatttttagttgagatggggttttgctatgttggccaggctggtctcgaactcctgacctcaggtgatccacctgcctcggcctcccaaagtgctgggattacagatgtgagccactgctcccggccaaatactttttttttttaaagaaattttcatttagtaaataatgctgagctcagag

SEQ ID NO: 44037 - DNA, 1035 bp, Homo sapiens
tatcatttttctacttgttattctgcacatatttgttggtagactacaacgtagcaatttcagaggaatgcttcatggtgttcttgtggagtgattatttcttacatctggttcaagtttcatgggtatgcattgcatgaattttaccaaattgtgtgtgtgtgtttcagatccgcataaataaatcagtagtcaaaagtaagggtagtgtttttgggaatatatttttcttacttttgtgggtccccaagaagtcagtccactgattttatgtatatatgcactcactactactgtacatctggagtagaggctggcaagcttctgaaatgctcagatagtaaatattttatgctttgcaggccatgtggcctctattacaactactcaactctgctgttgttgtagccatggatactgagtaaactgattagtgtggctgtgttccaataaaactttatttacaaacacaggcagtagcttgccaaccccctaactagagcgtagctgtcactttgagacctgagtaacttctctgtaggattacacccttgcaagaattctgcccgcagcatttccgagtttgcattataaccttgtgggcagggcagtgaaagtactgttatataggaaagttaccgtctcctaggaattttgttttaagaaaaagattctaatactaaagtatgacatttgttgaatattttttattggcagtaggaaaggaaaattgaaattacatacaggaactccaaaagcttgctcgtgctcatttttcttctattacagattgaacatttaatgataaatgtgggtggggggatttaatatttcagaacagaaggcagagattaattttattttgccccctaaaatgtaatacattttctctctcttcttgccccctgccctgccctttcccactcctcctctctgtccctttgctgggatagggaaattgactgtaaggggattatgggtctatgtgggagggagagataagagggtctcagcaaaatgccaccttccaaccct

SEQ ID NO: 44038 - DNA, 1026 bp, Homo sapiens
ttttccagtttgcctccttggggttgcattttggcagagaaggctttaacaccccaatgttcttaacttcagtagttgttgattgaacaactacttttggcaataacctttttctgtactatagaggatatcaaataaaaagggagaattgaccagatgtagtccctgctttgtagaattttacattgggaagggaaagatggaatggtgaagagaatcacagaagtatggagagaggcagattgattccagctggagggatttgaggaaggtttgtgtaggatgtggcatgtgaacttggcctggcatgattggttggaaataggcaaagggatgacggattgggagggcattttaagtaatgcaaatagattgagcaaaggcttggaagtagaatagcacttggcaaaatgtgttgggagaaggggaatgatagtcactctgtggactggaattgtagtcttagtgggataggcgatatagagagtcttcatccaactgtgtgataaatatcctctggccgtttaggcccctctgtgacacacacagccaaaatttaatatatgagtagaatgcaaaaatctgtcattataagagaaaaatcaagaaacagtatatatggtggtaaagaacatagatttgaagctagattgcctgggttcaaatctttaatagctgtgttatcttgggcaaagctactcagtctctctgatgcctcagttttctcacctataacatgggataagactagtccctatgatagattaatttcaagaattagattagaagattaacatgaaaagggtttacaacagtacctggcatatagtatagagtagtgtgtaattgttagtaattagtagtagtggttgttgttttagtgtttgtgtttgggtataatgtgtaattgattttttttccttcgagaaagattagcctttctgtagcttatgtattctatataattttgcattagtgaaagtatagcatctcaagctcgtaagtgcatgaagactctcacagtgg

SEQ ID NO: 44039 - DNA, 1029 bp, Homo sapiens
ttttatgcattgaaatactctcagatatcctggtgtttttatatcttttggagcatgactgcatattgtgaagtaagaaaaactctaattccaaacagagaggaacaaagagactttccttgatagcatgtggaaatatgaggttgtttttaaaattgtagcttgtgggatgtaagggtgacttgtgttttggcattcagatggtgcaactgtgagtgaaatagttgtggtaatagctgttgatgatgttggttgatgaattacaggtgtctcaattgattcaaaatagttaagtctctcaagaaagattaagaaaattgttaagactgttgactttgtcaatttgtaccagctaagaacctcacttatgtgaggcaggcaaaacttttgtttcaaaaaccatataacacagttgctgtgataagatggaataagtggtcagtttttagctccctttgcatttacattttccttagggtctgcctcaagtttaggaagatacagttaaggcagttctttgagatgaattattggaaggtgtaggatgggttagaacaaatgctgttgcaaaacttgaattgcaattatactttaagaagaatcacattctgccaaatagaggtttttgtcattgattttgtgatttgatcacatttgtgttgccttttagaacaactttcttttttcaaatccatttttttttccttttaatcttcttggcccacccaactgactttagacatgaaatctttcatatgctttatttctatctccatttttacagtagttgtgatttatcaaactaggatttttaacttcaagtccatctgtcagagtttaaaacctctagtcttgcagttacaaaagtcctttctgaatgttgggtttttctttctcttccacacattttcattttctcggttcagtcacaatgtcaggttctagtgtggaaaattgggtgaaagaaaggttttggaggctgtgttatttatgaaatatttcctcatggattaagaaagaaaaaaagac

SEQ ID NO: 44040 - DNA, 1068 bp, Homo sapiens
ccttctaggcttaagcaatcctcccacttcagcctcctgagtaggtgggactacagatgtgccaccacacccggctaatttttaaacttttttgtagagatggggtttcactatgtggcccaggctggtcttgaactcctgggctcaagcattcctcctgccttggcctcccagagtgttgggtttatgggcatgagccattgcacctggcccaggaggattcttccatcactttggtcttgcccagcctcagccttcacaaacaaaatggggatatcagttcaagcaacttctcaggggtatgaagaggatacagagaaatgatgttggaggcctttggggacagtggaaggaaaatgcaagcaccacacatgctcacggctacagagatggccgtggcagagcagggaggactggagatggaattgggccccttccagggctgggttttctaccaatgggcctgggactttgatcaaatctctaaatgtctgccaaactgagttttctaccctgtacgatgcacgtgaaaatcgagtgtcttacagggcggctgtgagagtaaaatcagggaaggaataggaaaagctttgcaaaccagaaggaccccagcagtgaattcactgcaggacatttagtcaggcgccctacagaaatgacatcgtttattctttcttgctgtgtttccctggacaggtgaggaaaacaaggcttggagtgggtaagttgccaagtttgtatggcagagcccagccctgactccaggggatgctgttctcaccccatctcgtggccaccatccctggactttccctgcaggtgggtcctgtagctgtgtgtgcccagcctgctgctgtgtgcaaataagaatttgatggaggctgggcacaggggcttacacctgtaatcccagcactttgggaggccgaaataggaggatcacttggggctgggagtttgagacaagcctgggcaacatagtaagaccctgtctctacaaaaaattagccaggcatggtggtgtagtcccagctactcgggaggctgaggtgggaggatcacctgtgt

SEQ ID NO: 44041 - DNA, 1048 bp, Homo sapiens
accccgagcagccgttctgtgggctcttcccaggctgatgaagatgctccagagagctatacccactgtgagacttgggctgagcactacgtgggctggggtggagcaggagtttgtcctcatccagatgggctgttgagagatggcaggagtggccctcaggggctccacaggacctgaactccaacaaccagcttcttgccctgttctagcaaaagcgcaaaggcgttgaagggctcatcgacatcgagaaccccaaccgggtggcacagacaaccaaaaaggtcacacaactggatctggacgggccaaaggagctttcgaggagagaacggtaacatcactggctgggccttgtgtcacggggaatacaggccagcagttggcctgtgggatgctaaggtccccagctggctgggagctgtggctgtttatttctgtctcattccccaatggccctccagtagcctttaaaaagccacacagaatttgttttcaccaattgatacatgatatcaggggaaataggacaacaggctcagacctgagcataacacttgaggtaatggtgcaggatacagagggttgccctccattcccctcttccagagcaccacaccctggggagacttcccttaccccactgatctgaccattcctgacctgcatccatctgtaatgtcgtggccatggggactggaagggggctgcgagcctgtgccggccagaaggcagtccagcccagcgcagctcagccagctgtcccaggcctctgcaagtcctgtgtgaaaatgaagctgtaaatatcttcctcaagagtcgtatgaggatcaagatcatgtactgaagtgcctggcacaggatcagtccttgactggtgccctgacttttggcagccaccaggtgacctcaagggccttacaagaggttgaagcctgctagtttctctcctgactgggaatttaggataatggctgaggggtgtgtctgtgaaagcctcgtggggaaggccatgagcttgggtgtgattgcagctgctaaggaccct

SEQ ID NO: 44042 - DNA, 1005 bp, Homo sapiens
aaaaaaaaaaaaagtgcccctggctgtgacagaacatcgtgtaaaaagcccttatagtgacggcagggatgtaagtggtacatgtttctgtggttgcatctgagtccactatgcttggattgtaagggaccaggggatgtagcaagtcattgcagtgcaccgtccgccatgttctcccctccggtcttctgtgtaggagccagcatttagtacacagtttggtgatgcatcagatggtcacgagttgcttcctgcgtgcctttgaacacatgagggtggcggaggtgtcggtttgggtggtgctgggtgaggggtaggtgaggcctccgatgagagtactccaagcaggacacagccctctgggggtcagagcagtcaaggcagctgcttccgctcacctaaactgcgggtctctgcaggaagaaagggaggccacaaaggccgggcgaggcagtatacaagccctgaggagatcgacgcgcagctgcaggctgagaagcagaaggccagggtgagtacgtgcctgtccaggccacgccagtggcccagggtggcgctttgccaatttggttcatagagaggccaggcaaggactacccattcgcagggacaagccagcacgtgggggtcgggcgggcagtgagccccaggtgtgagtctcagaacaaccaatgacagtcagggcgtgggcatcctctgcctggatgggttagaaagaactgtggctgctctgcagcagctgctttagtggggccctgttcttggtcttgtgcacctactttcaggaggatctccctcctgcaggacctgtccattcacagctcgagctcccagcacccctgcttgtctgctgcagccacacaggatgatttgccacactgcacatgacatatgccctgccttcccacacccccagcatcagcatgctctccatccctggagacgttgtttagcctctcctcctctgtgactcatgcctcacctccagccagagctgatttagta

SEQ ID NO: 44043 - DNA, 1186 bp, Homo sapiens
tgcagcctccaactccttggctcaagagttcctcctgcctcagcctcgccagtagctgtgagcacaggtgtgtagcaccatatctggctaatttttaagttttttgtagaggtgggattgtgctgctttgtctaggctggtctctaacccctggccatccgcctcagcctcccaaagtgctgggattacaggtcacagcccagccaccgcatctgctcctctgaagggggccagcccctccacacctgtgggcgtttctcgtcaggtgggacgagagactgagaaaagaaataagacacagagacaaagtatagagaaagaacagtggtcccctgggaccggtgctcagcatacgctcagcatcccgcatacggaggacctgcgcatacggaggacctgcgctgcgcaggcactggtctcttgagttccctcagtatttattgatcactatctctaccatctcggagagggggatgtggcaggacgatagggtaatggggagagggtcagcaggaaaatatgtgagcaaaggtctctgtgtcataaataagtttaaggaagggtgctgtgctttgatgtgcacctacacaacatctcgtgcatcaaagagcagtattgtctccagcaggtcccacctccagccctgaggcggttttcgcctatctcagtaaatagaacacacaatctggttttacacccaagacattccattcccagggacgagcaggagacagatgccttcctcttatctcaactgcaaagaggccttcctctttcactaaccctcctcagcacagaccctttatgggcgtcgggctgggggacaggctgggagacagtcaggtctttcccttcccacgaggccatatctcaggctatcacatggggagaaaccttggacaatacctggctttcctgggcagaggtccctgcggccttccgcagtgtattgtgtccctgggtactcgagattggagaatggcgatgacttttatcaagcctactgccttcaagcacttttttaacaaagcacaccctgcacagccctaaatccattaaaccttgagtcaacacagctcatgtctctgcaagcacagggttggggctagggttacagtttaacagcatctcaaggcagaagaatttctcttagtacagaacaaaatggagtttcttgtgtctactt

SEQ ID NO: 44044 - DNA, 1186 bp, Homo sapiens; identical to SEQ ID NO: 44043

SEQ ID NO: 44045 - DNA, 1186 bp, Homo sapiens; identical to SEQ ID NO: 44043

SEQ ID NO: 44046 - DNA, 1186 bp, Homo sapiens; identical to SEQ ID NO: 44043

SEQ ID NO: 44047 - DNA, 1062 bp, Homo sapiens
catcagaaacagtttcctctacaagtaaccattttagaattgctgaaaaaccaatgacagcatctctgaagcccacttaacatgcctccccttgctaaatcacaaaagattccttggcttcttggaagcaagcagattttgctaggacacagctgaggttatagaacttatggctgtcacagggaggtcactccatttgcatctcaaaaagtctgaaagtggccaggtgcggtgactcacgtctgtaatcctagcactttgggaggctgaggcgggtggatcacttgacatcaggagttcaagaccagcctggccaatatggtgaaaccccatctctactaaaaatgcaaaaattagtcagacatggtggcacgtgcctgtaatcccagctacctgggaggctgaggcaggagaatcacttgaacccagaggcagaggttgcagtgagccaagatcgcgtcactgtgctccagcctgggtaacagagcaagactctgtctcaaaaaaaaagaaaaaaaaaattctgaaagtacttctggtctctctctttagaggttagagttgcttctgctcagaaatacacagttctgggaactgagtctcatgtggataggatgagtatgccttatgggcaaagtgacagttcttcccaaaactcagatggggatgaagaggagggatgggtgaggaagggctgtggcctcactaggctttaactgaacaggatatggacaagcagcgagtgtggagggtgcctaccgactctgaagccctggctggagcaacacccatggctaggtgtgtcccgggcctcaggaacaggtatgtgggcccctcgccactgtacctcccctcacaggcttgtggatgtgtcagatggcagaagggtgggaggaaaagagctgccctgcgtgggtggttccatggtctcaagctagtgccatcaagacaggaaaaggccggctgggcacagtggcttatgcccgtaatcccagcactttgggaggccgaggcaggtggatcatttaaggtcaggagttcaagaccagcctggccaacatg

SEQ ID NO: 44048 - DNA, 1056 bp, Homo sapiens
aagggaggactggcttcttgcccggggcccagcccaccctggcacctaccgtgcttgcagaagccacggtcataccaaggacagtccttgatcttggactcggggtcgatgtgcaggaagggacattccttgttgctgcactcccctgcagggaaactcagacgtgagaccactgggaaggccggggccaggcccaccttggcttcatccaaggaaaagaggttctggtgtccagttttggcctgacgagccctgagagccagggaagagtgtttctgagccccagcttcctgtgcagcggagctgtgatggaaatgcacccattgagaccaggaagttccattctgattggctcttcacatctaagagctgggacaagggtaggggaagcacttgtggacctggccctctccaaagcagcggaccccagggaccaccagcaccaagaaccgccttcctgagtagttgcccgcttccaggctcaccttctccaatccatgtttacaactgtgctcaaaatccagaggaaatgcaaactccttccccaggcccctccgcaggctcagcctctgccaccccccagccacatgggtccccctgtaccaggaccagccccttcttagtcttccgcttccagctcaggaatcccctcatccttgaccactcagcctagagaaggttctggtcacggtttccttccttcaaagcacttgtcacaagcaatttcttctctgttcgtctcatggcctatcagctacctctttccctggaccacaagagtgaaggcttcacagggcaaggacctcttcaccattgtccctccagtgcctggaaagggggccctcaacccaatgtctgtggtgcaggtgacagaagctgcagacagtgcgtcctgcaccagggctgtcagcaaggaaggagcgaccctcaggccacttgtatagcggtgccttaagagcctgcccaggagagccagctgctgcctctggggacagatgggaggccactgccccatcccagtgctgccccagtgctgctatgggcaaggcatcgggg

SEQ ID NO: 44049 - DNA, 1029 bp, Homo sapiens
gaccccacgttgtgtgtgtgactttggtcacgtggcccaacctctctgagtctatcccccctcccctcctttaaggtaaagacatgaagtgcttgttgtgaagattaaataagctaataatgtcaagtaaatgttagctttgcagtaatctttcctgtccgccacgttactgcttttttcgagacccttttctggagttactcccagcaagctgttactcagacgtcctgttggttaataaagctgtccctgcagcagttctgctattgtatagactcagtcttaaaatagtgggcttgatgtgacatatttcttcataatattgtgtatgtgcagcctctgtgtaattgcattatgcacctttattgcatagttgaagcagtggcaggaaaggatgccatatgtgttactgggagattattcagtgggtattttttctcactcttccgtttcagtaccagtgaaggacaagaaacttctggaggtcaaactgggggagctgccaagctggatcttgatgcgggacttcagtcctagtggcattttcggagcgtttcaaagaggtcagagccttgtggatgtctgtaaatgaaagcaaatctctgggtcttcagatctcttttttgccatgaattaatttgggcaatgaaggccttgttgtctgaaagcagtaagttatgtagaggatgacagggagggatgctaggccttggacttctgtggttgattggccctttcaaaggctggctctgagatattacagccaagaacatgtttcctgttgcttggaatcagtatgtctgcctctgtcttagagaaatcctaagacttctttaagaggaaaatgaattggaaccgtagtgggcattagtctataatatgatgctctcctccctgccagaacttcaggacaaatatttgaaatggcctatcttggcctggtgtggtggcttatgcctgtaatcccggcacttcgggaggccaaggctggaggattgcttgagccgagtttagaccagcctaggcaat

SEQ ID NO: 44050 - DNA, 1107 bp, Homo sapiens
tgtccaggcacctcgcccttcgcttcatggccttctagtagttccagggtgttcgcagttgtgacctgcttcccgtgagcctctgctctacgcccctggatggggcgtgcattccctacccagcagccctcgcgcggtccggcacagcggacaccaggactccaaaatggcgtcagttggtgagtgtccggccccaggtaaggctgtttggactccgtggtggaagcaggagccagggtccagggtccagagccacactgggagagaaggaagctgcggagctgcctgccctttgctcaggcacttcgccacgacctcacttgaggcgcgccagaccccgctccgcctgcccaggcgcgccttcctgctgcccagggcctgcgccaaccgggttaggcgtggagggtgaaggcatctggggcacgcgcttctgggcctgggaatgcgccgccttgggccactgttcctctttccgctaagaaatagccgcttccctctcccgctgcgacccagttgctttgcacttgaatgttaggcgcagcttttgcccttttttcccaaggcttaagctcagatgaagctccaggaggagctcaggactaggactgtacctgataccatgtaaggttcgatgcatatatgttgaatcagagaggcgaggtgacctgttcaaggtcacaactcgtgcgagggctgagctggtattcaaacctgaggattcgtggtaaatgaactttattctctaggacggccttatgactagcaggcttttccgagacacccatgtgtaaatcgctacattcatcccgctgtgcacactgatgatttttgtttgtttgtttttgaatagttagccctagatgctccatagtagccttgtcagagagtccttgttgggaaagtcgattccattttacagatgagggaaataactgttcgggatgtggtgtggcctctctgaggtcacacagcctgatagtggcagagttttgattaacacatgtgtgtcttagctcagtttctggtttttttttatcattttttttttgagatggcgtttcgctcttgtcgcccagggtggagtgcaatggtgtgatctcggctcac

SEQ ID NO: 44051 - DNA, 1026 bp, Homo sapiens
ggcatcgtgatagtgaaggtggaggaggaagatgaagaagaccattttcaaaaggaaagaaacaaagtagagtcatcgccacaagttctcagtcgctctacaactatgaatgagagagccttattgtcatcgtatttagttgcatatagagtggcaaaagagaaaatggctcacacagcggctgaaaaaattatccttccagcatgtatggacatggtacggacaatttttgatgacaaatcagctgataaactaagaactatacctcttagtgataatacaatatctcgtcgaatctgtacgattgcaaaacatttggaagcaatgcttattacacggctgcagtccggtatagactttgcaatccaactcgatgagagcactgatattgcaagttgtcccacactcttggtttatgtcagatatgtgtggcaagatgattttgtagaggatctcttatgttgtttaaatttaaattcacatataactggattagatttatttactgaattagaaaactgccttcttggtcagtataaattaaactggaaacattgtaaaggaatttcaagtgatggaacagcaaatatgaccggaaaacacagcagacttactgaaaaattgttagaagcaacccacaacaatgctgtttggaatcactgttttattcatcgagaagctttggtatccaaagaaatttcaccaagtctgatggatgtattgaaaaatgcagtgaaaactgttaattttattaaaggaagctcactgaatagccgacttctcgaaatattttgttcagagattggagtgaaccacacccacttattgtttcatacagaagttcgttggctttctcaaggaaaagtattgagcagagtatatgaactcaggaacgagatttacatttttctcgttgaaaagcaatctcatttggcaaatatttttgaagacgacatttgggtaacaaaattggcatatttaagtgatatttttggcattcttaatgaattaagcctgaaaatgcag

SEQ ID NO: 44052 - DNA, 1050 bp, Homo sapiens
actttgggaagcctaggcaggcgaatcgtttgaggccaggagttctgagatcagccttgccaacctagagaaaccctgtctctactagaaatacagaaaattagacgtggcggcacacgcctgtaatcccagctgcttgggaggctgaggcaggggaatcgcttgaacccgggaggcggaggttgcagtgagccaggatcgcgtcactgcactccagcctgggagacagagagagagagtgagactctgtctcaaaaacaaaaaaagagaatgtttgaagcctactgaataaagaagtgatttggatataataggaaaagctcatttacacttcaccctttcctttcaagactttaggaaggggtctttttgtttctttggttggtttttttgtttttgagacagagtcgcccaggctggagtgcagtggtgcgatctcggctcactgcaacctccagcgcccgagttcaagcttctcctgcctcagcttcctgagtagctggaattacaggcgcctgccaccatgcccggctaatttttgtacttttagtagagacggggtttcgccatgttggccaggctgggaaaatgaactcctgacctcaggtgatccgcccgcctcggcctcccaaagtgctgcaattacaggggtcagccaccacgccctgccaggaagggttttaaatgagcaatttcggacatggggggttttcagttgtgggaggtatctatgcttgacatcgagggataaaggagagaagggaatttgtggacggtgcagcggaccattggggactggtaccagttctgccattgatgttcttggatgaaacacatagacccaccaagtctcaaatgtgtcctaagtaaagtaaaatagattatctcaaggtctcttccaattttggaatctgccgatagactgaatttaacattcagctaagcaaaacctatggccccacattcatttccatttgtgccaccaacatacagaaagttacttgcattattgagagaggctaagtgacacagtaccaaagaaaaggggtt

SEQ ID NO: 44053 - DNA, 1080 bp, Homo sapiens
tgtgtctgagaggtggaagaaacctggagccggtgaatgagacataggatttattgaggacttatatgctgggtggtccaggagcagtgggctggacacgaaaaccagttgctactgtttgtaaaaagcatgcagattatatagcattttcacttagcaacctgctcctaacaacctccatttaacccgaatcaaagggccttgatcctctgtacagcctgcattccaagaatgggccagaggttcagatgttcagatgtccttcctagaaaaggagcagatctctgagttggccactcccacatttcttagcttggaagtgtgaacccacattctacttggaccatagggtcattgttagggtatgcttgagttattgctgtcaggtgcatctgccatacgataccataaaccttaaaccactaaaataaaagagatgtagctagtcaataaaaggaaataaagtggaattataaaaaaagattaataaaaaataaggcagaaaaagaagaaaacatataggacaaatagaaaacagcaaaataatagacacaaatctaatcatactaataatcacattaactataaatggtctgcatgcgctaatcaaaaggcagaagttggttggattggctaaaaaaaaaaaataagacccaattttttactggaaaagaaacacattaaatatgaagaaccatatacgtttaaagcaaaagaatggaaaaagatatgttaatagatctggagtgggtatattagtatcaaagtagatttctgagcaaaggatattaccagagataaagaatgttatatcctaatgataaagtggtcagttcgtcaagagaatgtaagttctaaacatttctgcacttaacagtgcttcaaacatattaagcaaaaactaatagagctgcaagaagaaatacacaaattcacaattacgtttgcagttttcagtaccttttaataatttttagaataattaggcaataaatcagcagggatatagtagacttgaataatattatcaatcaacttgatcccattatttatagaacactctacccaacagctatatac

SEQ ID NO: 44054 - DNA, 1481 bp, Homo sapiens
tcagatgtgggtaatttaaagggggcatttttacaagaaacaaaaaaaactcggtttgttcggaggcaagttttaaatcagggttcattttttaatattgatgaatccttcaataattgtatgtttactgctgcccttcgcgagccagcctgagaagcgcgggctcgacatccccgcgcgcccccgccgcccgcccccaaggccggcgacgctggagcacatgtcctgaggcccaggaccgtggtcggccgctttcgcacattcgtggccagcagagggcgcagccggccagcccccgcagcgaaagatccccgagtgccgcgtcagcgatcgcgctccttgccctcgccgcctgccagccgccctgagtcagcaaaccacagagaggcgaggacctcccattttcctagacagaacaagtgggcgttgggggtacgggtgagtggcaagaacaaccgacccggaagcgaaacgagggggaacttccgttctttgttctgtccccggtgtgtgggtctgtgacagggtccaacagggcctggtccgtgtccggtcccccaaatctgtcgtccctgcccccagggtgagtccacgcgtccccgggtctcgcggtgagacggaggctgtggtcgccggggaagggggtggtgtctgtgccactgcggcccgcagggtcccccggccggcccggagcagggttcggggaggcgcccctccgtcccctgcagcccgtcctctactccgcttccccagggatccccctagcctagcgggatcctgcgtaggggttagtaatggggctccggttctggttttgtgactttaacggcgacccagctggagcgtttaaaagtttcagcagagcggtaggggcgcctctctcttgaaagcagctaatgacagcgaccctaacttggtatttctcccagacgtttttatttgatgttaacacagttattcgcgcccgtggcaggagaggaagtttatttttacgcagctgggtccaaggatcagagaaattctgctaagcgtacgcagttagcacgagggctgggagtgggtgcagacgccgattccaggggtaatcctgctggagcccagtgcatcgcgtgatacacctggctcaggctccgttttcagttgtattagattcctggtttgatcctctctccggaagtgggattgaatccacatcggtgtttacactctgaagggcttttgtaaactccaggagaagatagcagagtgatgaacctgaaaccgatgggctaattagaggaacgagcgtattattttctccagaaaagacatctgtggagagtgggcatcatttgattatacgtgtttgatggacagtcgggtggaaggagaagattctgttattgaagctctttttttaaaaaaattaatttttatttatttttgagactgtctctggagtgcagtggcgcgatctcggctcactgcaacctccgcctccc

SEQ ID NO: 44055 - DNA, 1052 bp, Homo sapiens
ggactaagcggtccctgctgtttggagatacttaagatggggctccactttttgagccccccgactcccttatttggtcttatactgcctgtgtgcaagtcaggctctggggatatggcgccagtatgaaatgcagggtctcttggtttttccccttttctagcagacaggtcattacttagttcccaactcccactctaaagctctggttagcgggtgatgaaaatcagcacaagtgatcacatacagcaatcccaacctttagaccacttcctagctgcctctccaaaatatgtagtaaacggtcattgagaaactctccctcctggtaattcacagtgcccacaggatcaaggcttggacttctttctaataaaaatctgcttactatcccttcttttttgcgtatgtgaaaaacaagttaatttagctcaggaaagtagtcaattatcatgtttataaggttgggtgggctaggtaagatgatgtagagggtgacattaaagtgtagaacagagaccacttaggtggaagcaggcagccttggactttgctaaagaccagtccatgtgactgacatggggtcacttcaaatggtagtgcctccctcactgaagagcatcagaagggcttctgagcaaggccagaatgagcctcgatgaacatccaagttgaccaaccagtgtggtgcctaacagaggacagagccaccagcaggggtgctcaggggctgctccccttttattaatgacagcggtttctctcaaggaagtgtagtgccctcccctttgggatagttgcctgacccctgtccatcagcccttcaagtaccctcatcagaaaaagagcccgcgcattctcctgccgatgccttgtcggtcgtagaggacattgaacttgttcacaaactggttcatggtgttgcacgttttggtgatggtgccgaggtaggccatgagccccacgtcgttgcattgctgggagggaacagaaaggaccagttcctcgggatccctcgtggcatgcccggggaacaacagtccccagtcctg

SEQ ID NO: 44056 - DNA, 1123 bp, Homo sapiens
tgccgtacaagagctgctgcctcagtacaaggagagggaagtgagtggttagagaacaatggcaaacaaagggcgaggcgtttaagcttctgtagagaggctgctcagatactgatgttttctgagcaggcagaaaggaggggcacttctgcctggtgttctctgtgctctcctttccccatcctgttgctcttttttttttttttttttgttcttctcctttaggtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccggtacgtgtggagcaagaagcaggaaagcacttacccattagttgttttgtagagattaatttgatcctgtgatgcctattgttttatttggttgtaaaagttgcctgtgtgttcgcctttcattcttgggtatgtagtggtctttctacctattttctgggtgtttgttgttgacccagagtaagttcagagggttcttgacacttacaagatgtctgccatgaagagaaaatgtgattcaaaggaccgacccaatggggctcttttccttctgagttcctttggtgtttctgttctcacatcctagatccagtctcccactttcatgcctctgatcatgtgcccaagccaggagtgccaaaccaaccgctcaggagggcggctgtatctgcagacacggggctccagattcatcaaattccaggagatgaagatgcaagaacatgtgagtttggggtacgtggccctgggcaggtggatcgggagtccacttgaatcctgtagtcacttgtggaat

SEQ ID NO: 44057 - DNA, 1081 bp, Homo sapiens
gagctgggtggacgagaagacgccctggacgactcgttatggctccatcgcaggcttggctgagctgggacacgatgttaggcctctgggaggaagaaatgggggaggggacacagtcatgaggttatagagggcactgtacccccatctgggagaccctggtgaccctccggcttttgcttgtccttttcccttctaacaggttatcaagactctgattctgccccggctgcagcaggaaggggagcggatccgcagtgtgctggacggccctgtgctgagcaacattgaccggattggagcagaccatgtgcagagcctcctgctggtgactgaagcccctgtccccacacctgcccactgagacacaggcagtgtttagcaagcatatggcatattttattcacttactcccatctttgcctcatgttttcagaggacattgcagagtctgatactattttacagatggaaagactgagattagactgagtaagaaataagggggctgggcatgatggcttctgcctgtaatcccagcactctgggagcctaggagtatgaggccagcctggacaacgtagcgagatcccacctgcaaaaaaaaaaaccaaaaagccgggagtggtgacgtgtctgtggtcccagctactagggaggccgaggtgggaggattgcttgaacccaggagttcaaggctacagagagctatgatcgtgccactgcactccagcctgggttacagagggagaccaccgccccccaaaaaagaagggtttaacacgctcagcctgtggcatttggaccatccttccccaatgctcctgttactctgtggtcttctctgtacaaggcaaatgcgctcttgattaaccatcctgccacagtatttagcaagttcattcacacattagtgcccatgttttctttttcttttctttttttttttttgagatggagtctcactctgtaacccaggctggagtgcagtggtgcgatctcaggctcactgcaacctctgcctctcaggttcaagcaattctcatgcctcagcctcccaagtagctgggaccacaggcac

SEQ ID NO: 44058 - DNA, 1083 bp, Homo sapiens
tgttgcccaggctggagtgcaatgacacagatctttgctcactgcaacctccgcctcccgggttcgagtgattcttctgcctcagcctcccgagtagctgtgattacaggtgcccgccaccatgcccatctaatttttttatttttagtagagatagggtttcaccatgttggccaggctggtcttgaactcctgccctcaagtgatccgcccaccttcgtctcccaaagtgctaggattacaggcgtgagccactgtgcctggcctgagatggggttttgctatgttgcccagggtggtcaggaattcctaagcccaagcagtcttcccacctcaccctcccaaagtgcacagattacaggcatgagctgagccactgcacctgcccattataaggatttcaggttttactttatggcaagtggagagccattatgagggtttgagcaaagaaatgacaatctgctttacagtttgacagaagcattttggctgcaacgttaggaatagatgtagagaaaggcaagggtagactccggttgacattgttaggaggtttttggagttacccagtggatagatgatggtgacctgggccaagcagtgggagcagaggagtcaggttggactacctggtggattgattgatttttgagacagagtctcgctctgtcgccaggctggagtccagtggcacgatcttggctcactgcaacctccacttcccaggttcaagtgattctcttgcctcagcctcccgagtagctgggactacaggtgcgtgccaccacgccaagctagtttttgtatttttagtagagatgggatttcaccatgttggccaggatggtctccatctcttgacctggtgatccgtccgcctcggcctcccaaagtgctgggattacaggtgtgagccaacgcgcccgaccggatttatttttttaccttttttttttttttgagacagagtccatctgtcactgaggctggagtgcaatggcgcaatctcaactcactgcaaactctactgccgaggctcaagtgattctcctgcctcagcctcccaagtagctgggatta

SEQ ID NO: 44059 - DNA, 1032 bp, Homo sapiens
aacgccttatattggaaaatctaggattttcgcagctattgaggagaagtcaatgcctggcttcaaagcttcaacggacagcctgactcctcgttaggggctaatgcagttgctgactttaagttgaagccaatactcatttaccattttaaaaatcctaaggcccttaagaattatgctaaatctactcttcctatgctctataaatgaaacaacaaagcctaactgatatcacatctgttcacagtatggtttcctgaatattttaagcacatgggtgaggcctactgctcagaaaaaaagattcctttcaaaatattaccgctcaatgacaatgcacctggtcacccaagagctctggtgaagatgtacaaggagatccatgttgcttttttcatgcccactaacacaacatccattttgcagcccatgaaacaaggagtaatttcaacttcaagtcttattatttcagaaatacatttcataaggctatagctgccacagtgattcctctgatgatttgggcaaagtccatttaaaacctcctggggttaggcatggtggctcatgcctactatcccaactttttgggaggctgaggtgggaggactgattaagcccaggagttcaagactagcctgggcaacacagtgagaccctgtctctacagaaacaaaacaaaaactagccagatgtggtatgcaatctgtagtaccagatacttggaaggataaggcaggaacatcacttgagcacaggaggttggggctgcagtgagccatgactgcaccagtacattccggtctaggcaacagagcgagaccctgtcttcaaaacaaaaaacaaaaccagaaaaactcaaccccccgtccgggaaggattcaccattttatcttattttattttatttatttttgagatggagtcttgctccatagcacaggctagagtgtggtggcgcaatcttggctcactgcaacctctgcctcctgggttcaagcaattctcctgcttcagcctcccaagtagctg

SEQ ID NO: 44060 - DNA, 1038 bp, Homo sapiens
gccattgcactccagcctgggcaacaagagtgaaactctgtctcaaaaaaaaaaaaaaaaaaaagaaaaagaaaagaaaaaggaaattggtaaaaattaaggaggtctaactaaagtatggacttcagttaattacaatgtattaacttcagttcattaacggtaacaaatatactataccagtgcaagatgttaataaaagggggaaatggtacaggatatatgagaatcctactgtcttaacaatttttctgtaaatttaaaaacattgtaagatgaagagtctatttttagagcactgagtaaattgcatggaactaaacacacacacacaattacatgtaaaactgatagaacctgggtaagttcagtggatggtattgaaggcaatttcctggttgtgagattgtactctagttttgcaagctgttaccgttgggggaaattgcatgaagggcacgagggctctctgggtaataatctcttacaattgcaagtgaatctacaattatcttaagataacaagccttattttatttatttattttatagagacaaggtttcactgtattggccaaacttgtcacaaactcctggcctcgagcgatcctcccaccttggcctcccaaagtgcagagattacagacatgagctatagtacctggccaaaaagcttaattttaaaacattgaaaagagaacaggatcttttggaaagctgaagaaataaagtctaggcttaaagttctaggacccttacccagcaccgtggggcagaactggcctgataagaaaatgaagctgtgggccaggcacagtggctgacgcctgtaatcccagcactttgggaggctgaggtgggtggatcacttaaggtcaggagttcgagaccagcctagccaacatggtgaacccccatctctactatacaaaaattagctgggtgtggtggtgggcgcctgtagtcccagctacttgggaggctaaggcatgagaatcacttgaatccaggaagcggagattgcagtgagccaggatc

SEQ ID NO: 44061 - DNA, 1057 bp, Homo sapiens
ctcttctcctggtgtaagacaaaacaaaaacaaaagacgttggagtagagatcagaaaagggtgggtttgagatgtttgggagggttgagtgggcattttgacaacttagcttctccttgggtggtatttagcagacgcccttgtggtttaaactgtagctttagatataaaatccactcttggccgggtgcggtggctcacgcctgtaatctcagcactctgggaggctgaggcagtcagatcacaagatcaagatcagcagattgagaccatcctggctaacacggtgaaaccccgtctctactaaaataataaaaaaaaattagctgggcatagtggtgggcgcctgtagtcccagctactggggaggctgaggcagaagaatggcatgaacccaggaggcggagcttgcagtgagccaaggtcgtgccactgcactccagcctgggcgacagagcgagactccgtctcaaaaaaaaaaaaaagaaaatccacttctaatgctacctggggccctgctgcttgatggagaaactgaagaacataaaggatcttgtttgagggtttttgttgttgttgttgttgtatatttgtttgttttgaggcagggttttgccctttcacccaggctggagtgtggtggcacaatcacagctcactgcagtctcgaactcctgggctcagatgatcctcctgcctcagcctcccaagtagctgggaccacaggcgtgcactgccatgcctggctaaattttgtattttttttagggacaagttttgccatgttgcccaggctggtcttaaactcctaggctcaatctagcctcccacctcagcctcccaaagtgctggaattataggcatgacccactacacactacacctagtttttgttatttatttattttttagaggcagagtctcactctgttgctcggccaggctggagttgagtggtgccatcatagctcactgcagtcttaaactcctgggctcaaatgatcctccagtctcagcctcccaagtagctggaaccataggtgcacatcacaatgc

SEQ ID NO: 44062 - DNA, 1098 bp, Homo sapiens
aaaatctcagctgtgcacagtggctcatgcttgcaatcccatctctttgggtggccaagggaggaagactgcctgaggccagcagttcaagaccagtgtaggcaacatagcaagaccccatctcaaacaaaacaaaacaaaacagaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcgggggcagcagaatggcttaaacttgggaggcggaggttgcagtgagccaaggtcgcaccattgcactccagcctgggcaacaagagcaaaactacatctcaaaaaaaaaaaaaaaacaaacaaaaagaacctgtggatgagttcccacatggcttcctaacgggctgcggctctcctaggagtctctcgctcatgggaaaggcacaaactgaatgtggaaggaaatcccattgctgtggaagtcccattgttaggaagctctgcttttctggagttcaaatttgcattcatgacgctttaaaccgtcagagctgggtgtgtcctcctacaacaaatcactttactctctctctctcctagttaacaggctttcaaatattagaacatccatgttctgacctcattaaaattgctcttttgtggaatgaaaagctctgatttaacccgtctttaagcctggtatgcatattcctctctgttccggccaccttgtctagacacactacactgaggcagtgcccatcttagatgatgttga

SEQ ID NO: 44063 - DNA, 1045 bp, Homo sapiens
cctcttgagtagttgggagtagagatgcctcccacatcgcctggctaatttttgtatttttgtggagaggggatatctcgccacgttgccgaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaatgcgctttgagaagacggggactccccaggatacccctctctcccctcgtccagcctccagcccacccgattcctccccacatcctccacctccccaggccccacccacctcctccaactcctccggggaaacccaagccctgcagcgcatggaacagaagaactggaaccgacgcttctggaacaaggctatctgagagcagttcttcctggccctcgggttcatgggacggcataactggaaccaatgcttagggcgcaagggtatgtgagagtgggtcttcccgtacaggaagtagaagatcttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcatctcccactccttcaggatggagacaaaaacccaactggtgaccaagagtggtggcttaggcctggaatcccagcacactgggaggccgaagcaggaggatcacttgaggccaggagtttgagacaggcctgggcaacatagcaagacccttgtctctattaaaaatataaaaaatacgccagacgtggtggctcatgcctgtaatcccagcactt

SEQ ID NO: 44064 - DNA, 1111 bp, Homo sapiens
aataaataaatatatttaataaatatttaaataaataaatatatttaataaatatttaaataaataaaataatatttaaataattctttgcccatctttttcgaaataaatcaataaaatagatagtatatattagacatgttagtatatatatctaagacatgttaaaaatcacaactgaattctcacaattcagtcacaaacctaaacagcaaataaaaatttctatgaccagaatttgggggaactaccaatagctataaatagaagagattattatggaagtatcatagataaaaagagtgctcgcttcaggagcacatataataatacagagaaaaatttaaagataataaaagatttaggataaaaagaattctcacttaaaaatgaaaagaaaattatctttatgtatatataacaactataactctcatcaaaaaactctacaggaacagcatgttttcaaaagtacaacaatttccaaactatttgaaataaacctattaatgattcaatggccaacattttccaaacaaaccaataaaatgcatagtgtgcatgaagctatctgttacagtctgtggcactcatatttcacaaagaattctgtgccaatctgagcccctgcactgtgccttcaaatgctcctggactgtggcaaccaagtccgtaagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatccacatctcccctgggtccggtgttctggaagtgagagagacaatgtcacacctcaaggagacagctctctagacaggaaggttattcacgtcccatgtcaagtctagctagagttcagagcaattgagaagtgcgattttatctcc

SEQ ID NO: 44065 - DNA, 1028 bp, Homo sapiens
atcctgattttagttggattaaagaaggaagagcatatttttaagtctcttatttcatttttttcctctcacaggtcaatgtctggtctgggtccagtgttccttcccaaactgtgggaaatggaggcggctgtgtgggaacattgacccctcagttctcccagataattggtcctgtgatcagaacacaggtagaaaagactggaaatgttttcattcatgttttattgttcctccctttctttctctgcacttatcctttagattaaatactacgtaaatatagttagcactcagtgtccttgtagtgcttgggagagaggaaggatctgcctctcatatggagatgaatctgggcagaaaaggctggaggaagatgccctgtaaagtgatcttgttggggaggggcctggaatctaaatacatgagcattggtctgcccctgtcaatcctgattaaaatattggtattgggttggtggatagggagggatataggatatatcggggaaaacagacgagagagatctggtgcgcttagaattctaggctgtttggaactagttggaagagatgatgatgatcttgtccagcccaattattttacagatgagaaaacagagtctcagagaaattattcttatggtgctccatagacaggagcacagtcagacacgcgggcatgcaagcaggagtgtggaatctcttcctggagtatgaggaggcaccattcctactgcctccagctgcatttcagctggttccagctgcatttcagctggttccagctgcatttcctccatgggtctttattcttcctctgtgctgatctcccaggtgcccctttggtcccacctgctgcatataccaatttccttcttgttctctccccagctctcatccagctctttctcttaaagagtctcttcctgtcccttcattccttctctctttcagcagatgtgcagtataatcgctgtgatattcctgaggagacctggacagggcttgagagtgatgtggcctatg

SEQ ID NO: 44066 - DNA, 1039 bp, Homo sapiens
acaattgcctgagatgcctgaacccagccttggggaatctcacagccctcacctacctcaacctcaggtagggaggccgagccagggccacgtgggagcgtgtgcttctcagtctcaagtactactgagtgacccacccagtgaccccgagaggatggcagtgctgggatgccatgcctggggagccagtccgctgcctttctcccttccacagccgaaaccagctgtcgctgctgccaccctacatctgccagctgcccctgagggtcctcatcgtcagcaacaacaagctgggagccctgccccctgacatcggcaccctgggaagcctgcgacagcttgtgaggatggggacgggaccaggaaagggacccctgagccaggcagcgggaccttctagggggaggttggggagggcctggagcaaagacagagatgggagggtgggttctgctgggcctggtctcatggccccttcccactgccttcctgataccaggacgtgagcagcaacgagctccaatccctgccctcggaactgtgtggcctctcttccctgcgggacctcaatgtccggaggaaccagctcagtacgctgcccgaaggtgagaagaatgaagaactggagaggaggtgtttgtatgtgcgtcccagttggctcaggctgcggtaacgaaaacactgcagaccgggtagcttatacatggcaggcattcatttttcacagttctggaagctgaagttcaggatctgggtgcttccatggtcagcttctggcagggtgcttttcctggctgcagactgccggctccttgtggtactctccgatggcggagagcagagacagccctctggggcctctttgataaaggagcacaaatctcactgatgagggctccaccctcatgatctcaattacttccctaaggcctcgcttcctaatcccatcactttgggggttaggatttcagcagaggactttttgggtgacacatttcagtccataacagtgtatgtgctttgaagaagttacaggcca

SEQ ID NO: 44067 - DNA, 1022 bp, Homo sapiens
cagtcccagcctctcctgtgatggcaacagctcttgtggccctcacctcacctgtctccctttgccacctaaacaagcctccccatccgcttttctggggtgcctttgtttgagccactctgatcttctgccatctgtagcagcttgggggcctgggcactgcccccctgaaccagtgggtgtctgaggctgggccactgtggggcgggccagacaagagtgggggcggcagcagcggcctggggctctgggaggacacccccaagagcggcgggagcctggtccgtggcctcggcctgaagaacagccggagcagcccatctctcaggtgggcgtggcacctggaggctccgggatggccctgagggggaaggtggcagacccccccaacccctgccagctgatttccaaccctgactcaccctcccccttcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacggtgggcgagcggctcccaggaggtgggcgggacctgggtctccagacccggccagggggccctgacagccttcgctcatcctgcagtgcccatggctgtagcgatcctcaaggaggtggaatccccctatgatgtccacgattatatccgttcctgcctgggggacacgctggaagccaaagaatttgccaaacaattcctggagcggagggccaagcagaaagccagccagcagcggcagcagcagcaggtgaggcagccggcaccagcagctggggtgggcttgcctggtgcctcctgaccttcaccctcctctccgctgccttaggaggcatggctgagcagcgcctcgctgcagacggccttccaggccaaccacagcaccaaactcggccccggggagggcagcaaggccaagaggcgggc

SEQ ID NO: 44068 - DNA, 1083 bp, Homo sapiens
tgtggcccaccatctccactgtcccatttgcagccgccagctcccacagtgcgcgctccgagaaaaggcagctctgggggacctgacaccgccaccaccgccgccgccacagcagcagcagcagcagctcacggcattcctgcagcagctccaggcgctcaaaccccccaggtgcgtggtgcgtgcgagccctcaggatacagggtgggggggggatgggggcagaccagagatggatttggggtcctaagaatccacaatttgctcctcagaggcggggaccagaacctgctcccgacgatgagccggtccttgtcggtgccagattcgggccgcctctgggacgtacatacctcagcctcatcacagtcaggtgtgtggcctgactggtccccacccccaaggcagtctccgggtgaaatggggtctggggtctgctccccacccccacacgcccctagctgccattctggctggggagcccactgctgcggctggactagatcagtgggcccaagtgcccacctgcagccgcctctgcccccctgccccctgcaggtggtgaggccagtctttgggacataccaattaactcttcgactcagggtccaattctagaacaactccagctgcaacataaagtgagtgggcatcctggggctgaggccctgggaatgaagggtggaccgaggcaggccccaggctgtcccctgcagctctcccctctgatgggccactggtctcagttccaggagcgcagagaagtggagctcagggcgaagcgggaggaagaggaacgcaagcgtcgagaggagaagcgccgccagcagcagcaggaggagcagaagcggcggcaggaggaggaagagctgtttcggcgcaagcacgtgggtgctcccaagcctcagctggctgggtggacaaccctcgccaggtcccctcaccatgtccccctcttaggtgcggcagcaggagctattgctgaagttgctacagcagcagcaggcggtccctgtgccccccgcacccagctccccgcccccactctgggctggcctggccaagcaggggctgtccatgaag

SEQ ID NO: 44069 - DNA, 1719 bp, Homo sapiens
ttcattgtgcgtctggcctcttctctaggccgcggccgtggtgacagctgcttttaccaaagaagcatcgaagaaggcgatggggcctttggacgaagcccccgggaaatccagcgcagccagagctgggatgacaggtggggcggggagggggcatggcgcagagccgggcaggccagggaggggaggcctgggccctgtcgctagagggtaacagaggcccaccagataagccctgtccgagatcccggtgctcctgacccctggtttcgtttgtccccttcctccctccactgcctcagggcacagtggacaaggcatggggcggttgcacagggtggcaggggaggctgtactgtttctgacccacacgtttcccctgctgcagaggcgagaggcggtttgagaagtcagcaaggcgggatggaggtacgaggctgctgagggcggcggccggggcggcagggaggaccaagatgggtggcccagtctgggggtgcttatttcggaggtgttgggggcaggagggcctggagctggcccccccaacgtttcttgagggtccaggcaccacgctgcctttctaataactgcccctgtcttcccgtctcccagcacgatgtggctttgaggagggaggggctggcccaaggaaggagcacgcccgctcagacagcgagaactggcgctccctacgggaggaacaggaggaggaggaggagggcagctggaggctcggagcagggccccggcgagacggcgaccgctggcgctccgccagccctggtgagattggggcctggtagcattggcgggggcagtggggagcaggaactgtaatgagagggtgggctcctgtagccacggggagggagcagaggctggctggtgtgggagtggccgggacagcagccctggaggtgctccgtgagctgcagcagagggggccgctggcttcgcttgggtacccactcttcttctccctgacttttcctgtgcagatggtggtccccgctctgctggctggcgggaacatggggaacggcggcgcaagtttgaatttgatttgcgaggggatcgaggagggtgtggtgaagaggaggggcggggagggggaggcagctctcacctgcggcggtgccgagcgcctgaaggctttgaggaggacaaggatgggctcccagagtggtgcctggacgatgaggatgaagaaatgggcacctttgatgcctctggggccttcttgcctctcaaggtatctgtgaggaggcgagggtgggaacctgcccttccggggtcctcttcctccccacccaccccagctgttctctgctccccaccccggccccatgcagaagggccccaaggagcccattcctgaggagcaggagctggacttccaagggttggaggaggaggaggaaccttccgaagggctagaggaggaagggcctgaggcaggtgagccgcggggtgcccagcgggcctggggctgggccgggcaggcactggtgttctttgccgggctgggcattggctgcccacctacctgtagaatcaggctacttagatctggaagaagagtgctgagaggtggggaggaaccagggggtagcagagccatgtcttcaaggcagtgtaccagatagaaatcaggcgtaatcaaaatgacctttgaaagtcccttgaagaagctgtagaacctggagtgacgtctgc

SEQ ID NO: 44070 - DNA, 1007 bp, Homo sapiens
ctggggctgatggcctttcctcctcagcaccctggttgaacccgcttcctcttctttcccagactgtggcgtcctggagttgatgggagctgcagcaccaagccgggccagcctccctcccagccagtgacaacaccgcagcacctggaccccgcccacccgcttgagtcctctgcctggggccccagggatgcgcctcctcctgaaagtcccctccatcctcccttagaggaacaggctgccgccgcgcccccatcagcctccattgccctgaccttatttccacctgatggtgccagaggctgcttcccagctggtatcctgagatcctcgttcccttggtggcttggttgtttaagcctccattattgattgggggcggtggtctgggtgtgattcctgtgggggaaaccagcccgaggtgccttggctcaggcttgcctgcctggagtccttgtcgtgtacccgtctgtggccctagagtcacctcctgctccttttcactgggtttctccccagaccaagcccctggatttgagcttctgagcagccaactgatttttttcatgagggaaagaattttgctcctagatttatttctaatccttttctccgtaactgaccttttctctgtaagctatttgtggctctagtgggtttttgtttgcttgcttgtttttgttttatctttgccctgaacgtccatcctggcctcggctgcctccctccccgagttcttcactacacctcctgtctcagcctcccagagagggtggcgagggtgctgatgcccagagacaccatccggcgaatggacctctcctgtcatgcggggcagggcagggctgccggcagagccatgtcctgaaccctccctcctcccccctgctctccttaagggtctttcccagatgtgaaggtccctcccaggctctactgaggtcagaccaattcccagtggcttgggtaccctcgttcactccagcaccagcccctgccctccttct

SEQ ID NO: 44071 - DNA, 1404 bp, Homo sapiens
atcctagtgctaggaactaggagatgctacataaagacttgttagctggattggattttttttttccagccacccaagccttacttccctcctgcctctcaaagtgtcgttctggaagatcgtcagctttcccaccctcttgtgcactgcctcttcgagtctatatagaagtttcaatttagaaccccgccaacccctcgcctttggcatggaaacaccatcggtggtaccagtaagggtctctcctttgctgccgacatgggggatttggggttctttctccttcccatctttcctgtgccctttgcagacctaggctagccaccctccaccaggctagccagctccaatctgattttcttagattgtaggtcttggtcccccagcggtctgtcgtgccattgggaaggatttgagggtagacctggccttggtgtccctgccattgcctggggaccaggggccctgagggtcccacgtggtggttagtcaagtggaccatgtgcttaaacttctggactagctttttctgctgttggacacatcagtcttgtgttcgtgatctgatgcgttagccctaacttttacatctgctattggaatttgggaattaaagaaaaatagcccactttagaggagagaagatgagaggaggaggctagatgaaggatgttgaaagtctaacaaatgtaaaatggcttcaaactcacagaataatgcttgcgagtttgggatggttactgctaccgtgcgcacctccagtcttgcatagtgtcaaggatgtcggggcacgctgtcggagcagcttcctccttcttttccctggctggagcccaaggctgggcaagtgggcaaaagggatcacaggaggtaaagagtgaaaatcctttgaaaactgttaacttgtagacaattgccaagcggtggtgtgatttgctgggatggctcagagaggagagagctgggataaccgaccagccgcgaagaatgcgggtttgcatctcttttttaagcctcagcgtcctcaccctaccacgcttggagaatctccatcctgagaaagggccaggtcccctccagcaggcctggggctgggcggttgttccagtgttgaggaattggggactgtgcttctgtttaagtggctctgttctgtgccaaggcacagtgctctgtgttggagctaattttaggggtgatggagtgaggagataatgttcttagctgaatgtgcactgggaccgcctgttctctgtcttttctttctctcttgagttctgagccccagagagcaggctccctttcccgcgcgccctggcgcctactggagcacccgggcccagcgtgtcctcgccccttgtctccggcagggggcagtctttcaaaagcattgattcagatgct

SEQ ID NO: 44072 - DNA, 1068 bp, Homo sapiens
cctcttcctctccacccagctcttcctctcccacttcggccttttctttctcacactccatttccctctacggcaatctgtgcagcctcttcccccagtctcattttgcgggcttttctctcttttctttccttccctggcacccaagccaaaggccctgcctctggcctccagccctacccccttctgcggttgcacagaaggatggctgcccagctcttaaaaaaactgcccgggaactgttgacatctgttctccctcccccgctggcttttctgattggcttacaatcctgaggctaggaccgtctcaggagccaagagaggagagcggccacagggaacctagggtctcaccaagctctcctttccttctgcagggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctt

SEQ ID NO: 44073 - DNA, 1069 bp, Homo sapiens
caagaccctgtctcaaaagaacagtggccaggtgtggtggctcacgcctgtaaatccagcactttgggaggctgaggcaggaggatcgcctgaggtcaggagttcgagaccagcctggccaacatgggaaaaccctgtcgctactaaaaatacaaaattagctgagggtggtggtacacgcctgtaatccgagctactcaggaggctgaggtaggagaaccagttgaacccgggaggcggagtttcagtgagccaagatcgcaccactgcactccaacctgggcaaacagagttggagagtaggaggcttggggcctgagctagggggaaaaagcagaggcaggtgggggactggggggcagtgtgctgggtctggtgagtccctcagtgagtcccccagctcaccttttctcctttttctgcagggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtaagtgtcccgtggtcctaccaagctttcctcgagtgttctctcacctgggatttggggtgaagggtgggttcccagagagtcatcactgctgggttcttgagaccatggagatgacaaaaaggagaattgatctttgtatcaaagagttgagatacagggccaggcctagtggctcaagcctgtaatcccagcactttgggaggccaaggtgggcagatcacctaaggttaggagttcaagaccagcctggccaacatggtgaaaccccgtctctaaaaaaatacaaaaaattagcccagcatgatgggcgggtgcctgtaatcccagctactcaggaggctgagacaggataatcgcttgaacccaggaacagaggttgcagtgagctgagatcacgccattgctttccagcctgggcaactgagcgagactctgtcttaataaataaataaaagagttgggtacagcatatttgggtcgcagaaggatgc

SEQ ID NO: 44074 - DNA, 1033 bp, Homo sapiens
ggctgaatggacagtgtgggggcctgcagaaagtgtgccctggggaaggtggagggaagattctggaacgggaaccaaggaggtccgggagggtgagctgggaagaacacaacagtccgctgggtcctcagggagtggggacagcagcggtgtgcctcccccccgccggcaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgaggtgagagctggagcttcccctgcgactgctgctcatccgggggagagtcctgaactccactcaggacccacttcttaagtttccattttgtatagttagatgttgaaatggaggcttgctctgtcacccaggctggagtgcagtggcacaatctctgctcaactgcaacctttgcctcccgggtccctgttcaagcagttctcctgcctcagcctcgtgagtagctgggactacaggcacacgccaccacgcccggctaatttttgtattttagtagagacggggtttcgccatgttggccaggctggtctcgaactcctgacctgaagtgatttgcccgcctcggcctcccaaagtgctgggattacaggcgtgcgtcaccacacccagctggaaaaaaaaaagactttattttcacctgaaattcattaatttccacttgaaattccacctgcagttgtagc

SEQ ID NO: 44075 - DNA, 1077 bp, Homo sapiens
ggatggaggctgtggtgagctatgatcctatggctgcacacccatctgggtgatagagcaagaccttatctcaataaaaaaaaaaaaaaagaaagaaagaaaaggaaggaaggaatgaaggaaggaaagaagggagggagggagggaaggaaagaagggagggagggaaaagaaggaggctgggcattgtggctcacgcctgtaatcccagcactttgggaggccaaggcaggcagatcacttaaggtcaggagttcaagaccagcctggccaaaatggggaaaccctgtctctactaaaaatacaaaaattagccgggcgtggtggcaggcaaccgtagtcccagccactcgggaggctgacgtgggagaatcacttgaacctgggatgcagaggttgcagtgagccaagatcacaccattgtactccagcctgggtgacagagcgagactctgactcaaaaaaaaaaaagggaagggaagatgttggggagagagagaaggggcacagtagaaagagggtaggatggatgaactcgggatccagtgaggtagagaactgttgggctcaggcctgacagagactttctccttgactaaattttagtcttctctgggtcctctttttttttttttagacagagtctccgtctgttgcccaaggctgtagggcagtggcgcgatctcagctcactgcaccctccgcatcccaggttcaactgattctcctgcctcagccttggagtagctgggatgacaggtgtctgccaccatgcctggctagtttttgtatttttagcagagacagggtttcaccatgttctccaggctggtctcaaactgctgccctcagttgatccacccacctcagcctcccaaagtgctgggattacaggtgtgagccaccgcacccgccctgggtcctcttcttgactgggtctcaatgttgtgttccactccctccacatcccactgccttgccaggcctgcctagcccagtttagagtgaatctgggaggttgagggtgcagtgagctgtgatcgcaccactgcactccaacctggttgacagagcaag

SEQ ID NO: 44076 - DNA, 1031 bp, Homo sapiens
agaactgccttgagcccaggagttccagactagcctgggcagcatagtgagaacccgtctcagcaaaaaacaaaaacaatgccatctggccattgcttttcaatttgcagaacatttctgtacccattgcctcacaataagcctttgaggtagggtgggtattgcttgttttccagaggtaaaacaggcccagaaaggtcaggtggcttgcaagaggacaagcccccagtgagtagggtggtgctagcccgggggtctgcctggcttcaggaaaggacgaccctggactcccatggcccagctgggttttcaaggtttcaagggtgggcgggatttggatggggctccatctgggtgaggagatgatgggatgaaggccctagaggtgggcatgaactaggtagatctgggaccaaagagagaagaggcaggaggaggttgaggtagtgtgagatgagctgggtgggctggacttggggcctaagggctaccctgagaagttgaccccaggaaggaggaaggcttataaactggggtggggagaaaggaattgagtgaaattgctgctctgggacttggtgcccccgtcctactctgggcagcccctgcctgcctctcccctaagccccctcccccactatccctccccctggactggactggggtcgtcctccggtccccaggtatctgcgggatggtggccatctcctggtacgccttcaacatcacccgggacttcttcgaccccttgtaccccggaaccaagtgagtgaggaaaccccccaccccccgccctcggggcagcgggtgggactcagccctgccccccggctggcgtctcacttgtcccccgcccccgcgccgcccttgtgcgcaggtacgagctgggccccgccctctacctggggtggagcgcctcactgatctccatcctgggtggcctctgcctctgctccgcctgctgctgcggctctgacgaggacccagccgccaggtgagcagggtgaggcgcaggctggggccgggcggga

SEQ ID NO: 44077 - DNA, 1044 bp, Homo sapiens
aggcgtcttgcaagttgcaggttgagcgtccgctgtaaggaggcggtgtgtgtgcaggtgtgtggggcttccaggacagtgtctttctggggtcttagagggctggagccaacagctctttgggcccagggcagttctttctgtggctgcggcaccttcccgctccctgctccccgctaagatgaggccgccccattgtttctccggggcagtctcccttccgtctgccctatgccagagactgagcgctggcgaccgtgaactgtgtgtggtgccgctgcacgccctcctgggtccttcagggccagtccactcaccaggcaccgtgtggcagggaaggagccgagggcgacactggctgtgaagcggggcttgagagctcacccccggggatgttggagctgctctgagcagttagggggcctgggtgggtctcctgtgcccccactactcccagcccctcctgaggcagcggcagaggcttcctgttttcatccatctctctaggactgactgtatgcagggccggcgggccccccccccaaaaaaaaccctataaaagctgagtacaacttgggccagaaccccagagttctgagtgtccagaagggacactggaggcagcccctacacccacttcccagacacatcatgctgtgaggagggggctctgctgtgagcctgcacacctgagaggggcacccctggcaactgcatgaaagatggtgccagagtccccagggcacaggggtagagggtgaccaggttccgggccttgggctaggtgcttctgcctacatttttccacagtggggaagtagggggaaacttttacagaagcaaggtgcagcaccccaccctgaatcacacaggcaggagaggggagccggcattcagactccacggctggggtggtcctgggagagggacctgactgcgtctcccaaccgtgcaccccagcccctggccacgcagcccatgtgcccctgggctcttccataatctctccattgactgctagagccacctggggactcagactcg

SEQ ID NO: 44078 - DNA, 1031 bp, Homo sapiens
cccctttgttcagccccgctcttccccacgcctgggcactttggtctctctgtaaatgaacccctccaggcagcccctcagccccaccccttccagttcttagagccccttgccctgcgactccaggtaggggtgtgcctctgttgaggggcagggctggcggaaggggacggtcagggtttccgcaggggccgggctcctgacactgtccctttccttccccagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaacccccgtgtctgcgttgaggggaggggtgggttctgaacgctgggcacagggggcggagacgtcactcctggtcctctcctgcccctgccctccaggttggcacggggttctttgtccaccccgcagcccagagcccacacccttccttcctccctttcctgaagccatgtccttgagagtgccgggcagctcggagacatggggcttttccatggtcccagagtcctgggagaaggcagtgacctgagcatgggcgggcagaacttcggggccaggccgggcttcaggcctgcattctcctctgacccactcagctacttctgtggagttttccacagcaggcccccttggcttcctcctccccaccctcccctccctttgtcttcctgtggcctccccttcctcctacctcctcctctgggggagggggagcccagtaggggaaggaatcctgcatctggcatggagtaggcgggggtcccgggagaggtcagagcccagggagccccagct

SEQ ID NO: 44079 - DNA, 1054 bp, Homo sapiens
gtttttgaaaatataaaacaaagataaactggcatcctcctaatgtatctttgaaatacacattactggccaggcgcggtggctcacgcctgtaatcccagcactttgggaggcctacgtgggcggatcacgaggtcaggagatcaagaccatcctggctaacacggtgaaacgctgtctctactaaaaatacaaaaaattagctgagcgtggtggcgggcgcctgtagtcccagctactggggaggctgaggcaggagaatggcgtgaacccgggaggtggagcttgcggtgagccaagatcgtgctactgcactccagcctgggtgacagagcaagactctgtctcaaaaaaaaaaaaagaaagaaagaaatacacattacttcatttttctcagacctggagaaaaagcacccccagccccattttcccatctccaaataatcttcagcatttgtagagatgtggcccctggaagttcatcagatatatggggcccacccacgcgtgtgttgcgatgatattagaatttgcaactgccagattctggcaccaaacccagcacctctcaatactgtcctgcaccccacatattgtatgattttttgtttttttgttttttttttttgagatggagtctcgctctgttgcccaggctggagtgcagaggcatgatctcggctcaccacaacctccgcctcctgggttcaagagattttcctgcctcagcctcctgagtagctgggactataggcatgtgccaccatgcccggctaatttttgtatttttagtagagacagggtttcactatgttggccaggctggtctcgagctcctgacctcgtgatccacccgcttcagcctcccaaagtgctggaattacaggcatgagccaccacacccggcttgtatgacgttttgaagggcaaagccaatgcaccattgatgtttgcctgttgcttcattcactcaatagagatgtaaggaatgaaagctttgattggggtgaaagaagtaaaaaagtttaaacccctactttaatgggattaatgc

SEQ ID NO: 44080 - DNA, 1050 bp, Homo sapiens
ctccttggctgggcacagtggctcatccctataaacccagcactctgggaggcccaggtgtgtggatcacctgaagtcaggagttcgagaccagcccgagtaacatggtgaaaccccaatttctactacagatacaaaagtaagccgggcgtggtggcaggcgcctgtaatcccaactactctggaggctgaggcaggagaatcgtttgaacccgggggttgcagtgagcctagatcacagcctgggcaacaagagtgaaactctgtctcaaaaaataaaaataaaaactccttaatcccatgctccctggaccccagaccaggctgtgcccactgcactagagcaagacagtgaggtcgtaaccaccccagtgatctcagggtgcccatgacctatactgcaccacaccgggttccaggccacctcttggggtcatttttttggtttccttttctgcctttcagcaaagacctttatttgcactcattttcacagagtggaaaaactgttttggccaactttctgacagaatcttctgacatcactgaatacagcccaacccaaggagtgaggtgagccctgacaaatctgtgtcccagagtgtccaactggctcggcagggaggctcattcctctaatcccagtgctctgggaggtcaaagcgggaggatcgcctgaggcctgggcaatatagggagaccccgtctcaactaaaaataaaacattagccaggtgtgttggcatgtgtctgtagtctcagctacatgttaggttgaagcagaaggattgtttgaggccaggagttggaggctgcagtgagctatgatcgtgccactgcactccagcctgggtgacagagtgagaccctgtctcaaaacaaaattaataataaaacaattttaaaagactgcccagccatcacccacttcctacttttgttgctgttggcattccaaaagtgtaatgcagcctcattattggtgctgctactgttcgtcttttttttttgggatggagtctcgtcctgtcgctgaggctggagtgtggtg

SEQ ID NO: 44081 - DNA, 1089 bp, Homo sapiens
ttgaggcaggagaatcgcttgaacccaggaggtagaggttgcagtgagccgagatcgtgccactgcactccagttctggtgacagagcgagactccatctcaaacaaacaaacaaacaaacaaaaagtattattattattttcaagatggggtctcactgtgtcacccaggctggtgtccactagcacgatcttggctcactgcaatctccacctcccgggttcaagggattctcctgcctcagccacctgagtagctgggattacaggcatgcaccacgacgcccggctagtttttgtatttttaatagagacggggttttgccatgttggccaggctggtcttgaactcctgaccccaggtgatcagtccaccttggcctcccaaagtgttgggattacaggtgtgagccaccgtgcctggcctggtttctagactttctttagcatgggggaacccttagagtaccgccaggcctcggggttggtggcagagcagagagggacatggggtgggagttgagtgacagcccagggtatgaggattgaggggtgatgctgggtctggaaaggtgccctgaggacaagagtgaggagaagggaggttgggacactgaggagctcaactgaacgctcagctctgtagggaagttggctgccctcctaggtgaccctcacgctggtgataggcacgggccaacccctgggacaccggggtggcatcagcaaagacctaaagagattagggtgcacagattcaaggtagtcaggcagtttggggcctcctggaagcagctgaggagatgggagtgcaggaggtgctgtccagcctcgggctggttccttaactttgctgagcctcctttgtaaaatggagaaggaaaaacatgttgtacaaacccttctcttttacaggggaggaaagtgagaaaggaaaccaatcaaattcgtgttagctcaagagggctgcgggccttccccggtcagcctggggcagaggctctgcctgcacctccccctagactccagctgccttccacagtgtcctgaggggaggaatgagccatcagagggtctcctgagggcacac

SEQ ID NO: 44082 - DNA, 1063 bp, Homo sapiens
gcttcagccttcctagtagctgggactacaggcccacgccacgatgcccggctaatttttgtgtttttagtagagatggggattcactgtgttggccaggctggtctcgaactcctgacctcaggtgatccacctgccggcttcccaaagtgctgggattagagacgtgagctactgcgcccggccttacattcaccattaagtgcacattctgtaaatgaacgagcagcagattccagcacagtaggcctgtgtgttattcatgctgaggggcattgaaaagcagtcaagattagctcccctcatgccacccgtttgtgacctcagtgccacctgggcctctaagatgtatgtggcagagactagaacttctatttaacaagagaaagaagtaggagttctgtggctatccagtgcccctaatgggcaccctgcattggttggtgggtgtttgtttataccagtgaggtcctagccaggtggttggtcagggatgtgtctgccattctggcccagggacttgtcattttactgtagacttggctcttccctctggtgccaccagcgaagccaggcttttccccgtctgtgagtggggtctgcccagtctcctggtgtgggcaggcgcagggatggaggactcctgcccggagcccagccagtggggcacccaagctctcctggggccctgctgctcccctgctcttgagctcagtgttgccacctatgcacgggtcccccttgtggtgctcacgccactctgagccgctctagaggagacccctgcgtgcccagggcacagtacgcgacgcagccccatggcacaaggcccagtgtgcgtggccagccgctggcagctgtgctgctcggagggcagagttccatttgcattccactcactgccggcagctggccctcctctcctgctgcctttatttgctgcgtggaggctctttgtgggctttttgggtctgagtcactgaacactggctggacattcactgcctgggagatctctttgccagcactgcggtgcccggtgggaagaggttgctggaatctg

SEQ ID NO: 44083 - DNA, 1022 bp, Homo sapiens
catgagtcaccccaaaggtgcatgggcaggcaggtgctggggaatcggctactccccagagcttggcgtggccatccctgtggcccctctgggagtctggagcccattccctcacactggtactcactgcagctggggacatctgcactaggaagacaggacacggcatggaagctggcctctgcccagaagccatgacattctggtcaccagcctgatgctataaaacgagtgtcacggccgggcatggtggttcacacctgtaatcccagcactttaggaggccaaggcgggtggatcatgaggtctggagttcgagaccagcctggccaacatggcgaaatcccgtctctactaaaaataagaacattagccaggtgtggtggcacatacctgtagtcccagctcctctggaggctgaggcaggagaatcacttaaacccaggaggcggagattgcagtgagccgagaccacggcattggactccaggctgggcaacagagcacgactccatctcaaaaacaaacaaaaaaaaagagtgtcacctggggctacttggccagacacagagagcaaggagacatccctattatctgtcaaaaataattgttggggctgagcacagtggctcatgcctgtaatctcagcactttgggaggtcggggcaggaggacttgaggcctagagtttgagaccagcctgggcaacatagcgagcaccccatctccagaaaaaatttaaaaattggctgggcgcagtggctcatgcctgtaatcccagcactttgggaggccgagggggatggatcatttgaggtcaggagtttgagaccagcctggccaacatggtgaaaccccatctctactaaaaatacaaaaattagccgggcatggtggtgggcacctgtaatcctagctacttgggaggctgaggcaggagaatcgcttgaacccaggaggcggtggttgtagtgagctaggatcatgccattgcagtccagcctggacagcaaagctagact

SEQ ID NO: 44084 - DNA, 1059 bp, Homo sapiens
gcttcagccttaactggcgtgagccactgcacccagccagttacccatgacttctaaacactttaacactctttgcatatatgctgttatagtagctgcctcgtgtaatataagcagattaaggatgtccttaacttggcaatactctaaaattgcatatatggcaacatctaatttatctagggaatgatgagtgcatttcctacatatatttaagcactaaaacttaaattactagttttgatggaaacgagtttcaagcattacataatatgtacattgcctttcaagtgatccgggtctttactttgaatatattctattgttgtatatcatgaaactgacccctttaggaatttacgagttgtgtgtggctagctgcctagaccctaatggatccagaatgctcggagtcttctgcttttcccatttactcatattgatctctgatctgctgttttgctttatatgtagttgttttgtcccatggttatggggcatttttatctcccttctggactaaagtgcttggactgtgagctctcagtcactcagaagcctttcagacctacctccagggttatcttccagatggttgaaacagcgaagaattggtctgtgaagaaactcagaaagatactgctaaatctaggcagattaaagacagagggtctactgccaactctaacatatcagaattctcactaaacgcaaacatcgccctccacactaaagttatagcttagcaaataagttactgacgtagggtgattctgtgagtgtgtactgttagcccagacttgtacagcatgggagaaagagaatttaacaaaagaagttatttttcaatgggaaaaaagctcatcattttgaaatctcttaaaataatttaggaaattatttcaggggaaatttcttgacttagggtataaagttaaattttatttgtaatataattagtgatcttttttctttatatataaaatagactaaaagtaaattcctgttatcaactatccattactaaggggttagctctaggaatattggataaccagc

SEQ ID NO: 44085 - DNA, 1026 bp, Homo sapiens
tatccagaggagatgtgtgaatagggagatatggaagttgagaggcaggagtaagtgcttctagctgtgggactcaagagatggcccgaagggataagggggaagataatttaacctgagaaatgggatgagtaccgtgcagggttcttgagctcagtctaggagtaggaagcagtctccatgtaggtgggacacagcacatgtggaagaggagcatgaaacgcccgagagaattggggcagtccctgggcagctcactgctgggctgaggaggtgagacagactttgtcaggcagtagagagccagtggagattttgcagcagaggagacttaagttataccttaagttggctgtttttgaggtggctcttgtgcatggattgagttgacaggcagatagttgagcaatctggagagctttgaatgtctgaatatttcttagcatcttaactaggttagtagctccacggaaatgcaaaagattggtaacattggtgcctggtttgttgtcagggttggaactttcttgctttttcttttggactacttgtagagtgcttattatgtcccagccactcgtaattctatcctcacaggaatgaagcataggtacaattattacacctgttttccagatgaggaaactaaaggtttaagtggctaagagaaacctttttgtcctccacctgtgctgctccttctcttcctgtccaggccttcttcccattcagactcactctctcattgacctctcagtttcccttcaccagcatctccccatctgccctcttttgtctgtgtctaccggtgtatcctttgctcaggtcctcatctcttcatatcttggcaactgttgtgacactctccatgccatcatttggactctagaattgttttatctaaacataattgggtcatgtctgtgtgtatgtgtgtgtgcacatgcatgcatgtgtacgtgtgtgtgtgcacgtgtgagggcaaaaagatacctcctaggcctggcgtggtggctcacacctgta

SEQ ID NO: 44086 - DNA, 1050 bp, Homo sapiens
agtatattggtttgaagggctgtcagatcgcagagagtgttttaaggtctaggagttttaaaggctgaggggaaggatcaagggaagaggatgagattaagattccaagagaggaaataattagtggagcaagtcttggaatatttggaagggtagaattaaaggcacaaatgtgagaagctaactgtggaaaagaggagagagaattccttttctgagatggcagggagtagaaaagcaagaattactatatggagaaatgttaaagtggagatgaaagaagctgggagtgctggcgtctaatggtctttgtttcagtgaagtatgaggctgggtcaccttcagaggtgagattgataggatgctggggtccaggggacatgcttctgtcacagcttggaaagggcatgtgataagcccttcaagcatttagaatactggcatcattacaccttatcatttttttcatatgtggtatgtgggttaagggagggagtgagagacagaaagattttgagcatctttggaaagctggatgaatttggtactatatttgaccttttccttatgtatcatctgaagagtttttgccagtgtatataattgttaggagaattagaaataggatacaaatatagttgaacaggatagtctgtatattttaaaattaatgaagcctaataaacaattaatgagcatctttacaaccatttaaagttttcaaccttttaaaaattatagcaaccgtgcttgcagacagtccaaaaatacaccatgggccatactttgcctatcctggtataaaacaagtaaatcttccgagaagtgtttaagataagcccaggacagttagtaatataggaaaagatctgggtaagcatggttgagaatttcaacattgcaattttttaatttttaaaaatttaatttcttcaataattattgaattaatttgcatttattttgttagccaagtgaagtaatttttgaatttttaagaggctattattggtggtttataagatgacttgccaagtatatttgggataa

SEQ ID NO: 44087 - DNA, 1075 bp, Homo sapiens
tgcatagaagaaaagaagccaggcttaccaacagcagcaatagctggactcctattataaatgtatttggtacatacttctcgaattgtctcagcattcacagcctgaaatatggaagacactgtcattcagctgtttgtagtaaaaacaaagtctatacctggaactttttaaaactaaagcaagatgaaagatacatattctcagcttttgtaacaaggatctttttacacatgacccaatagtaactcaggactacttacatcaattcttgcttcaagctcagggatgggaatccttctattatagcataacatttgcctaccaatatcttcacaaattggagttgaacctgtttaaagagaaggaaaaattaactattggaatacagatcaaccatatgaaaacagaacctatatctttatttttaccatcaagctgcaacaacatgtttgttttcagaagatttctggctcgtgcaacctcactttctgtgacacttgtacagagtcgcatcctaaaaaacgtggaaaaacagtagtagttggaaaatgttgtatttcatgagttaatgacctaagaatgatgatgccatcttctacacaaaacatacaggtgattacaatttaattccaatgctaagcaaaagctaaaatgattattttccccagtattaatttctcaaaaatgatacataaacatgcctaattacacattagcagacaaaggctttatacaaatgggctgatcacattttcagaaatgctataagcatcttgagacttcatgagtcctcatctgttggagtctgatatgctatgggttaagtcagtgggtcattcattggtttctgaaaacaatgagtagagtctaacttaaatctaatttttaacaataattacatcctagttgactagatttagaaagatgtaaaccaattaagaatagtggaggaaaggaaccagagctaaatgttttccaagaagctgcgagcctttctgcccatctatcgactcaatatactttgttttcttttagcagtggcaacttcagatttactttcccttcaaccaga

SEQ ID NO: 44088 - DNA, 1058 bp, Homo sapiens
tctaagggattgaaggggagaaatgagccaaagctgactcttaagatagcagctgacagaagcaacaagggcaaataaaggttctttttttacttgtgcatgtttgaaggtagtctagaaggaacaatgtaaatggtagagcttcaaaataaaagaggccattttgctatgccttcaccttttggtagagaataaatgagattgtctgcagaaagggtgaatatgagtttgaagagaggtttgaaatggccttgtggatgaataactcagtgacccacagacttgtcaattagtgtccaaggctaatggaagtcacatgacatgagtactgggaaaatcaggcaggctgtgggcagttcttggtccctcaggcagacctatgcagactggaagccagagtgaaaagctggtgcttctttttgggttggcctgagaggagtatggggtcagagtgagaatgacattgagagttgaggaccacaaagccctagccaggaagagagtgtagaatagcaatacagtatacttctaagtccctgacttatgatatttgtgcagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaaggtactggttttaatgaaacttttcttcaactcacactggagcctggagataatgtagacagactccaaatagcagcacttgttatcacagaaacttgcagagataaattctgtgccacagcagaaaagtgtgaaaagtgaggtgcattttgaagctgtcagtcttacccattgcatcagtacacatgcacatatacatatgacagaatacttgtttctcaggaaattgaagatcatgagacaagtcttgatttatgttggcttactctgtcatggcttgttctagggattaggttttctgtagtttttcttttac

SEQ ID NO: 44089 - DNA, 1050 bp, Homo sapiens
tattaaattacaaatatatcttaccaattatatgcagttactcaaataatgtaactgtatgtgaagcagtacttttgtcatgatgattgttccaaaagcttctcattataagatgtgattcacaaacatttactttatgtttcacttgatcatatccccttaaaagttatttcaacatggaaatttaaaaataatagctagtaatatacagagagaaaaattaaactaggaagcatttcaaagcaggaaatataagtgtagggaaaaaatcaaactgacatttgaatgaaactaaaacatacacaaatgtgataaacaattatggttcctgggtctgcagatatgtgtttatatccaaaataatgtttcctgtttcagcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtaagaatgcttctacatgttcaccacatgcttctacgtatagtgagcccaaatgtgataacatttggcatgtcaagtttaatgagatatgtgagggttttgttaattgctaatggtattgccatgtatgaattattaaggctgtcttaatgagtaaaatagaaaccagtttttatcatggcattattccatgttttcccaaaagccaggcctttactgacttttaactctaatatttttaaagaatgaactacaaaagaaaacagtggctgcatcacttggcttctccaacttaattcagagatgcccagacaagtcgtttaaaataggcccattggatacagaatagactgaaacagagtctgttttctgctagtgagactgctgtaaatataggagtgagtgatgtcctataaatgaatgtagcaaataaatgtacctttaaattatgtctgcttttaaaattttattatggacattatcttgagaattatcacctgaag

SEQ ID NO: 44090 - DNA, 1028 bp, Homo sapiens
aatcagggagaaattttagaacaccaataaaagaaaattctaaaccctctaggtaagatttattgtactttccttggtagcattaagcatttttttaaaggaagcagttatcttgaagttctgaaaattatgtgagttgtaaaattccttctccagccaaatatcaagtattaggaaaaaacaaaaactgttatagacacacaggattcagaaagtttaccaccctctctgaaagatttactgcaagatacattcctggaaactaatccaagaggaagatgagatattcaagaaagagtagtaaacaagtaaaaaagtaaaacttttagttcagtctaaataagtatggattatttgaaaactttaataaaaacttggaattaaaacgcagaagattgcaacatgaaaagtatagaaggtggctgacaggaaagggaacagaaaaaggaaataaaatactgcccaagttcttaacctgtttagaatgaaactgtagatcttggttaactcttaatgttaatagaaaactttaaataaaatataaatatgtgtgttaaaaaatagataagccagatagaggttatataacttctaaagcattaggttaaaattagaacaaagaagacagttcagtaatgtcaggaaagtggaaaaagtaaacaataaaatacagggtaaatagaaaatagaaaacaatttgtcaggagccaattcaaacataccagtaatgtgataaattagagtgagttatattcacttattaaatgagattctcacagtaagttttgaaaaataagctgtatatttgcccttatgagagacttaaactaacataaccaaagaaatagaaagtcaaagaggaactaatataccagacaaatgtaacagaagcagcaaggaggcatattaaaataagatagaattcaggtttcagcattaaaagaccaaaaagggatatttcatgcatcagtacatgtagagcactttgcataaagcatggcacataataaacaagttaaaaattagtt

SEQ ID NO: 44091 - DNA, 1066 bp, Homo sapiens
ccagagtggactgtaaatcatgatcgtgttacacccccacctcatttttcttttgaatttttattgcacaggagacccaatcctctgtttgcactttggatgtcccttatgtaatttccctttcagttgccaatatttgagttagtatccttccatccatgcaaacttccctctcttctgcaactcatcttttggtttgatcttgtgtgttgtaccaggagcagacacctccattctgcatcctttgacgtgcaatggctagggcctatgaaccgagaccctcctgaggcccatcataaggtagataactaatcctcacttccgtgtcactgttaatcagccaacaccaagattggtgtaaatcatgaggctgtctggggtgtcaaatagtgaagctgaagaggaagtagtttctaaattcccccaaactctatttcagctctttagcagccaccttgtgttaaggcagacatgcttcttccttggcaattaaattgccagaattgtccaaggatgagaacaagcagaggctttggagtaactattctgttaattaataaagacctctcagtagtaatctggatatatacatctgcatgaaacagaaaatcactttgtgctggtttttatgttatctttttcatagttttatttgtatattatcctgctacatgtatttgtctgttcctcttcttaatttcctcctgtccactttctatctttactaggttgctagcaagtgagttcaagggtggtggctgcctaaaagtatatactctgtaggacctattatgaagacaaatacattgtgagtatagaattattattggccatgagatacattcttacattggctggaaaatatgacatttcattagggattgataaatttaggtgaccttaattgttatcacaattgttagttcaccaacaggtatccttatctcacagctgttttttagataagattataacattatgggatttacttaattagaattactttttttctgttctgaatatcaagatgactttcatgttcacacaaagcaaataattcaccatt

SEQ ID NO: 44092 - DNA, 1066 bp, Homo sapiens
aaatgcagtttgattttttcagtctttttattttatttgaagcatttcatttacttttaatacaattgttaatataattttgtttctattatcttgtttatgccatttgatttacctgattttttttctcccattctgtagattgccttgtcattttattggttgtttcctttgctgtgaagaagctgttgagtttgatgtagtctcatttgtttatttttgcttttgtttcctgtgcttttggcagcctatccaaaaaaatcattgccaaaactaatatcagggagtttttttccctacgtttacttttaggaattttattgtttcatgtcttacatttaagtcgttagtccatttgaattaatttttgtgtatggtgtaagatgagagttcagttttattttttgtgcatgtggatatccaatatttccagtaccatttattgaagagactatccttttcccattgtgtatttttggtacccttgtcaaagattagttgaccttatatgtgtggttttatttctggactttctgttctgtggatctgtgtgtctgtttttatgccattaccatactgttttgattactgtagttttgtattaataatatactttgaaataaggaattgtgatacctctagctgtgaaaaatgccattggaattttgatggggattgcattgaatctgtagattgcattgggtagtatggacattttaaaaatcataattcttccagtccttgaacacaggtatcttttcacttatttgtgtcgtcttgaatttctttcatcagtgttttatagttgttagtgtataaataattcaccttcttgattaaatttattcttacatgttttattctttttgatgctgttgtaagttagatttttttaaatttcgttttttgatagttcattgtaagtgtatagacatgtttgttgatttttgtattctgcaactttactgaaagcatttattagttctaacagctttttggtgctcatttatagttataaatatttagaacatccctgtgtggctgaaagattattatgatgattttt

SEQ ID NO: 44093 - DNA, 1049 bp, Homo sapiens
ttactggcagttttgtagtacagaaagtgagtgctctggtataagaagaaaatccatgtttttgttttgttttttacagacaagcaatcatctccttgggccaaaaccatttccactagacagattattagcaatattatatagtatcgtggacagcagagttgctccaacagcaaatattttttcccaggtaagcttaatcatagattattatctgtcatctttgtgggattcttcagatagtagagtcaatagaattccaggcattcagatttttgttcaacatatgttactgttttaactatataatgaaccatgtttttggtaagtaattgaaaattacgtatatagaatctttgggggtatcactaaatttacatatgtttacaagtataacctcatggcaaataatttaatttggctctttttcaataaaggaatttttaaaattaaataatcataattatcttgctaattaaacaagtggcttgatgaccaagttgatgaattgtaatttaatgaaaacaaaattgaaaaatttttttttgtaacagagtaatctacaatgttcttattcctcatctatgtactttgcagatagatgtgcttttattaaaaaatgctgttttccagaataattaagttctcagaatttcactaggtggcagcaaagcataaaaatagaaaatatgactttaaaaaaaacaagtagttaaggtttgttttttagttgacattttaagaaaaaacaaattattaaaattatagtcacagtagatttcttaaatggtccagaaaaacaatgcttagcacatggtacaagtggatagaagaaaaagcaaaatgatataactagtatttatttaaaagcaaagtcatgtcagatattgcagtgagcattttgttttctctatgcatttttaggttgagaaatatgtaaataatgcctgcgttttaattaattcactgaataaatctggccccagaatagctgtcagactttgtaatctaatgtgtgctggtaacttttaatttttcatttagagaag

SEQ ID NO: 44094 - DNA, 1026 bp, Homo sapiens
cattagagaaatgaaaatcaaaaccataatgagataccatctcaagccagttagaatggctattgttaaaaagtcaggaaacgatgctggtgaggctgtggagaaataggaatgcttttacactgttggtgggagtgtaaattagttcaaccattgtgaaagacagtgtggtgattcctcaggggtctagaaccagaaataccatttgacccagcaatcccattactgggtacatacccaaaggattgtaaatcattctactataaagacaaatgcacacctatgtttattgcagcactattcacaatagcaaagacttggaaccaacccaaatgcccatcaatgatagactggataaagaaaatgtggcacataaacaccatggaatactatgcagccatgaaaaggatgagttcatgtcctttgcagggacataggtgaagctggaagccatcattctcagcaaactaacataggaacagaaaaccaaacactgcatgttctcactctaagtggacgttgaacaatgagaacacatggacacggaggggaacatcacacactggggccttttgcggggtggagggcaaggggagggagagcattaggacaaatacctaatgcatgcagggcttaaaactgagatgatgggacgaaaggtacagtagatcaccatggcacatgtatacctatgtaacctgcacgttctgcacgtgtatgctagaacttaaagtaaaatttaaaaaaacaataattctcattaaaaacacatcttatttttgggggtatactttgtgtacagaattatatatgttagaattgttaaggttacttttagtaacctcaatttctagtaaaaacctaggaagcaagaaattttgtcacatgtcagttttttatagatatgagcaattttgtaattttataaatatgtttataacctaacttttatgtgtagtgatagtcccaaatatagtcttttcttagactttaagaagccaagaacaaacttatgtttagtaattt

SEQ ID NO: 44095 - DNA, 2079 bp, Homo sapiens
aacatggaagaataaagatattcattttcttttttttcttcagatagtgttgtttgtgtttgtttcaaagtttgtaagtggcatatttcttgaaagtttattaaatcacctgaaaaatattcttttcagggatcttttctggaaagatgctttatgaattgatatttctgtatttttcagaggctagttctataggtagcttaagataggagaaaatgaagtactactttgatattcatttaggtttgttttctctaacaaaccttatgatactgcctttttaactgttattcataaattattaaacatattttagtgtttcaaccaaagagaaaatcaatacagttgccccttggtatacttgggggattggttccaggaccagtcccatatatatcaaaatcctagcacactcaaaccctgcgatcaactccgcagaacctgagtgtaaaaaagttagccctccatatacatgggttttgtattccctgagtactgtttttgatctgtgtttgtgatctgtgtttggttggaaaaaaaaaaaaatctgtagacaagtggaccctcacagttcaaacctatgtcgttcaagggtcagttgtttattttgattagccaaattgtgtaccagttgctgttaacattatgacactttagtgttattacaccatgcttagatctgaaaatctaaaattaaggtaagaaagtttggctaaagcgaataatttctttttgattcttcttctctacacttagtagaatttggaagatttttctattttaaatcattgttttttatgaagtagaataggaagaaattattttaatgatttggttcttagttttctgttatctagttatatgttatatagttacacatttatatatatctttttctgtgccttattgaattattttgatatgaaatacttgggaacaaactaatatatatatattttttttaaataaatggaattagtatgtttttaaccagtttgcttaaactgctgttcagtagaattccagtgttgattcatggaaaactactaagtagttataattagttaattagtactcctcaaactttagaatacatagagtttctagagagatcgttaaacatagattcctgggtctcatcctcagagattctgatttggtatgcctgagatggtgccaagaacttgcatttataacaatcgcaggtagtgctgccaatccaaatactttgagtcatacgaaactcaatgatgtttagtttatgagaatgttcagaccttagaaaacaacagttaattatttgtgcttgaggtttttcattatatgttttatggttctatgtgacataaatataacctaaaagaacaaattatgctttgttactgtagggaagttcacatttttaccctgcagttttgataatttgaatctataaaacaaactaataatagattaacgggaaaaaaaaggcatacaaatttattttttaattttaatttaattttaaatttaattttatattaagttccaggatacatgtgcaggggcgtgcaggtttgttacataggtaaaatgcgtgccatggtggtttgctgcatctatcaacccctcacctaggtattaagccctgcatgcattagctattgcatacaaatttattaatatgcatatgggcacaggagccttacacaaaatatgagactcaaaaggtggggggcagaaaggggggccagctggttcaaatttttatgacatcctgaggttacagaaagaaaatgggcttggagcatggcataacaggttattggagggagaggagcaaagacttggttagggaaggcagtcttgtgcaaatgaaacctcataggcagcaactttcagaaagaatagatggtagcctgtgctaagtttctctgtcacaccttcaaaggtgtcagaccctcaagtctctttcttgagagttaatctttcctagatccaaggtggggggtgatcagagaaagcctgtttgcatctgctgttttcttatttcctctacagatgcaaatctccctcacaaaatacagcttttcagggctg

SEQ ID NO: 44096 - DNA, 1029 bp, Homo sapiens
gtatgcggtgattgaggtctagaatctagatggatttgagtatggtcagaagctttcattgcaggtctttcattaaccactgaccctgagctggtaatctttgtatagatggttctttttaattttttttttttaacaattagaatagctgtttatatttcatagacagtttggaaaatgttgatgtttaatttttctttgaccttttttgttttaattgtagggatgggaaaggaaagagacaagaatttctgttttcccttttagaaatcttcaattaattaagatcttatctccatttaacagaaaatagtaatatatctgaggctggaaaacagtcactttcaaagtaacagattctatgtctcttagcacattttcttcactttgttctttttctgtttttgccctgaaaagtattacttagtttcagtgtgtgtttgcgacagaacacagaaggcaatcatttaaaattatgctcacatttagtatgtttttgaaagtttcagatttcagggctcctctgatttacatgtagatttcagacatcttctcagctgggaaaaaacaaaacagtttttccagttcaagcttatcactaacattcctctagaagttggatgtcttgggatccctggcttctgagggaaatgataacacaagagacttacagagaggagagggtcaggaaaacgcacctgagtgagatggacttaggagcagataatcctcctcggtctttcctggaaagtaacttgcagttaccactctttagcactcgaatcctgtgggaatctgtgctgacagccatttcaaagtagattataaagtacaagaaggaaaaatttagggaaaatatttatgggaaaataaaatgtaaagagagaaatatatatttaaatgtggtattttttaaagttcttcgagtttcactgtggaatgattttatttagggtgaggttacagctttttaaaaaataatattcataaatgtgtagtatggtttaagtcttatactactattggtaa

SEQ ID NO: 44097 - DNA, 1088 bp, Homo sapiens
ggcagtttatgtactatcccctttttcttcctagttgatttacttaataggaagaaaaataaactagaatctacagtattttttcccttgttactgattttgccggtaataaggttgttgagattttctttagatgtcattgttttctatttgtcttagtatttaataattttttttttaccctcagtttcaaaattgtgatttactttttcagaagtatttttactcaaaacacttctgacaccaaatgtgtggggtatttttgttcacccaacaacaaattcttcagttttctagatatcaaatgggtgtcctaaaattcaattcacttctgacactaactaccagaagttagtgcagacctcacaagttaagggcttagtcctacaagaatattagcatttcagacaccattctaagtcccaggtttctacctgtactccagaaaactggctataaattggggtttcacatgagcccctcctcaggtttgataatttgctagaatagctcacagaactcaaggaaacactgtacttactccatttatcataaaggatacaaatgaacagccagatgaacaggtacacaggacaaggaccagtggggtcccaagctcaggagcttctgtccctgtggggctggagtgtgctaccctctcagcatgtggatatatttactatcctggaaactctcagaacctcatcatttaggatttttttatggaggtgccattatatagtcatgatttgattaaatcattggtcattggtcatggattcagtctttagcccttctccttttcccaaggacaggaggtggggccttgatatggtttggctttgtgtccccactgagatctcatcttgaattataatcccgtaatccccacatgtcatggagggacctgttggaaggtaattgaatcatgggtgcgattcccccatgctgttctcaagatactgagttctcacgaaagctgttggttttataagtatccggcattttccctgctggcactcattctctctcctactgccctgttgagtgctttccaccatgattgtaagtttcctgaggcctcccca

SEQ ID NO: 44098 - DNA, 1104 bp, Homo sapiens
tgtttgttagttttccttctaacagtcaggaccctcagctgcaggtctgttggagtttgctggaggtccattccagaccctgtttgcctggctatcagcagtggaggctgcagaacagcggatattggtgaacagcaaatgttgctgcctgatcattcctctggaagttttgtctcagaggagtacccggccgtgtgaggtgtcagtctgcccccagttaggctacttggggggcagggacccacttgaggaggcagtctgtctgttctcagatctccagctgtgtgctggtagaaccactactctcttcaaagctgtcagacagggacatttaagtctgcagaggattctgctgccttttgtttggcaatggcctgcccccagagatggagtctacagaggcaggcaggcctccttgagctgcagtgggctctacccagttcaagcttcctggtctgcaatggcgggcgcccctcccccagcctcactgctgccttgcaatttgatctcagactgctgtgctagcaatgagcgaggcacattgggcgtaggactctccaagccaggtgcgggatataatctcctggtgtgccatttgctaagaccgctggaaaagtgcagtattagggtgggagtgacctgattttccaggtgccatctgtcaccccttttttttttgactaggaaagagaattccctgaccccttgcacttcctgggtgaggcaatgcctcgccctgctttggctcatgctcggtgcactgcacccactgtcctgcacccactttccaacactccccagtgagatgaacccagtacctcagttggaaatgcagaaataacccatcttctgtgttgctcatgctgggagctgtagactggagctattcctattcggccatcttggctcccttgtacagaacttttacacagaaggggctctgtttatttgttgaagtttacaatcaaccaaaattaacaaaatgttgatggagtaaagaataatagctaacagttatacagtgttaagtttgttaactcagtgttctagggatttgatggacgtatacatcaaaccaattccaagagggaggtactattatta

SEQ ID NO: 44099 - DNA, 1034 bp, Homo sapiens
gtcttatataacccatagcatttgattcctaagaatacatcctcttggccaggcgcagtggctcacacctgtaatcccagcacttttggagaccaaggcgggcagatcacaaggtcaggagtttgagaccagcctgactaacatggtgaaatcccgtctctactaaaaatagaaaaattagctgggtgtggtggcgcacgcctataatcccagctactcaagaggctgaggcaggagaattgcttgaacccgggagacagaggttgcagtgagccgagacgcgccactgcacttccgtctgggcgacagaaggaaactccggctcaagaaaaaatatatatatatcctcttaaaactcctttgcttttatgctaatactcttaactagttgatttcttcagcttcttaaatgttggatttcccagtgttgtgtccccaccaatgttacgttatccattttactaactgcaataatcaattcccatacctttacctgtcgatgactctagaatttgtaatctctgaactcaactgaaactactaaatacattacttgtcctatgaagtacctcaaactaaacaaatttaaaactgaccttggccgggcacggtggctcacacctgtaatcccagcactttgagaggctgaggcgggcagatcacttgaggtcaggagttcgagaccagcgtggccagcatggcgaaaccccatcactactaaaaatacaaaaattagccaggcatgatggcacgtgcctgtaatcccagctatttgggaggctgaggtgagagaattgcttgaacctgggaggtggaggttgcagtgaacccagatcacgccactgcactccagctggggcaacagagcaagactttgtctcaaaacaaaacaaaaaaaacctttctttagataatggctaaaactattttctagcttcataaaatcaaacacttttccaaaaatatgtttccagaaaaatctttttaacttaaaaaactgttcattgaccagagatttgagggtcgagtcaaaa

SEQ ID NO: 44100 - DNA, 1030 bp, Homo sapiens
aggttgcagtgagctgagatcgcaccactgcattccaacctgggggacagagtgagaccctgtctcaaaaaaaaaaaaaaaaaaggaattgcaagtagcctgtaatcccagcacttttaggagtccgaggcaggaggatcacttgagaccaagctgggcaacatgatgaaacccctgtctctacaaataatttttttaaaatattagccaggtgtctggcacacgcctgtagtcccatttacttaggaggcttaggtgggaggatcaccacttgaggccaagagatcaagatcagcctgggcaacatagcaagacccccacctataggaaaataaatccgagcgttccaagtgttcagctattcacccactttaggtttccaccttccttagaaagtagagtagtataaattatttctgaaatttgtgaaacgatgtaccacataaccctctcaaaccaggttgctactacttccaatgacttcattgataaggggcaaagtaactcgaatgatgggtgagctcatgacatggtttagctccgtatcaaactctggatttgggaaaattgctactgatttattaaacacttgaattcttatatgctaggtcagaatttggcaactaaactctcagaaatttgtaaacttcctttttacatagaaaagtgaatccaggctgggtatggtggcacgtgcctgtaatcccagctgctcaggaggctgaggcatgataattgcttgaacctgggaggtggaggttgcagtgagcccaagattacactgctgtactccagcctgggcaacagagggaggctctgtctcaaaaaaaaaaaaaaaaaaaaaaaaagtgaatatactgtactgtaaagcctgtgcacctcttcatcacacataattgcctgtacattatgcccagtgcctggcccctattggatttctgacaagctttaatgttgttaggttaagagagaacctgttcctcaagtttagtcttatctctagtatttaaatttttcatgaaggaaggct

SEQ ID NO: 44101 - DNA, 1045 bp, Homo sapiens
ttgacacttgatgggcattcaggtatacatggttttttagagattgataagattaactgtgcagtctataaactgtaaatactggcttttaaactcttttaaaggagctcttttgataaacaatttggataagagatgaaaggttagggaggctccaggcaaggcagaagactgctgatggcccagagatagttctgccccaaaaaggtgggaagaagaaaaaaactgagctggatatttttaaggaaatatattttatagcatttttctttaatgcctagttttgctgcaagcactgaagtttatcctgcatttgtatttcttatttgaaaaagaaatggcctttggggtttgttttgttttttgttcctttgtaagcacactgcaaaagcggcgttgtcagcgttgtcttttgaggtatcaaacgtgctttcagtcagcaaatatcttgtatatagtaccattcctaataaactaaattggttatcaacctaatacaaacggtacttcatacaacttaagcctaaactagattagattatgtagaaacttattcttagagaatatatcgccttaatatttcttatcctgaaaagagtatttcttaagtgcccctctcaaagtatatcgattaatatttgtctcaaatttaaaactatatcctggtttttcccttacagttgtttagcaagtaaatgtttacttactaatttattttctcccagacttcattctaccagtttaagcttagctcagttttgttttttggttttgagaaggagctttgctctgtcactcaggctggagtgcagtggtacgttctcagctcactgcagcctccggctcctgggttcaagcgattctcctgcttcagtccgtgagtagctggaactacaggcgcacaccaccacgcccagctaatttttgtatttttagtagagacagggtttcaccatgttggccgggctggtcttgaactcctgacctcaggtgatctgcctgcctcagcctcccaaagtgctgggattataggcgtgagccaccg

SEQ ID NO: 44102 - DNA, 2324 bp, Homo sapiens
tcggcagccaatcagcgcctgatgtgtcctgtcgggcgcgtcgtggttggctggcgatgacctcatcctgcagcagcgggtggggccaaagccgtagggggaggctgttgcaaaggtagagagggagaagtgacgatggtgatcgttgctgccgcggccgatatggaacccaagcagtggcgaagggaatcgcaaggctcttccctgaccattttctactgtccctgcgcgaggtgagggccccggctcggcctctgcaaaactttggggcgctggcgcggaggaggagacaggatttctcccgtgacttttgtaactgcgtcagggcaagatggcgctgggtctctttggggcgcggggggagaggcacgtccaccgccgcagcgcatgtgaccgggctgcattcctgtggggtttggctccgacccaggccggggcgggggaggggacagggcttgggcggaggagactgtggtgcggtcggcgttggcggcctgaagaggaagagatgactgttggaaagcgttcccctcccccatacggcagaacagctgcggctcccaggggaaagcccccgcaggacagtcctcgtggggtgtgacggctgttggtggagaaggtttggcgccctattttcttatctgcctttctccccgcaaagtatacttatgtaaggtggtagttccctgacgtgggactcggaatcaactaggagtccttgagggcctctgggaggcctagcgaggggtagaccagcttctgggggtacaacgtcaaggaggatcgattactttctgaggaaacagtttctcagattgaaatagaaaagtatttccaaagtttggaaacaaatttaaaggtgtaaataacacccaggaacactttaattgctttgaaaaggcataagcagccatctgaatttaagggcccttttcagactcttccttcctcctgtgattcctgttctttatttcagttttctgtctgtacatcccttaagaatatagttttgtcggtgggattcgctcttttgtgcccaggctggagtgcagaggcgagatctcggcccactgcaacctccgcctccccgggttcaggcgagtctcctgcctcagcctcccaggtagctgggattacaggcgcccacaaccacaccctgctaattttttctatttttagtagagacggggtttcaccccattgaccaggctggtctcgaactctcgagatccgcccgtctcagcttcccaaagtgctgggattataggcatgagccaccgcgccgggcctgctttttttttttttttttttttttgcactgggcattagtaatacggaataaaagccgtgttttaaactgtattaagttgtaagacttttcagtactttcaagtctgctttctttctgttgcccttttgtagtttttaaaaataaaagatgcaattataagcacttccggtgaatattattccttaaggttcctgcatcatcatgaaatttgaagcacttttatagtagtacaaactatacttttagcttttgaaatctcgataggagaaaatatccagcagttttaggggctattttggcatattcattaaggtagactaagtttgtttttcgtttttcccacttagccaaactagttaaagtagtcaaaactagcaaataatttttaaagggcttctccttttgggtggtgtagagggtggggagttattcaacaaacacatttgcagccaaaatctggcctacttcttggcagagcgcttatacttggtgctacgagaaaatgattgctggacctgaaaagaacctgaggtcaaggttgtgctatttccttaagtcttagttgtaggctcttggtagtttgaaaacaagattgggtttttaattcatttgtgtatccttaaatcctcactagtttttgtggatttcttttttcagttataagcaactgaatgtggatgagctataaatatttagtacaaagaatgtaatttgtccactctgaatagaaagtaagcattaagaactcttgaatgtcttcaagggttactttgttacgtgtaagatgtctccccttccttcatagcagtttttattcctgcttaaaaagggaactaaatatgaagtcagtagattttaaggtaattttcagaatgtttctactttcaccgtgccttaataaggaaaaaaggccattttccaagcgaatggaaacaccctttccttgttttgtgcctttaatcagcgtgtaccttcattgttcctgattgccaaatccacgaacttcttgagctctcaatttttcttgactttc

SEQ ID NO: 44103 - DNA, 1033 bp, Homo sapiens
cttcggaagtacaaaacacagttgtttccataaacatgcctctagtatcatcctgcatcaggcactttgactcacttattcggaagcctcctccaacctccaactgatgcgagggtgtcaggtccctcaagttggagttcactgagaagttaactcctgttctgtcagggctctttacccaggaagaatacattgtgccccgtccagagtgagtcgagtccagttggctgttgggctcagccctgtcatgtgcaggcgtttccagggttttatgtagggcagttggctcaactgcatcgagtcctagctgaaggtctgacacaggttccttttctccaggacactgcctgttgacttcagtcctactcctagggctcgtataaccaatagtctttatttcttgcagacccagttcagttaaattagaatttctaaaaggccccaatgttaacatggttgaagatctgtcatatccctgtttacaaattaaaaaaaaaaattacacaaataatcacatcttgggactgtttatttcaaaatttaccagtaatttaaggaaaacaatgtaataggaaaaaaactaccaattcaccctttttaagttaacttcttacctcttgactataagtgcgtctctttatttctggagaactttctggggaagaaatattctgtatataaagaaagaattagaattgaaaatttaaaaatacgtaagtatatccataataattatagaaatgaaaacaaaatgaaaaatatacagactttagttttagatcttgtttcctgtttatttccattccccaaataagactgctttaagatcaattagatacacacatttagtctactgtgtatatcaacaagatgaaagttatgctcattttagtaaaaataaaaacatctaaattcatataaatgaatttttctgatttttagtttcttacaaccttttttttgtattctcagcacactagttgttaaaggaggggaaagagctcttaaaagaaattccatccccccaagtgtt

SEQ ID NO: 44104 - DNA, 1033 bp, Homo sapiens
atgtggccctgttccagaaggctggtgctggggtcccggtcccaaagtggtatgatgtgtagcttgtgagggatacggtggtacagttggatgagcactcgaaggaaaaagtggaggtccttgatgaggtgggtggtgtaaggcttgagctgatgtggtatgatgcccagaagccaaaacactggaaggtggcggcggagggggtggtgggggtgctgaatttacaacatgctggtgttgtgcttgtagaccttggagtcctgtggatggatggggtggtggatggtgatgaggggcaggaccaggagggggtgggggtgggggtaagtggtgtccagcagtttgagaatgaatatgcgacccaggggtgaccgcatgaacaggccctactacatgtgctacagagtgttgctgatgggaattcggctgttgtacaaggtgcggtcctggagcaggtggtggtggaggaggaggggggactacggcagcagcagtttgatggtgaatggtagggttctgagagggcaaaaaatgccctggagtcacgtggtgtcctggaactgtttgctggcttgtggtgccaggaagtgcttgatttggtcctgatgtaaacacagtttgttgagaaagactacctttgagctgattataattctgaaagtttgcagagggctgctggttttgatagtaagacgaagaaggaggtggaggaggtggagggggtggtgccgtgctgttcagactttgttggttaaactgactgtatgttgctgaagattgtcctgagggtgtctgtgtaaataatgttccagaagttgcctgctgagtattggctggaaggttctgtgctgctggataaaagtttctttgaggctctcgctgaggtgttccaacttgaggtgactgtgaatgatgaggcctgtagggagatcctaactgctgtgaaggaggctttggtgaaagataaccatgctgtacaggtgtgtgaggcgtggatgactttggaggattttctaggtgaggtgatggagga

SEQ ID NO: 44105 - DNA, 1052 bp, Homo sapiens
cagtgtctgctatacagaggccaaggctattatagtggttgaggcaggtgctggagtcagacgggccttgttgagtcctgggttgaactctcgttctaccatttatagagtgcataccgcgctctggccaggcctgcatgcaggtgcggctgactcactgacgttttggttttgcttcctgcaaaatgaagagaatacatagctcttatatctttccttagaaatgtaaaaatacttctgaaacttctttgaatgtggaagaaagaaaaaaattagtattgagcactttcaggaggctattttgtttgattcagatcttcataaagtggcggtctcttctataaggagaaaaagctgttgacttgggggccagtctctgaagtgcttagcatgtcgtctgttgtatcctaggcatttgagctggcaacgggagattatttgtttgaaccacattctggggaagactattccagagacgaaggtgagtattggtgcctgctgaatacctcggtctaggtcttctgccagccctgaacttctgtagagtactgtatttttgtactgaaatagagccatgtgtttggttttcaaacaccaaattcagatgcttttcctttgagtttgatgccccctcagtctcagtgaatgggcagagcctgcctagcacaggcagcactccagcgagccctcaggggccctacaccagcggctcttcctggccttgcacagggcaggaacccagctggctgagagaagacagatgatacagacctgaagcctctatgtggtccttttgaccattgatgtgctgcccatttctctgtcctgtttgggagctgagttgaaaacccaggaattctggcttgaatgccatctgtaaacctgaccatctccatgcttatttgcttgcgatgctggggtggcctggggtgagctggcctcagtcactgttactgctccaggtggtgcctgaggcctgccattcccacaagcctctgcatggatgtgctgcagacactgttgatttgaatctatttctgattttttactaa

SEQ ID NO: 44106 - DNA, 1032 bp, Homo sapiens
ggttttaccccaaaagccaagaggtgtttaccaggtggtacataagcatattcaaaatgtattttattgatggagataagtacttaatgaggctgtattaaggagagtaacaagttctaattcttgacccatcaaattcttaaggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaaggtaagtgtttcttcccatcaactgtctgccatcgctgactccagggacgtgcctttaacaaatgctgtgaaggaattggctggaagtggccaagccctgtgtgtgtgtactgatcagttttattacttttatactcctgaagaagtaatgtgatttaaataaattttctatgccattaggctatttcttgctctctgcataccaaatcttatttctgaccagttttcatttttaatatatttagtcagcagcatcatttgcaaaaaccttccagttttagcaacttacacctttctagaatgtgtagtttagtttaaaattcgtatcttcttccatctaatgtcattatatttagtttagtttagttttgttttgtttctattcaagaaaattatgcctcctctt

SEQ ID NO: 44107 - DNA, 1067 bp, Homo sapiens
ttttcttttttccttttagacagagttttattctgtcgcctaggttggagtgcagtgccatgatctcagctcactgtgacctccgccttgtgcctcagcctcttgagtagctgggattacaggcgtgtgctaccttgcctgtgccactatgcctgtgcagtttttttgtgtttttagtagagacagggtttcgccatgttggccaggctggtctcgcactcctggcctcaagtgatctgcctgcctcggcttcccgaagggctgggattacaaggcaaggctgagcccggccttgacattttaaatgtaatttaaacatatcctaattgcagtattatccaaaacagtaaatattctaaggcaaaaaatgtcttaaaatcttatcctagttttatctacttcactggtacttactaggaacttgtcagtatcttattaaatcatatttgccatgcccatgattcatcttggttttttttttggccaattaccccacccgtcatactcatttcctgtcctgaattggtaacctctgtgaggatatgaggactgtaagcaacatgaagcctgggagcttttatatatcaaacacctggaataatggcatgtgataggagctcaggcgatgcacattcagtgaatttatgtaaaaatactctgtaaggtaaagttgttttaaatgtttgtagggattttgatcgtttttaagaggtattcctgttttcattttccttgtaaaatctttgttccctctcacttcataatgctactttaacttctactaacagtaggctaactactaatagcttactgttgatcagatgccttccactgtcgattaaactgggaatatttcagtgttggattgaaggagtggcctgcccctccacacctgtgggtatttctagtcgggtgggacgagagactgagaaaagaaataagacacagagacaaagtatagagaaacaacagtgggcccaggggactggcgcccagcataccaaggacctgcaccggcaccggtctctgagttccctcagtttttattgattattatcttcattatt

SEQ ID NO: 44108 - DNA, 1026 bp, Homo sapiens
gttgaatttgtgtgcagataactttgtttagcctgcctgtgtgttcatctcttcttccttttgtacggtttttttttttttttttttttttttggagacggagtctcgctctgtcacccaggctggagtgaagtggtgcaatctcagctcattgcagcctcctgagcagctgggactataggtgcttggtaccacacccagctaatttttgtatttttagtagagacagggtttcaccgtgttgcccagggtggtctcaaactcctaagctcaggcagtctgcctgcctctgccttccaaagtgctgggattacaggtgtgaaccactgcacccagccttgtatggaaaattggcagcttattctgtaacatgacagatgttacttgagaagaggggctggagagggaaaagttcactacattgtcttctatatcagttgaattgaggtgtttctatgtagtattatgctaggtatacatgtgggcctagatttatggctaacttttgttcagtactgtatctgtttgcccttagctttcaaatagtagcatttttattcattatttcgacaggctgatatctcaaatgaacaactttaatgtagaagaggttatgtggtgagggcagaaattagtatgttaagtggaattatttgatccccaaataagactagtgtattatttgtaacatttagcagcaactctaaagtctttaaaaaaaaaaaaaaacacaaaaaaacacaaaaaaataaaaccatattgttaaaacttgggaagaatctcctaattatttttgataaatcttgaaaatattaaaggaattacacattctaacaaatactgaataatttcagaaatagctgcctgcatgtatttcccgcaggctccatcatttcccagaacctcatgctttcagaggggcttgctgttgccttaagtgactgaccacaccaccaccctttaggcttagtgtgtaagaaggtgaatttggccaggcgcagtggctcacgcttgtaatcccagcac

SEQ ID NO: 44109 - DNA, 1031 bp, Homo sapiens
gggatatgcagtaagtgttctttgtcatttgtgcatttgtttcctggagtagttcaacatctgtgttctaagaaggtatggctgagggtcaccactgctttgttgaggtatgtgaagtgcttagcacaggcctgcctcagctggctagattccttcctgccccctgccttagtttgaagttcatttgaaatcttaaaatattacttgcttccagctttatttcaaagttaattcattgaaattgttttacactgggattatattatttttctagtaattcatccatatcagacaaacataatgtatagtataggcgtttcaaatcagtcatttttaacttttcaaagccatgacccatagtaagaaacttcattgctactccatacacacacacacacacacacacacacacacacacacatttggtgcgtgtgtgtgtgtgtgtgtactgaaacaaaagtgttaaaagagaatggttttcactattaggttggtgtgtaatattcgtgataactctgatgtttatctagtcttattttaattagggaaaaaacaaaacaaaacataaaagagattgtcttgacccatactactatttaatgtggccccaccatttgaaaagtactattttaaaggaaagcttatgtttctgtgtattggatagatctcattacaagttgaatatcccttatctgaaatgctttgagaccagaagtgttttggattttggaatatttgtgtatatacacaatgacctatcttggagatgtgacccagatctaaacacaaaattcattatatttcatatacaccatatacacataccctgaaggcaattttatacgatattttaaataatcttgtgcaacatgcaaatcttttactgagttttgattgcagtcagaggtggaattttacactgtggcatcgtgttgacacactcataatgttttaggttttggcgcattttggattttacattttccaattagggatgctcaacctggataccagtgattctttctactgat

SEQ ID NO: 44110 - DNA, 1032 bp, Homo sapiens
gggcacatagaggtaaatgagaaacagccctactttctagattatggcctcttagactttgccactagaatgccagctacttaagggcagagccttgacctgtctagcttccctggcaccccagtagaacaatctgtggcctgctgaatagtgactgaatgaatagactgctcaaatatcttttttttcatctaagtgtggttcgttaataataagtgagaaaagggaagatatgtgagggctaaaaggaagaatgttatatttgaatagaggactcagaaaagatgttataaaaaactgaaagggactttgtcagtaaagaatatttggatgatgttgagagtatggggcactactcagactaaatcctggaggcagaacaaggtgtaagaagccctaactgcttgtgttttcctaacaaatggggaaactaaaaattgatggtagaagattaggtttaaaagcagtttgggagcatcatgtagaggatagagatgagtgtgagaaatttgtggtgaagtaactttaaagcatcacttcaaaatattaccaaaaatccccacagaaaaccgaaagaaagcagagtagaaacagaatcctggtgttataatctctcctctttttacaaaacatatttagcaggccgggcatggtggcccacgcctgtaatcccagcactttgggaggccgaggtgggcagatcacgaggtcaggagattgaggccatcctggccaacatatcgaagccctgtctctactaaagatacaaaaaattagccgggcacggtggcacgcgcctgtagtcccagctcctcgggaggcggaggcaggagaatcacttcaacgtgggaggcggaggttgcaatgagttgagattgcgccactgcactccagcctgggcgatagaacgagactctgtctcaaaaaaataaaaacaaaaaataaaaatatatttagcaaaagagcagtgccaaaatgtcagcagtatgtggtaggcctgaggtgtttttttgaaatatacttttatcttgt

SEQ ID NO: 44111 - DNA, 1892 bp, Homo sapiens
gattctgcttccaagccctggggattaccaagatcaggggcagggtcagcctgtaaacaaacactgtcgggaggccttgtgtcatacatgcttgtttcatgagtttgagcaaaaaaaacctgtgtcacagccaaacctccttttgtgggaagatttgtgtttcatgtggggttttcagaggcagtagggggtgcctggtaaacattcctaggctgcactgtaaacccctgaattggaatccttgagagtgggacttaggaatccaaatatttaacaaattcatcagtgatttttctgcacattgaacactaaaatctgctccattctaaggtctgcatgtatcatccttctaaaactccaaggatataaccacatgaaggcacccttcatactatacgtgcaatataagcggaatcattgctttgaactaccttatgttcctaactttttccagaaccctcggtgtatacctgctacaaggacatactaaatggtgactgtaggaacattgccttgcaatatcaggctgcctgtagtagctgtcctcagacatgagttttgttgctctcttaaatcattcttagataagttggcacctttgtacagttttcatctcttgaattatttctggagacatcaacagctgtggtctgacttggtatgaaaacatgtcatttccttagaaatgcatttattcgacctctaatcagaccctttcctttattacccacggtattgtcccccgcatccccaacttatcatagtgtggaattgtacatttatttctgtgttcatgtatctccccctctctagtctgaaaggttccctttggtcaaggccctgtagtttgttaactccactgcatttgaaccatccataatgcagtacgtattttgtttggataaaggcattttctctagtgttgggttgcaagtacgggataggcagagtgctgatgttcaggtggatctggggaaggcatgtcggcatgagcaggctggcatgctgactggcagatcagaatatagggcctttgtttctgcctcacgttttcttaaaatcatccatagttctccggaatacttaacctgtcacacacatttgagtgacatatatttcttacctgtaaaaacttagggacattattttcttcaaaatagagcataaaatattataagtatacacactagaagcatgtcagatgagtttcttcctatacacaaattgcctttacccatgtgtgtctattttccatctgtgaaaacggtagactggttgaattttaataactcacaaaatttactgttggtggctatttgctgtcattggcatccctcctccctttctccttccctccctgccccccaaccctccgagtctatgactttgatttattttattttattttttatgagatggagtttcactcttgtcacccaggctggagtgcaatgctgcaatctccactcactgcctctacctcccgggtacaaacaattctcctgcctcagcctcccgagtagcttggattacaggcatgcaccaccatgctcagctgatttttgtatttttagtagagatgaggtttcaccatgttggccatgctggtctcgaactcctgacctcaagtgatccgcctgtctcagcctcccaaagtgcagggattacaggtgtgagccactgtgcccaatctgtgttgttttttaaggaaaaaaaagcaaagaaccttaaagctgctttagaattgatatttgtacagtaaaaagaataacaaacaaaagaaatatttgtacagccaagtaatgttggctgtgttacatcagaggttcttcgctgggtgcggttttgacccctgggagtccatttgtgaatgtttggagacatttgcttgc

SEQ ID NO: 44112 - DNA, 1052 bp, Homo sapiens
aacaactgtactgagttctgagttccagtttttaatcatctctgtcctggactaacaattgcagcgttttcccatgaattttctttcttcttgcttttatcctttctacctgttctacactctaatttcatatgttttttgcagaaagctaatccttgtttctatggttgcatttcagtggctactacttgcctcagggatagagcccaagcttcttagcattgtggtttattcttttgaattgtggattattcctatgcctaacctctttcctctctccagtcataccagattagtttgggcctctgtgcttttgatgatgtggttccctgagacatggacctcctgcagtcagcctcattctggccagtctgtaagatcacctctagatgtctctgacttggcccactaccatctctgtttccataacgataccaggagcagttgcttacatttgtgtgtttacatgcactttcccctcctcactagactgtacacccctcagtgctgggcatctgtgtgcttctgggtagttgtagaatcagtggatgtcattttacatgcatttggactcactggtttaacttttctgtcagtctttctccatttcagtagtaatattttctgtcagatcccacaagtgttttataaaatattaatagtactagtggcataagacatatgtagtgctgaaatgcaattttagaaccagaggtttgctttttgcaaagaatatatggaattaatgtgtaaaatgggaaggataaaagcaagaaacaaggaaattaatgaggaaaagttagtccaggaaatagatgataaaaacctgaactcagaactcagtgaggtgatcaggcagcaatacctttagaacaccaactcctttcttttctaaaatgtagattagttgggaagcaggtctgatttacttacatccttactaactttgagttggctgtgtactacgttctagaaaacagtatggtcttaggaaataagtaagtagtatttggcttggaattacaattgtttgctattaggacttggggagt

SEQ ID NO: 44113 - DNA, 1033 bp, Homo sapiens
ctaccatgtacacagttaccatggcaggggatttatgtgtcatctcttttaatatttacaacactctaatgtgcatcagaagcctagagaaatggtcactggcttgagttctcatggattggtaagtgatggaacaggtattcagcctaacctagagccttgttaccagaaagctgtacatttggactgtggcttgtatcttgactctccagccctaggataattagttgcaactttaccatgactgtaacagttattttgttgttgtggtggtgtctctctctctctctctttttttttttttttggagacagggtctcattctgttgcccaggctggagtacagtggtgcgatctcggctcactgccaacctctgcctcccgagttaaagtgattctcctgcttcagcctcctgagtagttgggaccacaggcgcgtgccaccatgccctgctaatacttgtatttttttgatagagatgagttttcaccatattggccagactggtcttgaactcctgaaaggagtttttggggggtgataagaatcttgaaaaaattacctcctttccttcatctcaccagtcactgagttccttttcctggagacaaccattattggcttgttgctccatccagtgcttaggatgtctgtgtaaaacaaatgatacatagcatacacagtgctctgcatctttttattcatcagtgtgtatatctttcatattaatacatgtagaagtgtttcattatttttgcataacaactttattaaaagattaattgcacaccatgtaattacccatttaaagtataccattcagtggtttttcagtatactcagagttgtgcaaccatcaaccacataatttaactttttttttttttttttgtagagatggggtcatgctctattgcccaggctggagtgcagtggctatttacaggtgtgatcgtggcatattatagccttgaactcctgagctcaagtgattatcccatctcagcctgcacagtagctgggacaatcagc

SEQ ID NO: 44114 - DNA, 1045 bp, Homo sapiens
atgtttggttttaaaatgtgtataatctttgatctggcagttttacttctggtactgtgccctaacaatttaattggtaaggtatagacaaagatgcatgattaaagatgtttttcacagtatatacaatcttcccaagactggaaacaaaggaatggttcagtagttttggtagacgtgtatgatgaagtgcctgctaaagtgatattttacagtgtttttaatgataggagaagatgtttatgaaaagagggatctcaaattatatctgggtaaaaattgagaggaaataaatggagttattttggtttatctgtggatactagggctgtaaagaattagtttgtttatagccctgtgatttacagataatgaacaaatattattttggtaatccgaagaaaaataaatactacttttcaagcagaaaaatcaccagttgtatgttaattttggaaagttggctctgttaaaaaggaagatgggttgagtggggagagggatgtggcgccacagatagatggcaaaggatatggttaggactgttgtggacagggggttatataagggagacaccacagaaaaaagcagcatcttgtttcagggatggaaattgaggcagtagtgacagaatgctccgtgatgctgaccttggcaaataggtatggttggggccaaagtagcatttggcgttggtgtgatattggtttgaaatcccagaaaaaatgtacaggctttcgtaaaccagatcatcaggcagtgtagattcttgtctggattcaagaagggcatgaggactgttgtagctggagaaagaataagattggtgagaaaagtgggtatcactcgctcaaagccacagggtttataactgatggagctggaacttaaaccaagctctcaacttttaagactatgcctttaactactactctgtacttttcaaattctagtgacaggagtgaaatattatttagttagtaaagacaagcgtataatggcaacagcagatacaagtccctcataatgacttgacttaggattt

SEQ ID NO: 44115 - DNA, 1035 bp, Homo sapiens
actgctagaatataaatgaattcccctttccccaagaaattatcccccggagaatagtgctgtgcaacatctctcatattagagggaactatctcaatgactttattttgaatagctaataattctttgtgatgacataaatggaaatggtttcaatcttttgttagttttaggtaatttagagttcactagtagaaatagttttttttttaaagatattttaacacctgttttgttaattatttctcatagtttcaaatgttgaatgtttctcatgccttttatagatcatatgaaaaagcaaaacaataagtgattgtgatatagagaggatatatttgtttgtgtataaaaccaaatggaaaagctaactgacatgaacgagaatgagtagttatttttgacttggggaacacttcctttggcaataccatacatatttaaaatgcatgcacatgcacacacacacacacacacacaatcccagacaacgtagaagtgaaaatgctgcatttcagaaaactgactttagactaaagagatggctttactgatgagtacaatgatggtaaaggtgcatgtgataaagcatttgaaataaacttgctttgtgacaatgggaaatacagtctttccaaataatctataacatgaatttaaatacatatgtacttgaattaaacattaaatattataagcaaacatttgactattttatctctattcctacaagtttacaaaattttggtgggagccgttgccaaataatacttgtagtttccaaaaaattacattaccctgtctgcctcagatggtctcccacagaggtatctaatcttttggcttctctgggccacattggaagaagaagaattggcttgggccacacataagatacgctaacactaacgatagctgatgagcttaaaaaattgcagaaataactcatgttttaggaaagtttgtgaatttgtgttgggcctcattcaaagccgtcctgggctgcatgtggcctattggacaggcttggtctaa

SEQ ID NO: 44116 - DNA, 1050 bp, Homo sapiens
agtgtattggatgataactttacctggctgccccggcctaatgactccgtagaccacaagtttgcttactgccttcgtgctttgttctcttgtcaagttgtccattttggaagaaagcttagaagagtgtgctccaaagtggtcgtgggtatttcggtctaggtggtggggttataaatgatgttactttcttcattgtgttcatttctaatttcctactgaaaatgattttcttattaaaatcaaaacacagaacaaattttcagaaattatttaattttaataaaaatgaaataatgactgtgtaatggtgaagcttgtcattcaggcttctgggttccaaataatacaaactgactggctattttatttctagttacagtgattgaagtaggttgtgtaataaaagagtgggcaatgggagaggcagcagctgtgggcaaaccactggatcagccttgaggccatggtgctagatgtgtcttgccactgaagctgagtccttccagtgattttcccctgtagttttgccgcttgtgacctcgagacttctttggagagtcaccaccagtgggcatgttacaaactgagcctaggccgtgggcctctgccttggctgcctgggagtaaggacagactgtacctcctgaggctcctggagtgggaagcagtgctttatgctgactcctgtccagacttttctcagcatcttttctcacccaagggatgatgatgatgaggatgatgacgacgatgatgattttgttaccttgactattgatcagttaggactttgaggcaagtatcacctttcaggggccatctgccttgaagtgaaaatgattgttaattttgttgctagttgtttattcaagtgatgctgctttgctgttgtttaccctgcacgattcagcctttacttagaagcttttgtcatttgtctggttgggggagtatggaatagttattttgacagaggagctgatttagatatatgccttgcctttaactctaggttattttgctcatgagttgtgtcaaacttaataa

SEQ ID NO: 44117 - DNA, 1064 bp, Homo sapiens
ctccgcctcccgggttcaagcgattctcccgcctcagcttcccgagtagctgggattacaggcgcgcgcctggtaccatgtgcagctaatttttgtatttttagtagacacagggtttcaccatgttggccaggctggtattgaattcctgacctcagatgatccaccagcctcggcctcccaaagtgctgggattacaggcgtgagccaccgcgcccggccctgtattttttaataggaaatattggacagtatctttttgttttactgccttctgaacagccttgcaaatgtttctttttatagcggttttaccccaacttctctgtgttctcatggactcagtggggtctccacctactacagtggttttggttggcctggaaaagcctcctgaccagcggacgggacttgggccctctacccctgccagctcttcagccctcgtggggcttctttatggcagctctttccttctagaagttcccactcaatgtttgaaatacccacaagttctgaaccttggaggcacactcatcttattaatggcagagttgggactccaactcagttaccttggctgtttctcttccattttattgatggcagcagccagaattcccgacaaaggtctctggattggactggtaaattttgttcattccacttctcacgtgtgaatttaggtaatctgctgagctgcagattcttattgtgttatggtttagagataataacatctttgtaactgaaattaaaatttttttttgtcttgctgcaaattcagtctattgtaattctcaagtttcttcacagccctaaatttaccgttcgttatttgagattgcttggcatgtggttttttttttttttttttttgagatggagtctctctctgttacccagactggagtgcaatggtgcggtcttggctcactgcagcctccacctcctgggttcaaggcatgcactaccacgcccggctaatttgtgtatttttagtagagagagggtttcaccatgtcggccagactagtcttgaactcctgacctcaggtgatctg

SEQ ID NO: 44118 - DNA, 1056 bp, Homo sapiens
aatcttactctagcaaatagtaaggatttttgccgatgtaaccttccagcttttctttttgcagcagctgctagagccattatcctctctctgccaggcttcctactcatgctagttgttaattgccagggtctacaacagtggggcccacaggctttatcctgcctcgcggtgacctaacattttgtcactctgctatttaatttttaaaagtgtctccagctgggtgcgatgatgtgtgcctgtagttgtggctactctggcagctgaggtgggaggatcacttgagcccaggagttcaaggccatagtgcatgaagattgtgcctgtgaataaccaccgcactctagcctgggcaacagagagaacttgtctcttgaggggaaaaaaagtgttttctaaatgcagaagcccgagttactttatctcctcattttcccccgtagtctgtatctagttggtcactagatcctaccggtttctttgcaggagtcctctccaaatgcttccgtcaaaactcgctgtactgctttcatctgtcattcctcatttgccctcaaatattgttcactagcctctcttcctgttcctccgccctttgcatcatccccagaattatattcctaaaagagactcattaatatagcttaaaacaggtcgttcacagtctggtggtcctctttatctaaagtcctcactgatcctgccatttctggctcttttacccttcttatcttcataatgtgtacttccctctgcctggacctcactgagaagatgccatgtcccctgcacgctgcccttaccatcccactgcagagggtcctgctgcctcctagagcaccatctagacctttgtactgagactcagtgcttctcactccactagctcgagacgcaaggagctttaactgtctcatgttcacgtttctggtgcctagcacgttctttggcctatagacacaaattttatttgaataaagatttttatttctttcccacttggttaggaaatactaagaaaaagaggtgtgtgtgtgtgtgtgtgtgtgtgtg

SEQ ID NO: 44119 - DNA, 1048 bp, Homo sapiens
gtacaatcagctgtaacgaggtaaaagattcatcaatagattcttatattcagtcaagcatttacgaaacagctaaatgagccattgatgttagcagttaagtgacatagtcactgagaaaatttgggtattctatttatgctaatgaatctaaattttgtaaggatttcaagaagttatgtgattcaagcctctcactctaaacaggtgacaaaacattcaacacagatggctggcttgtttttttttgtttgtttgtttttttttaaaataaagatgtacaggaattaagattctctaaccttaccttttcaaccatggcctcatgattggttgctcaatatattttcaatgacttaattttgttgcactacaataaaattactacttaattttgttccccttctaagacagttctaaaatgtaatcacctttttggtcaagaccttttcatttttctttctggaatttgaattacttttgtgggggacaggggcgtgctctctgtgtagtctcaggacggcttggatctagtctaaatagtattccaggaaacagcatctgagaaatcagggtgaaatgaaacattgtggcaccatcttgaaactctaaatacttgcataagcgggaaaagagatggaggagaggatgggaaaatagatgagaggggtatatagtgaccaggtggcaaagaaaggtctttgaattttatgctgatgtttaccaagagccattgaaaggttttagcaaggatgtttgtagataatacatgcacattttcctgtgggcatgaagtaaggtcttttaaagaaagtctaaagaaatatatttttccccctagcatggaaggctataagatatgctgtagactttgcagcaagatattattcatctgttctggaaattggtgggaatattatggcagcatttacaatgagtgacagagagtggatgaattccttgacactgggggtattaaacatcgaaatggagtaccatagttagaggtgcttctttctaaagacaggtgattgacctgttaagtctt

SEQ ID NO: 44120 - DNA, 1079 bp, Homo sapiens
tctgatgatagtttcttttgctgtgcagaagctctttagtttaattagatcccatttgtctattttgacttttgttgccattgcttttggtgttttagtcgtgaagtctttgcccatgcctgtgtcctgaatggtattgcctaggttttcttctagggtttttatggtgttaggtcctacatttaagtctttcatccatcttgagttaatttttgtatatggtgtagggaagggatccagtttcagctttctacatatggctagccagttttcccagcaccatttattaaatagggaatgctttccccattgcttgtttttgtcaggtttgtcaaagattagatggttgtagatgtgtggtggtatttctgaggcctctgttctgttccattggtctatatctcagttttggtaccagtaccatgctgttttggttactgtagccttgtagtatagtttgaagtcaggtagtgtgatgcctccagctttgttctttttgcttaggattttcttggcaatgcaggctcttttttggttccatatgaactttaaagtagtttttttcccaatactgtgaagaaagtcattggtagcttgatggggatggcattgaatctgtaaattaccttaggccgtgtggccattttcacgatattgattcttcctatccatgaatatggaatgttttttccatttgttggtgtcctcttttatttcattcagcagtgatttgtagtctccttgaagaggtccttcacatcccttgtaagttggattcctaggtattttattctctctgaagcaattgtgaatgggagttcactcatgatttggctctctgtttgttattggtgtataggaatgcttgtgatttttgcacattgattttgtatcctgagactttgctgaagttgcttatcagcttaaggagattttgggctgagatgatagggttttgtaaatatacaatcatgtcatctgcaaacagagacaatttgacttcctcttttcctaattgaataccctttatttccttttcctgcctgactgccctggccagaacttccaacactatgttg

SEQ ID NO: 44121 - DNA, 1027 bp, Homo sapiens
atattgttgtgtgtagttgtaattaattcagtctcatatctgtacagtattcatgaatatacctcagtttattcattctattaatgagcatttgggaggcttacagtttgtggttattaggaatagtgctgctatgagcatttctttttcttttttttttttgaaatggagttttgctcttttgcccaggctggagtaaagtggagcgatctcagctcactgcaacctctgcctcccaggttcaagcaattttcctgcctcagcctccagagtagctgggattacaggcccgcgccaccacgcccggctaatttttgtatttttagtagacacggggttttgccttgttggccaggctggtctcaaactcctgacctcagtccacccacctcagcctcccaaagtgctaggattacaggtgtgagccaccttgcccagtctgccgtgagcatttccatacatgtcttttggttaatgaagcttgcatgcatttgtttaatatattcctaggagtgcagttgctgagttttagtgggtattgtcagttttccaaagtgaatgtaccactctatacttccaccaactgtgtatgctccaggttcttttcaatttggtattgtatatatttttttccttctcttacctttccctccatttctcccttcctttttccttgttagcattctggtggctctaccagtgttacccagagtttgcaccattttgaggaggattagaagtagaaactggactatttctgaacatgagcgttcctgagggggaacagaattagaagcatagaccagtaagtgaccctagggtgttgttgttggaggcactgctttcccactgattatagtcttgtaactgggtactagaggccgtgggtattaacattagttttcagacttggtttcagtagcaaaaccttctttcgtcaaaccttaataggaagttatcatgtaaaatatataaagaagatgcttggtttgggagctggggaatgtaaatcagagccgcagttttt

SEQ ID NO: 44122 - DNA, 1048 bp, Homo sapiens
aaaaaagaaaacacccctctgctttaaagaaatggtacttcctgctttcataaacagtcatgtgcatagtttagcaaggcctgatgcctctggagctttttccctttatagcaccattgaatcccagtcctaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgatgtcagttaactctgagaagtcgtcctcttcagaaaggtacagctacatctcttgcatgaacaattaatggtgtagcattgctaagaaacaaaccaggacatatttttttttcttgtcaagtttgctatataacgtattgtcctgcatgctggtattgtgctgtattgaagatgtgtattggggcaagctgttctgcttttgcaaagggtgattgatttttttaagaaaaatagtggagcctgatcagctgcagcatgcacaccataacacagcagaccgctggttcatgtgtgacagctgttgaaggctttaaaaataatttagctaaaaagcagaaaagaaaaatcttgcttttttaaagggaaatgctgtgaggttttcttcctatatgttgaggttgctgctctacagaattacgaaggttatttgtaaaatgtaggttaaaaatacttgattttgggttgtaataaatatttattcttatatggtaagggagtgccatttgtaaatagcttaggaattgcaaacccacagattagtcacattctgtaagagagatatgatgcttcttcaagtctgtgctaggaaatggaacagtcactgcatgcagtaatggttcatgcctgcaggtaaggacaaaatgactcagaagtatttttaaagcaattattttatctgtcaatcatatgattatatctgaaaagagatatttcattaaaatgactgttttgccttataaaaagaattaagatatttttatc

SEQ ID NO: 44123 - DNA, 1106 bp, Homo sapiens
gccgagattgcgccatccagcttgggcgacagagtgagactttgtcttcaaggaaaaaaaaaaaagccaatcactgaaagaacaagtattaccgaggaagaaggctttaattggatgctgcagcaaggagatgggagctcagtctcaaatccatctcccagactaaaaccagagcttgatatagcagggaagaaatgtaacagtgtgtaagaaaataggaactagggaggggcaaggaagcaatcatgatgaatgagggatccaaagtgtcattgtctggatgtggtgatttggtgagtttcagttttttttttttctttctttgaggtggagccccacgcacatagatggctctctgtggtctccctattcatccgtctttttatacttttttttttgagacggagtcttgctctgtctcccagcttggagtgcagtggtgtgatctcggctcactgcaacctgcagctcccgggttgaagcgattctcctgcctcagcctcccgagtagctgggattacaggcatctgccaccacgccaggctaatttttgtatttttagtagagttggtgtttcaccatcttggccaggccggtcttgaactcctgacctcaaatgatccgcccacgtgggcctcccaaagtgctgggattacaggcatgagccactgtgcctggccttcagttctttgagagagagagagagggaatttattgttaatttttttttggaggcttgagggtcctttgctgaggaaggaacttagataaaacatacttgtattacgctttaagaccagaaaggtcagtttctgtgtttatccaaaagaacagcctatgggactattgggtgggttttactatttgggttgttgaagttcttggaaattttactgtaggtctcagcaacagtaatcttctggagaagatgaagaatgtgattgcctccagtatctttttgccccttagatttcccctttataaattcatgtggttcagctatgagatgatctgaggatcagtctagttctaaaattgcttggatctttggttaagtgtatctggaaatgtatatttaagaataaattaatgtagctcaattgtaa

SEQ ID NO: 44124 - DNA, 1013 bp, Homo sapiens
ttttttttttttttttgagacagaatctcgctgtgtcgcccaggctggagtgcagtagcgtgatctcagctcactgcaacctctgcctccgggttcaagctattctcctgcctcagcctcctgagtagctgggattataggcatgctccaccacacctggttaatttttgtatttttaatagagacgggttttcaccttgttggccaggctggtttcgaattcctgatctcaagtgatctgcctgcctcagcctcccaaagtgctgggattgcaggcatgagccccaccgcgcctggcctcaaataattattcttgagccacttagcatgttattgtccttgttgatttttctcttcatttacaaacctcataacctgctcctctatcctcatttatcattgattttgcctggctttctagaatttctttagtattttctgtcaactttgtcacttttttcatcctttgcagattttaagttttcacttggctctagatttgtattttattgaattgttagactgtgtgattattaatgagagagtgacaaaggattttgatgggtggggataaaagttagtgataattggggatagttttttgaatgttcagtttaccaatgatgatttttatgttttgcagaatttctgcttttctgtgaattctcataacagaggacttcagtaatgaacactgggataacagggactcccttttaaggctagactggccttagcagatgttggtcagttaatcatccaccctcctagattacgcagaggaattgctttattcttgcacctttgtgaacattcacttatgagtcagtcagttttgaatcaggacctcaatacttggcttcagatagcagtattagaaattggcacctgagccagaaaagcctttgcgggccttttgcatttcagcgagaagtctcttaaaaataccaagttgggccgggcgcagtggctcacgcctgtaatcccagcactttgggaggctgagctgggtg

SEQ ID NO: 44125 - DNA, 1078 bp, Homo sapiens
aatgtcattgaaaaatttgaggacatttgaaagtggagatgcatagaacatagtggcttagaacccaaaccctatgtacagactgtcttggtacagattttccctctaccacagtggctctgtgatctttgacaaattgcttagcctttttgtacctcagttttcctgtaaaatgaagataatgcgatagtatttatcttacagggatatgggagtatcaacagaattattatatgtaaagcaaatagatgcatgtctgatacattgtaactggtgtaaaatgcttgttgtttctgtttctactttgtattaggcagttcttgcattgctataacggaatacctgaggctgggtaatttttaaagaaaagaggtttaattggctcgcggttctgcaggctttacaagcatgggtccagcatctgcttctggtgaggccacaggaaccttacaatcatggtgaaggcaaagggagagcaggtggttagatgggttgcgtggtaagagctggagcaagagagagcgggagtaagtgccagatacttttaaacaatcagatctcatgtgaactcacttgtcaccaagggaacaatgctaagccattcatgcgggatccatcccagtccccgtgatccaaacacctcccagcaggccccacctccaaaactggggattacatttcagcaggagatttgaagtggacaaatatctaaaccacatataatttatttgaaatacaattattatcctgatattttaatgtcaagcactgtttcatgcttaaaatgctgtttcttttttcttttccttttccttttttttttttttttttttttggagacggggtctcactctgttgcccagtttagagtgcagtggtacgatgttggcttgctgtaacctctgccttccagctcattcaatcctcccacctcagcctcccgagtagctgggattataggcgtgcatcaccacacccagctaatttttgatttttttgtagagatagggtttcgctatgttgcccaggctggtctggaactcctgggctcaagcaatcctcctgcctcgggcttcca

SEQ ID NO: 44126 - DNA, 1061 bp, Homo sapiens
gtattctacaagctactttgtgagagttatgttttggatatgtttatcagtacatgtggatcttctgcatccttttcttctttttttttttttttttttttttttagacggagtctcgctctgtcgcccaggctggagtgcagtggtgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgcatccttttcaaatgctgtatattatgaatgtaccatagttcatctgacagttgcacggctattcattacttgctgttgcatacagcaatgtgacaaacatctttgtgtgattctcctaggccacgtgtaaatgtctttctagggtagatttgggagaggaattgctggagcatacatagccagcattcttcatatttaaatcaataagtagaatagtgtttggcatgattgactaattgtttgtaaaatgaattatgcatttgcaatattgtcattttagttagggagtgccagtgtaagtaaaaccagtgatctcaatactggctgtgcatcagaattgcttatggaactttttaggtgttaccacccccagagagtgatttcgttggtctgtaaatcagtacagctgtcctttagcatgaagagtaaaattaaatacagaggatgcattctgagactgtcttagaatgcccaaattacccagcgcttaacttaaatgtagtttacctcataaactacggtcaaatatagcaaaaaattttgatcttctttatggacagttaatatgttaatgacttttaccctccaaacacttagcatagtaaatctaataaataattgttttaagattagcagagaggacaaaagaaattatttgtagagggatggagca

SEQ ID NO: 44127 - DNA, 1087 bp, Homo sapiens
atttactttttaaccagacatgaatagttcaatttaggatggcttaaataaagttaagataggtaacctttcaactcatgaacatatgactgtcaagaatcattgattccttgaagtgttggtagctgaggctcatgtgtatttcagagaaggaaatatggaagggaacacgtgagagcaacgggaaaactaggaggtgactaggccatcattttgggataaacagcattccattttgctttggcacatctttcagttattcttctgtttaaaatatttgaaaattgtgaatttttaaatgtatttaatacaggaaattataagcataaagaataataaaatagtcaatccctaacttgagaaatggaatgctaccacaagtagagatattttttctttatattcatgctgttaatttttcctctcgctttactttctgtatgttttttattttctctgcctttattttatttatttgagaccccctccccctgaaaaaaaatctcgttctgttgcccaggctggagtgcagtggtgccatcttggctcagtgcagcctctgccccctgggttcaagcaattcttgtgcctcagcttcccgagtagctgggactataggcgtgcgccaccatgcccggctaattttttgtgtttttagtagagatggggtttcaccatattggccaggctggtctcaaactcctgaactcaagtgatccacctgcctcggcctcacaaagtgctgggattacaggtgtgagccactgtgcccagcctcacaaagtgctgggattacaggtgtgagccactgtgtccggccttccctctgtctttaaagaaagtagtctcagtccaaatgtcagacagagttaggctttagaataaggaaaaagttgggcactttaggtgagtgaaaatactttggcaagtacaggcatacctcattttatttctgccctacttaaaagtgacatatctttgtatggcccagaaagtgctctgggaacaggcccctgccatcatctctggcttcatttcttaccagtaccgacttaagtcctgccagccaccaaaaccactcagatgg

SEQ ID NO: 44128 - DNA, 1032 bp, Homo sapiens
acatcttgccaaattctagagtggtagttgtcaccataatacaaagcaacagttagtgttgtaaccatcatataaaggagcctggcatacttggcatactttttttttttctttttttgagatggagtttcactcatgcagtggtgcgatcactacaacctccacctccctggttcaagcagttatcttgcctcagcctcttgagtagctgggattacaggcatccaccaccatgcccggccaatttttgtatttttagtagagatggggtttcgccatgtttgccaagctggtctcgaactcctgacctcaggtgatccgcgcccccctccctcctcccccttggcctcccaaagtgttgggattacaggcgtgagccaccacgcctggccaagcctggcatactgttatgttccacttggaagctacagttgtagagctaatcacttgggaaagaatcaaggagatgctcaaacagaagcagatgtactatggcaatggaaccctcaagagagagagcaggagtagaactgtctttataagaacctgatgtagaactcataaacattcaagtgccatagatggtttaaggaaaactttatgaacagtgtgggaaactaccatttatagttttctcaacaggatcaaatcagccaattagaagggtacacagatggcaacataaggcaatagtctgtctgtaaggaataaaacagaaaaacaatagcaagcaaaaagcgctgtcccaatatggcaccattggtgcagaagtagcagatcttcaggtgcgtttcagaggccctgagaatatctgagtagtgccaataaggaaaagcctggagttagccaagaaactttatattatgctcttttttttttttttttttttttttttgagagtcttactctatcgcccaggctggagtgtagtggcacgtctcactgcaacttctgcctcccaggtttaagcgattctcttgcctcagcctcctgagtagctgggattacaggcatatgccgccacacccagat

SEQ ID NO: 44129 - DNA, 1022 bp, Homo sapiens
gtggtgcgcgtctataatcccagctgcttgagaagctgagcaggagaattgctcgaacctgggaggcggaggttgcaatgagctgagattgtgccacagcactctagcctgaacacagagactccatttcaaaaaaacaaaacaaaacaaaacaaaacaaaacaaaaaaacagcaacaacaaaaaagaaagatccaggcatagctttcccttcgtttcaaacctcacaagggatggtagcctttaaaggaacaaacagttactgtgaattttttttcaccaaaacctctgaagagacggtttagggaactggatcgacaaaattttattggattcataccttgctaaatacagtgctggtaaacaataggtacctaacatttgaatacaaaatgttgaatactgagtagagctcgaagagaaatttgcagagggtgctgtgaaactggataaaagaacttttgttcaaactgcggaacttctttttcccagttccattcattgaactttggggattgggcctgattatgccaggcattctcttaacccttctggttgtcaggaactaggggcacatgggtacaggtatggactagagatgcccactggcagccctttgggatttggctatgttgtatgttgtatcactccgagggattggattaggtgtgccccctgaccccggtgcaggcagttcacagatagtccagcaaccttgtggatggtgtagcctggctggaaaagataaactgggataatgctttccttgcctcaggaatttgaatttctaagagattaggtcagttcaatggggatagcattgtagatactaaaagcattgacttatagtgaaagatctggggcccagttctgggtttgttacttacttagctaggtaacattggacatatcttatcttgcagggtttcacctccttttcttacctctaaaatggaaatgaggccaggcatggtggctcacgcctgtaatcccaaccctttgggaggctgaggtgggtagatc

SEQ ID NO: 44130 - DNA, 1061 bp, Homo sapiens
tagagtattgtccagtagatgggtgaggggagttcactaagtattcttagtgtctagtttgtaattagtttatgagacttaaaaccccaccacacattattctgaacctgctgtaaatattatgagaggcagtatgtatagttgcctctggagctggagtgcctggatttgttttccagctttaccatttgctagctgtatgaccttgggccaagctatttaacctctctgctttagttttctcttctgtaaaagagggttgataatgacagtgtctactccatggagggtttgtgtggattaaatgagctaataagtagtaagcccccacaacagtacctggcacatagtaagctctattagtgtttttcttctgtgtcagttaatagcctcataggctttcctcagatatttaaatacatgaatgcctatgatgccatctctcctttggcttcctgaaatcagatttccttagttcttgtaaagccagtggacttccattgtattttctttcctctcctgtttcactgtaattcctctaagttatactttattatacatttgaattttaggaaatatgcttgatgcatttggaatcttttttctaaagacttttttttaaaatcttatacactaactggaaataatttgttacatttttttccttttgtgttcagaggctcaaaactatttcatttgccttaagaaatatgagtcaaaactatttatctcctaagttaggaggctaggaaggccaagattcagaaaagttggtaaattaagaggactgaatactagaaatcaaaagaacatccactttcttgcttctctgtgtatgatattacttttgtaaaattgtgtgtcttttatagagaaaagtactcttagcacaaagctgattgtttttgtgaagagtattttgaagatgcctgttgaaaagcacttgtggagtagtttatggaaacagctgtgagattgcacaaagtattcttgtactcttcagagccattctttagtaggagaaaataaggtccatattttaagcttgatgatagcaagcc

SEQ ID NO: 44131 - DNA, 1122 bp, Homo sapiens
tgctgcttcaagggtagaagactcctcactgctttccttcatgagatttcaaaggaagtgttggttttttttttgcctggttcaagtattgaccaagaagatgacagtgatgtggtctcttaggtttcaaaatttctacttaaacatcttggttctagtgatacgtactttgcaaaaataattcacagttattatgacttttgttaatattctgaaactatggtattcagagatgatccgtcaggttctgattaagtttcttagaagcccagtgcactgaaaagattatggtgtgtcttttctcttcctagcaaaatggaaaatgacaatactgaaatgcaaactaatagaataccagcaaaaattctcattgttactcatggcttcaaaaactacatcagatgccttaaaaaaaaatcctcttacttcttttggtacctcatttttgttggttttctaagcatgtagaaggggaccagagcatgccaccccaaaatatcccacttttagtgtaggtgttgttttaagctgaaggcatttagtttcctgccctccacctttctgtctaaaagcaggctatccatttacatttctgaaagtgttccgtactaaagaacccctatttattatacatttctagttatcttcccatgatttgtacctccctcaaagtccagaacttgttttcctcagtctagccttttccccgtactttatcaccctttgttaagatggtgtgtaaacccaaattttaatcacccttttgagttaacactgagttctcctttgtgtatgcacattgcatgcataggtaaactgctttttttccccctcctgttaatcttttatctgttaaattcagggaccccagccactgaatctaagagggtagggaaagagtgttttcctctccaacagtgtgcttcatttttttcctgttgggtaattcaacactgactctccccaaaattacacagaagaattaaagtaacacaggaatgaagaagcgaacatagatttatctgtcagatgcatttaaataaagttatttctctacaatttccttggtcttttgtatactgttataataaactagtaggcagcagaaaattttttttgtga

SEQ ID NO: 44132 - DNA, 1039 bp, Homo sapiens
gctgtggggcattgtagtcaggattttgtagaggtatatctttgttaatttttctccagaagtgtttttaaaggtgagagtttaataatgtttggaaaaaataagagagagcacatgtcagatgacaaatggatggcactgccagcaagggctgtgagggtgcaagccggcttttctctcctgctggtcagtgattctgttcaccagcttaacagactaagttctagagcaaaacacttacttattacacattggttctctatacttctttttgggttatcgtatgtttatccttttaaaaacgtcatagaatttttcttcttcttttttaataataaagctttcttgcttgaagaaaagcctctttgtatccaccacagcagatggaatggcatttgtacttctaaatttttcagtagtaggagtaccaaaatagcactaaaaattaattactttgattacctcccctcccacccagtattgggaaaagtcataattaagtctcccttcaaggtagttcattagttcttgtatgttaaaaaatctgacccttaaattaaatcttccttttgagctgcctttgtgtttccaggacatgtttagctgcacctgcctgctattcggtctctttcttcaccagagttataaaataagaggaaaaggattgtattctctattcagaactagagttctgtggataacttgacagctttccataagtgtgagtctccatatctataatcaagttgtaagtttgtgtttaaacatttttcccccatatttagccatgtctcctcctttgtattgttttcttctacaaaaatgttcttgtaatagtgttttacttttaattctgagaaatttatgacattttctttttaaaagttattctccacttaagttagagatgtatacagcattaaaatggattgcagataaagatatttgtaaatgagtgtttcggttaaatgcttttccaactgaaggtggcatcttgccaacgagaggatagcagttagccaacatgttttttcttcat

SEQ ID NO: 44133 - DNA, 1043 bp, Homo sapiens
tcttgaactcctgagctcaggtgagccaccacgcccagcctattttttcatattttttacatttaatatttctttagtaaagagaacattttactaaaatattacaattctgaatgcatttactagccttgctgcgttctgtgcactgatgtgtgatccattattatggttttatctgctacctatgtttgtcttcagtctctccctgttccctgaacttcagttggttcagctgttcccctttccagtacctcatggggtcttagactcagcagtattcctcccaggctcatctccctagccttacacctttgtgttccatgttttctctgctgcagcctggcgcctctgtgttttcctttctgtttggcttagacctactaggactcatatcagatctcacccccagagggaggatttccctgactccttctcccccatgcgtgaggagttcctttgcctacctctgtcattgtgcagaccacagtgcttatggcattatgtctgtgtgatttttttctcctctactggcttatgagcccctcagggacataaactgagacttcttgtttatgcttgtgtaacagagtgtgtggcccagggttggcaccagtatctgtctgcagaatggataagtaagatctataatgtcacaggaggcaaactggtggatgtgggctggatcacttctgtagatgtgatcatgtggttgacagtgctttaaaattggagatattttacatgaaagtctctatggtttccatagtctgaaaaaaaatgtgactatttggccactctgggtcagcatgctttcatgatagttgttcactaggtatttttggtggtttgccacagattggtgtttttgtaaaagatggggttctggtttctggcatgtttttgcagttctggctttctgaatggctaattaaggatagagccttaatgcagatactcatgtgtatgtgtagatacacatgtatatgctaaaatatacacaaaatgctgatgaattgaattttcaaggcctttagctgaataac

SEQ ID NO: 44134 - DNA, 1060 bp, Homo sapiens
taaaaatacaaaaattatctgggcatcatggcgggtgcccgtaatcccagctacttgggaggctgaggcaggagaatcacttgaacccaggaggcggaggttgcagtgagccgagatcgcgccattgcactccaggctgggtgacaagagcgaaactcagtctcaaaaaaaaaaaaaaaaaaattacctaaagatgtcttttcgtttagtgtacacctttttgctttctataaaaaggctgggagtttcataatactaaacaggtagtaactacagaaaatttttaatgaccaatacctatactttgaaagagggttaggaggaaaaccatcatagaatctcagaattaacaaaaatttattatgcattatattagaatcatgtcaaatacaacttatccagatttttattgtttgttcaccatgaatatttgttcgttgggggtatatctggacttgccaaaggaatgagaacacacgtgtgtaatatttagcttgatattatgttataagtgactttagggattatctagtcaagttgttttaaaacagtggaaccttttctttaattgaaattgtatccagagtccaatatttgaagcataaaagccaagtggttgaaaggttgaaatgagagtcatgggcccagaattctcatgtttgcctggcagcaagtccttggttagtagtaatacacagcgttagtgtgcattagtgttcactctgtgccaggtcttgtattaagcactttacatgtatgatttcacagtttgaaaaccacttatctagttcagcttctgatttttttctgttaagaaacaggtccagagagcttaaatgaattgcccagcatctcaaactagtttttaatagagttagtattattaaaattcttatagtcagtttagctagtggcatgtgtgtgatattttattttcccagttgttagattaattcaggtcttttgcagtaaaataaaaatttccagaagagtataaaatggaaaaaatacttgactttcagtggctagggctttgataatattttggtgtgaatcattc

SEQ ID NO: 44135 - DNA, 1050 bp, Homo sapiens
atagtcccagctacttgtgaggctgaggtgggaggatcacctgaatctgggaggttgaggctacagtgactgcactccagcctggatgacaatgagatcctgtctcaacaacaacagcaacaaaaaggggtactttttaaaactaatgagaagaatgacattgttggacatttttgaaaatttctttaatgtctggcttaattgaagacagattatcatatatgtgtctgccttcagtctgttgtgatatgttatttttgttgaaatatatgaagaaaatattcaaccccatcctgtgttcttgtatattttctttaaagcaacaagctcatttcatacgcttttgagaaaaatgtctgtcaggttcccaaatttgaataaccaaggcttgtctgttaataagccttgctggaaaaagcaaataaaatgattgcacaggtgtttttcctggagacatgcattttactttggttggtagcaggaatacttcccattttagcacatagaatatgaaaacgctgtcaactcaacattgagatttaatgaaattaattttttcattgcttcatcaagaacatccttacatgaacctggcaactttttaactgaaagttaaatgcaaggactgctagtacagcttggggccaccacattgatttgtgctaagatgccagcagcttaatccaccattctttttatgtcgtcagtgcaaatgttgacacagaaagaggcaaataatgtcttgaatcattatggaaataggtttgatcttggagacttctgaaggtttgtgaaccacactttgagaactgctggaaggtataaacattaacactgggagttgctttggctgctcttcttcccctcaggaaaaaagagaatcaaatgagagtctgattttcaggtataaaggagtgggagagggaacagatgtttatgacattcctattcagtctcacttaagcctcataactgtcatgtacactagatattgttgtcccctttttgcaaatgagataaacaggtcttgagggttagaatagcttgcct

SEQ ID NO: 44136 - DNA, 1940 bp, Homo sapiens
ggtagatagggttttgtcacttgaatgcaaaattagctttataactataactttgaaactaaatggctaaattattactgattttatttttatttttatgggtcgccttacaagatgtatttagtttgcctcttggttttgagtactgtggaaatgagcttactggttgctgtttctgaaaatgtgtactttaacttattctcaaggtaattattgatgtgtttttaaactgaaaaacactgaagaaattttatagataagttttctccatattttgtttcacataaattgtgtccattttgaagatgtagttcctcttttcctcttccaaatgattaaactggtaaaatttttgtattagaggaattaaggtgagaggtgctgagcaaaatatgaatcttccaaggtttattcttgtaccttgttagggatatgcgtgggtgtttgtgtgattgtgagagaaacagaatgtgtgtatgtgtcactgattttttaaaagtatagatgttgctttattatttgccttaaatatatagcaaaatcaacctgtagacaatgcacctgaagagaaaatgtaactgtgtgaagatttaataaagtggattggtggaaagaccattttattatttggaatgttattatttggaatgttaacagaaaaacttcagctgaattaaatttaaaggagtttaattgagcagtgaacaattcgcgagtcgggcagccccaagaatcacgggagattcagagactgcagtgcagctatgtggtggaagaagatttatagacaaaaaaaaaaaaaaagggggggaagtgatgtccagaactcggaagtgaggtacagaaacagtcaggttggttacaggtcagcatttgccttagctgaacacagtttgaacactcagcagtgtatgaatggttaaagtacggctgctggaatttgccaggactcagctgtatttacaggcgcatacccatagttacgtttttcaatcttgtctacctgttagcttatggatcctccacaaggacttaaatattgaagtacggagtccttctcaggccatatttagtttcctttaaccggaaaagtaactagaaaaaaagtgtttaaaggggcttatattctccccctgccatccaccgccccccccccccccgccgcaagtgcattaaatttaagagtggatgttgaaaataaaaactaaaaattgttaatcaccagtatgtttcttaagtaagctttcaagaatgtagaaggaacaaagaggaaggtaatttttagccttgataatgttaaaaaaaattcacaaaaccataaatggagggctgtatacttaaactcttctattcttagaaacgaacctatggtagtagattattccattttgattataactcaggccatattgaaaaggacgtttgcagtgatgaaaaactgtgattccttgattaacgtgtagaatttaaaaatagtgtgttacattttcacagaaattagatctgtgaacatatgtttttcttagctgtgatttccaaattaattttgaaatattgagtgaattaagcagttttaaaagatgcaacagatttaattttcacccttttggatttgtttttattttagctgagatgtgattcttgttttacttgaaaatattgcttgggttttgttttaaaacatgaattttactcattcatgtaaattatgttttataggtcggcttgtcatcatttgatttgtgactctctattctttggaatacagtggttaaaaactggatatgtaaaatactgatacctcgctgctattaccaggattttataccagtgtctagtggaatagaccaaaggacagagtccttggactcagaacttgcatgaattctgcagtgtgcaagagttttctggagaattggtaccttactcatattctcaaa

SEQ ID NO: 44137 - DNA, 1049 bp, Homo sapiens
agttgacttctaatataccttctgcaattagcatggtggattttacaataggaaaaataggactattgagtattaatggtaacagatttttttaattttaatttttattttttgagacagtcttgccctgccacccaggctggagtgcagtggcgcaatcttgactcactgcaacctccgcctccgtggctcaagcaattctgctgcctcagcttcccaagaagctgggattgcaggcgtgcaccaccacattcggctaatttttgtatttttagtagagacggggttttgccatgttggtcaggctggtctgaaactcctgacctcaagtgatccacccgcctcggactcccaaagtgctggggatggtagcagatattgacagtgccaggcatagtgcctgatggacactctcactaaaacagcaacagtcctcagcattctatgggcctaccaactttgcttatttgtattgcacattcattagctagattttctgttaagaatagtctggcctggttgggtgtggtggctcacgcctgtaatcccagcacttagggaggccgagaattgtttgaacttgggaggcagaggttgcagtgagctgagatcgcgccattgcactccagcctgggcgacagggcgagactccatctcaaaaaaaaagaaagaagggagggagggaatagttggcccggcgcagtggctcatgtctgtaatcccagcactttgggaggctgagatgggcagatcatgaggtcaggagttcgagaccagcctggccaccatagtgaaaccccatctctactaaaaatacaaaaaaaatatatataattacccgggcatggtggtgggggcctgtaatcccagctacttgggaagctgaagcaggagaatcgcttgaacccgggaggtggaggttgcagtaagccaagatagcgccattgcactccagcccgggcgacaatgtgagactccaccacacacacacacacacacacacacacacacacacacacacacacacacaaagaatagtctgaccaaag

SEQ ID NO: 44138 - DNA, 1063 bp, Homo sapiens
atgcttttagcaggaaagaaatttgtaggccgggttgaaaatcatagtgtttctgtacctctagctgttcttttgaaacattactgtaattctgggcattgaaaggatgttaggatttatgagggtgattaataagtggcatacatgcagagggacttgaatggcataattgatagtatttagaaggccagtcatgatcttgccaattattcgctgtgtaatattgggcaaatcagtgcacttctctgagccttgtctatccatgaaaaagaaagtaaacttgctatagttatttctcaggattactataaataatggagaagataatgtacttcaaagcagtatgaaaaagttctttgtactatgcctttccgcagctttctttcaaattttaaaaagtcactctggccaccatatggggaatggattatagagtggtaaaagtgaaagctaggagactagagagcatgctgttgcaatagtctagttggtgggttgtaatgtggcttggccaggtggtcttagtagaggagatgaggtggtcagattaaggacttattttgaatgtagagttgattggatttaatgatagggtatgaattaagaggaaagtcaaggatgactttttaaactttttactgccacaccttgttttccaggatgatggctctccgcaccagacccgtgtccccgtgtgcggtagggcagtgtcccgccggcaggggaccggtagccaaggctatccgaggcccctcagcattgccttgtttttccgcctgggcaggattctgacttaagaagccttcagtcgtagtcccacagatggtagcttcaccctgttggcttctcagccaagcacatacaccaaagagacagggtcttctcttgtttaggctggagtgcagttgtgcgatctaggctcactgcacccttgacctcctgggctcaggtgatccccctgcatcagtatcccaggtagctgtgactacaggtaggcactactgctactgtgcctgactaattttttaactttttgtaggcatgaggtctcgctatgttgtct

SEQ ID NO: 44139 - DNA, 1083 bp, Homo sapiens
ttcccaggctggtctggaactcctaggctcatccagttctcctgcttctgtctcccaaagtgctgggattacagatgtgagccacgacatccagcccaaggttcattttaaagctatgagttgatttttgataattgaattatttgctcatagttcttttaaaatctgaatgataatgcaattgtttgctttattatcttgtggctataaataatcagtcatggaattgggaattttttgtcttcctttattagaagtttaataattatttgataataagtagtgttatttatttattttttgagacggagtcttgctcttgttgctcaggctggagtgcattggtgcgatctcggctcactgtagcctctgcctcctgggttcaagcgattctccttcctcagcctcctgattagctgggattacaggcatgtgccaccacacctggctaatttttttgtatttgtagtagagacggggtttcaccgtgttggccagactgatatcgaactcctgacctcaagtgatctgcccgccttggcctcccaaagtctgggattacaggcataagctactgcgcccagccaataagtagtgttctttaagttaattaattttttttttgttttttttttttttggtctgtatcccaggctggaaggctggagtgcagtggcatgattttggctcactgcaacctctgcctcccgagttcaagtgattctcccgcctcagcctcctgagtagctgggattacaggcatgtgccaccatacctggctaatttttttgcatttttagtagagactgggtttcaccatgttggtcaggctggtctcggactcctgacctcaagtgatcctcctgcctcagcttcccaaagtactgggattacagatgtgagccaccgtgcccagccaaactgtatacgtattttaataccagaaacatcagggctaggcgcagtggctcatgcctgtaatcccagcactttgggagactaaggcgggtggatcatgaggtcggagttcgagaccagcctggccaacatggtgaaacaccgactctactaaaaatacaaaaa

SEQ ID NO: 44140 - DNA, 1086 bp, Homo sapiens
ctgggctcaagtgatccccccacctcagcttcctgtatagctgggactacaggcacgtgccatcatacctggctagtttttgtattttttgtaaagatggggtttcattaaggttgcccaggctggtcttaaattcttggactcaagcaatcatcccacctttgcctccctaattgctgggttttcaggtgcaaaccactgctcctgccaatagtgacacattttacaaatgtttgccattcagacattcaggactttcaagtcctccttgaagccttctgtccaccttctttaccatctcttaccacttatctgcaaacttttatttaacttgtgaacacatcctacctgcagggcctcttgggagtaggtttgggtttagaaataaatttttcaggcccttagcacattttttatgtcatttgtatttgggtactagctcagcagtttattcctttgcctctttttggctctgtttcaccttttcccattctagacttttatatattccattttattgtccctcctttcctcttcttgtttatttgaagcttatctgtttttccctatccaggtcaaatccatagtttgggtatgtggggctgtgtgggaggagaatgacaaagttagggagagcatgtaactttttcagtgagagaaaagcagcgtatatacgggggcatggaggagagcgagaacaaggtggattctggaagtaatttggtatgtgttgagtttaatgtctttgtggagagtgttgggaggtgagaccagggagctaggcaaacagcatgttaggaaagatccttttcttgtgtcaggtgtgagccactgtgcctggcctaggcaactctttttgaggaaatttttatatggctatatttgatgttgtaggcttctctgacatagcagtaattttaacgctaataagctggacagtcctaggaatgtttcagattctacaaaaatcacatttcccatttatatttttattttatttaattattattattaatattattattattattaatttgagacggagttttgctcttgtcgcccaggctggagtgcagtggtgcgatc

SEQ ID NO: 44141 - DNA, 1025 bp, Homo sapiens
tgatcctcctgcctcggccacccaaagtgctgggattacaggtgtgagctactgcgcccggccggtgatttattattattattattatttttgagacggagtgtaactctgtcacctagggtggtctcaaactcctgacctcaggtgattcgccctcctcagcctcccagagtgctgggattacaggggtgagcctgttgcccatccttaaccaggggtgggcctggttaagactgggtaatttataaagaaaaggaatttatttctttcagttctgcatgctgggaaggccaaggtcaaggggtgcatctaatgaggaccttcttgctggtggggactctgcagagtcccaaggtggcctagagtatcacatggttagggggctgagtgtgctagctcaggtctcttcctcttataaagccaccagtcgcactcccaggataatccgttaaaattcgttaactcattaatccatgaataggttccattcatgagggcagaaccgtcatgacacagtcacctcttaaagacctgcctcataatacccacattggggattaagttttaacgtgagtttcagatgggataaacattcaaatcatatcacagggtggtagcaaatagataaagcgcgtaagataggctctgtaaactttaatgtagtatagggttggctggcagacgtggcttcttaccctaatcctgctgtgtaatggcttaatagccatgtaatctgaacatgtttaagctatctgtgtgcctcagttttctcatttgtaaaatgggattaattatagcaactatagcactttgggaggccaaggtggggaggtcaggagttggagaccagcctggccaatatggagaaaccccgtctctactaatacaaaaattagctgggtgtgttggcgtatgcctgtagttctagctacctgggaggctgaggcaggagaattacttgaaacgggggaggcggaggttgcggtgagctcagattgagccactgcactccagcctgggtgaca

SEQ ID NO: 44142 - DNA, 2857 bp, Homo sapiens
gggattacaggcgtgagccactgtgccttgcttgctaatgaaaaaaaaattttttttttttcgtagagatgaggtcttgccgtgttgcgcaggctagtcttgaactcctggtctctagcactcctcctgctgtggcctcccaaagtgctaggattataggcgttagccactgtgccctgctgtattttctgttacttaaaactgaaagagcaacattgttgatcacagccagatggaaacaactcagatgtcagttgatgaataaacaaaatgtagcatatccttacaatggaatattattcagcagtaaaaataatgaagtactgttacatgctacaacatggatatatcttgaaaacattatactggatcaaagaagtcagtcatgaaagaccacttattaatatgatttaatttatatcaaatatctggaataagcaaactcatagagacagaaagtagatttatggttacctagagctggtggggagggggaaatatggggcgtgcctgttgatgggtatgtgtttctttttggggtgataaaaatactgtaaaattgattttggtaatggttgtacagctctgtgaatatactgaagtcattaagttgtgcactttaattgggtgaattgtacatgtgagttatatatctgactgtagttgttattaaaaaacaacaggaggccatgtgggctgctaggagtagcaatgtctgttcccagccagcaggtagagaccagggctggacagaggagtatgggctgtgctgcagattatttgtggtacccaactgttgcataaaacagggtgtgatctcttgcattgctatgcatgagtggattcccagtaaattgtgccaggctgcctgatgatgtgtggcttgtgctttggatcgtaatgcttacctatgctacttaagttacataccctgtggcctttgtggccaggactgtgggctactacctggagtgattcgttaggggaaaggacccacagcctgtgcaggaggaaaaaagcatctctgagtacagggtggatgagctggatgagctgccgggcaagagccacgcacacccaggtggtgagtcttaaggataaggtggaatttgccccatagctgtcctggacagaaactgcccagagaagaatgaatggaggacatagggctctgtggtcccaccatacatggggagacctgtgactggtcctgttaccatgtcaacttagccccaaacccatctctgattgacttggttgcttattttggcacattcttgctccacacagccacatacatactggctgctcctcgaaggccaggcagatgcagcagctgttgggccagcaaagaggaaggtcctggaaggttctggcctgaacgctgcatctgttgtgtgacagccacaactgctcaggcttccttgtctgtgggtgcactgtggggaggagtgttatgataagaacattggctctcagtctccctggggagaagtttggcctcacgtgggatttgggcgttgcctttaggaaggctctctgcatgtctagttccagtttgtactgggaagaattaaaaaagtctgccagcttctttagtttgtcctgtcttttgtgatgattctttctgagatcccctcctatcagctcaggagtgggattttctggagaaggaaagtgtttttctgttccttactgctcaccttggggcattcaggaacatgggcctgatgaatttgcttgaaggcagtctgtaatcccatcactttgggaggccaaagaaggcggatcatttgagctcaggagtttgagaccagcctgagcaacgtgacaaaaccctgtctccaccaaacaacaacaacaacaacaacaacaacaacaacaacaacaaactgggctggatggcacgctcctgtaatcccagctacttgggaggctgagatgggaggattgcttgagcccaggaggtcaaggctgcagtgagccatgattgcaccactgcattccagcctgggtgacagagggagactgtttcaaaaaaaaacacaaaaaaacaaaaccattacctggaagaattctaacagcactattattctcattttacagatgaggaactgaggcacagaaatgttcagcagcaggcccattgtttagagctgataggttgtagagctgagatttaaaactaccaagtcgaagcttacaactgtgctatcttacttttttcaattaagagtcatccttatggaactttggagttgggagttccttagcaattacttaatctaaccctttcattttactgatgagaaaattgaaccttagataataagggatttatgacttagtctcagagataggcaggtaaacaactagcagtgacacaaggtggaatagaatgttaaccaatagaggtactggcatttactgtgtgaaattaagggagggatcatgtaattctgatgactagccaagagcttttttttttttcttttgagatagagtctcgctctgtcacccaggctggagtgcactggtgcaatcttggctcatgcaacctccatctcctgggttcaagcaattctcctgcctcagcctcccgagtagctgggattacaggcgtgcgccaccacagccagctaatttttgtatttttagtaagagactgggtttcactatgttggccaggctggtctcgataccctgacctcaagtaatctgcccaccttggcctcccaaagtgctgggattactggcgtgagccaccacacccagcccctagttgtattagctatttattaccacataacaagttactgtgaagcatagtggtttaatgcaacatttatcatcttag

SEQ ID NO: 44143 - DNA, 1031 bp, Homo sapiens
atcacaagatttatagtcaaggaaatcatgaaacagattgtagatatggcaaaaaaggtgggggttggaaggatgaacggtttccagatgtggattgtgagaaattcaagagccagtagacatcacaccacaggaattatcagatgacttgatggaaatgagtgcttccataccactgccagacgatgaggaagatgacatagcagcagcagtgccataaaacaaattgacgttagacaattaagcagaggcgttctgattattgaagactgcttttgacgtcttttttactgtgaagttgataagcatggagacctttatgatgatccacttaataaatagtgctgtgggcctggcacagtggctcatgcctgtaatcttgtcactttgggaggccaaggagggcagatcacaaggtcaggacttcgaggccatcctcactaacacagtgaaaccccatctctactaaaaataaaaaaaattagctggacatggtggcatgcgcttgcaatcccagctacttgggaggctgaggcaggtgaattgcttgaacccgggaggcagaggttgcagtgagccaagatcgcgccattgcactccagcctgggtgatagagcgagcctttgtctccaaaaaaaaaaaaaaaaaaaaaaaaagctgtggtttggatatggtttgtttgacctctccaagcctcatgttgaaatttgataccccagtgttggtggtggggcctggtgtttggattgtagggggtggatccctcttgaatggcttgaggtgtcattcttgcttctcactcttagtttccagagaactggttgttgaaaagaggcacctccacctccactcttgctttctctctctctctctctctctgtgttcttagcacccctttcttccagcatgggtggaagcagcctgagaccctcactgaaattaggtgctggtgccatgcttgttgtacagcctgcaaaaccatgagccacatacatctcttttctttatattaataaattacccaggcttag

SEQ ID NO: 44144 - DNA, 1033 bp, Homo sapiens
tgcctggccctaaatgccagatggaagtgccccattagatggaagtgccccattctggaaaaaaattgccatagaggacattaatccaatttgtaaggaaaagaagtaagcaccaggatttaaggcaggaagggatgggctaactctactcttttgtgcaaatgtagtcaggtttatgatcaggactgcccttgtctgtaaagctgctaaccttgaaccttgaagggataagagaaatactggctgccagtcctttggttgtacaagaagtcctggacaatgagaacccttttttggattgattccattgatgctttgtccctggagtcaggaaatacctagccagtgagagattgccttttaaagttcttttgattttggacaatgcccctgaccatccagaaccccaggggttcagcacagaaggtgtggaagtagtttacttgcccccaaacacaatgtctctaatttagcttctacatcagggagccttaaggacctttaagactcggccaggcgcggtggctctcccctgtaaccccagcactttgggaggccgaggcaggcggatcacgagatcaggagtttgagaccagcctggccaacatagtgaaaccccgtctctactaaaaatacaaaaaaaattagctaggcatgatggcgggtacctgtaatcccagctacttgggaggctgaggcaggagaagcgcttgaatctgggaggtggcggttgcagtgagccaagatcatggcaccgcactccagccagggtgacagtgcgagactccttctcaaaaaaaaaaaaacgttacacacggtatgctatggaaaggcttttcagtgcagcagaagagaactcaatagagagaccatcatgaatgtctgggttgtaccactgaagataccattgttgttacagaaaaagcaatgaaaaccatcaggcttgaaacaaattcctgctggagaagactgtccagatgtgcatgacttcaaaggatttttattaaaaattattttattattttttaattat

SEQ ID NO: 44145 - DNA, 1071 bp, Homo sapiens
cagtagatcatgcctgtaatcctagcactttcagaggcctaagcgggtggattgcctgaggtcaggagttcaagaccagcctgggcaacatggtaaaaccctgtctctactaaaatacaaaaaattagtcaggcttgatggtgcacgcctatagtcccagctacttgggagggtaaggcatgagaatcatttgaacctgggaggcagaggttgcagtgagccgagatggtgccactgcactccagcctggggtgcagagcgagagtctgtctcaaaaaaaaaaaaaaaaagaaagaaaaaaaattaattaaaaaaattggcttgtcagttccagagtgcattgtttcaggcatctctttgaaacattattaatgtaaatatttttcggcattataattttcaaatcagtcttagaatatggagcctaaaaggataggaataagaaggagcatctagatgacatgattgaatgcattaaacttgggtatgttgtaacatacaactgtcattcaactttgtgaacatatagtgtgggtacctgtatcccccaaactcctgaaatttagatgtgtctctggatggactgtgtgtgttgggcaggtttagtagatagggtgggagaaagggtaaggaaagactgtaagctaggaataaacatccccaggaagccgaagtttcattgagatgtagtagagataagatggataatttacttaaaagaaattcctggcacttggcagtcctacttttgtggctgggtgcttcatttggtcaccaggtgctgtcattacttctaacatccagggtacaaaggttgccactgtgtttgatgccagctagctactttggtcacttttgttgttgttgttgttgttgtttgagatggagtcttgctcttgttgcccaggctggagtgcaatgacgtgatcttggctcactgcaacctctgcttcccgggttcaagcgattctcctgcctcagcctcctgagtagctgggattacaggcatgcgccaccacgcctggctaattttgtatttttagtagagacggggtttctccgtgttggtca

SEQ ID NO: 44146 - DNA, 1035 bp, Homo sapiens
ccacatctgtaatcccagcactttgggaggccgaagcgagcggatcacttgaggccaggagttcgagaccagcctggccaacatgacgaaaccccatgtctattaaaaatacaaaaatcagctggatgtggtggtgcacgcctgtaatcccagttcatagggaggctgaggcatgagaatcacttgaatctgggaggtggaggtcgaagtgagccaagatcatgccgctgcactccatcctgggcaacagagtgagactttgtttcaaaaaaaaaaaaaaaaggaaaagaaaaaaaattttttttttttgtggcaaagtaaaggaaggaaagttaaaggataaaccggttgagggagagaagtctaaggagaatgagatttgagaaaaatttattacgtttgtttatcgttgatggccttcagatatcattagcattagtatcttttttctgatcttgacagtttataaataatttatcattatttcattagttggtataggtgggtagtattatctatgttggaactaaggattagagagagttttgtcttgctctgtttgtattacaggtccaataggacccacagattttttttgagatggagttccactcttgtcgctgaggctagagagcaatggcgctatcttggctcactgcaacctccgcctcctgggttcaagtgattctcctgcctcagtggcccaagtagctgggattacaggcacatgacaccatgcccagctaatttttgtatttttagtagagacagggtttcaccacgtttgccaggctggtctcgaactcctgacctcaggtgatccaccggccttggcctctcaaggtgctgggattataggtgtgagccaccatgcccagtcgtactcacagatttttaatattgtcttgtattctgtttgcaaagaggaaaaattattacatatattcaaataaggcaatattaaaaaaaatcattacctggagttgccagattcttaagcttataggcttttttaattctaggcgcatgaccacc

SEQ ID NO: 44147 - DNA, 1045 bp, Homo sapiens
tctcttatatatgattttgtatcctgctttccttattttacattttgttataaatatttttcatgggctggctgggtgcagtggctcaagcctgtaattccagcagtttgggaggccgaggcgggtggatcacgaggtcaggagtttgagaccagcctagccaatatggtgcaaccctgtctctactaaaaacacaaaaatagctgggcgtggtggcgggcgcctgtaatcccttcccagctcctccgtaggcgaggcaggagaactgcttgaacccgggaggtggaggttgtattaagccagagatggcgccattgcactccaacctgggcgaccgaatgagactctgactcaaaaaaatatatgtatatttttcatgtctttaaaaacttcataactaattattaatgactaacattctaatttgttttatttgcttaaatatttccctattgctagacagatgtttccagttttctggcatggtattacttcagtgaatatctttgtatgcatttcagattttcttagactaggtggaatcctgcaaatggaaatattaggtcaaagacattgaacctttttaaggctcttaaattttggaaaagctcttttaaagaagaatcagcaggagtaggactaattaactatgggacatgaagagaaaagcaatacaaaatgacaaaattaaaggtttttttgacttagactgttatacttaatgaagaataagaaagttggcagaaactggctgggcgcggtggctcatgcctgtaatcccagcactttgggaggccaaggtgggcagatcacttgaggtgaggagtttgagaccagcctggccaacatggtgaaaccccgtctctactaaaaatataaaaattagctgggcgtggtggcatgtgccataatcccagctacttgggaggctgagacaggagaatcaattgaacacaagaggtagacgttgcagggagccaagatcatgccactgcactccagcgtgggcgacagagcaagactccatctcaaaaaagaaagaaag

SEQ ID NO: 44148 - DNA, 1028 bp, Homo sapiens
cttaatgttgccactttgagaatgttatataaatggaattatacagtatgtcaccttttgtgattcgccttttttcatgcagcgtaatgcccttgagattcatccatgttgttgcctgtgtgagcagagcattccttttttttttttttttttttttttttgagatggagttttgctcttgttgcccaggctggagtgcagtggcacgatcttggctcaccgtaacctccgcttcctgggtttaagcgattctcctgacttagcctcctgagtagctgggattacaggcatgtgccaccatgccaggctaattttgtattttaagtagagacggggtttctccactttggtcaggctggtctcgagctcctgacctcaggtgatccacccgccttggcatcccaaagtgctgggattataggcatgagccaccgtgcctggctgtgctttcctttttattggtaacaagtattccattgtgtggattaacagtttattcacaggctaaaggatatctgggtatactttgcttctacttttttttttgagatggcatcttgctctgtcgcccaggctggagtgcactggcgcaatcatggctcactgcacctgccacctcccaggttcaagcgattctcctggctcagcctcccaagtagctgggactacaggcatgtgccaccacgcctggctaatttttgtatttttagtagagatggggtttcaccatcttggtcaggctggttacgaactcctggcctcaaatgatctgcctgccttagcctcccaaagtgttgggattacaggcgtgagccaccgtgcccagcttggtgagacagttttggaatgtaatgatacaagtttatatccttattcagtaagcctcaacccttgaatttatacttccctgtagtataaattcaagctcataagcccatgactttggaatacttctcatggattacctaattttcatttcttatttttttacacatttgtttattcaacaaacatttttgcttactacc

SEQ ID NO: 44149 - DNA, 1522 bp, Homo sapiens
agcgttcgacatcgttatctcttcctctagattaattgcttcgctcttttgagcaagaatactctgtgtggcatctttggtactgtggggaacgagaatccagcattatctttaataaaatccagaaacatttttggttgtttcctttgaggggtacgtcgcagcacgctcacttttttccccttctcgttggccttggtccttcagtttcacaaaatgtggatagtgacttaaaaataccttaaaaaaaaaaaaaaaagaaaaaaccattagagtaaggggaaagcacttcctaaagagttgaagaactaattggtcggtaaaaattggatattgaattcataagatgttaaaatggactggatttttggtagttttggttgcttttaaaaaaattagtgctagctttcaagtgaattacaaccttaaatttgagatttcctttggtgaaccatggaagtttacccagtggtaaggagaactgtaatgtttaggattctgaataagtactgtgttttaatcacagctcttaattcaaagcattgatttaattccacgtagtctgttatactcagaaacataaaaacaagtggaaaaagtatgaccccagtgtcggagatggctatgtgtgcatgtatatacaaatagacacgtatatgtgcatgttacctttacgtacatgtggaaaaacagttctaattaagtcaatatgtgtcttgtatttgcatatattagagtatgattttcctaatggtcgagggcctttttggtgggccgcagtttggatttatgtggtatgttgatgaagacttagtgaatagccacagtactcagcttttcctctcacagattaatctgccagtttctcccactgtgtattgtgtatatgtgatagaatttgagggggaaaataacacaccagctaatgatgaaacgaactggctctagtctgtaaggtaacgggaccagcccaattatataactgattgaggcattgccatttttcacttaactctttgaatcaagtcataattttatttaataatttttttgaggcagagtttcgctcttgtcgctcaggctggagtgcaatggcccaatcttggctcactgcaacctccgcctcccaggttcaagggattctcctgcctcagcctcctgagtagctgggattacaggcacccgccaccaagcctagctattttttttgtattttttagtagagacggggtttcaccatgttggccgggctggtctacaactcctgacttcaggtgattcaccggcctcggcctcccacacagctgggattacaggtgtgagccaccgtgcccgacctgaatcaagatattatttaaaagaactgtttgatgttatttatttattcatgtcttcaataggtatttacatgtctgtcttcggagatggtgttagaggttgttttttttttttttttgagaccgagtcttgctctgttgcccaggctggagggcagtggcgcgatctcggctcactgcaagct

SEQ ID NO: 44150 - DNA, 1067 bp, Homo sapiens
aaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctcctttctactggttatgtaaataaatcaaataaatatatcaaaatgagtgcagataagaatcttgaccttgactaaaggtaaggaactaaatgaatgtgggatcctcatcagaaatggtggtgacaccaaaatgtgttgtgatcagctgtgaagta

SEQ ID NO: 44151 - DNA, 1080 bp, Homo sapiens
gattcaaaaaataatggttgattcaaaaaatgttggataactgagtaaccatctaaaaaaccatttaagtgtggctcccctacctcatttccctttgctaaataaattccaggtggatcataaatttgaacattaaaatgcaactttaaaaggactctacttaggccgagcaaggtggctcatgcctgtaatcccagcactttgggaggctagggcgggcagatcacctgaggtcaggagttcaagaccagccatgaccaacatggagaaaccctgtctctactaaaaatacaaaattagccgggcatggtgccgcatgcctgtaatcccagctactcgggaggccgaggcaggagaatcggttgaacccgggaagcggaggttgcagtgagccaagatcgcgccattgcgctccagcctgggcaaagagcaaaactccatctcaaaaaacaacgacgacaacaacaacaaaaaacagtactctacttacatttgagattaaaaaaaaaagaatctctgaccaggtgtggtggctgacccctgtaatcccagcactttgtggggctgaggcgggaagatcacttgagtttgagaccagcctggccaacctggtgaaaccccatctctgctaaaaatataaaaattggccaggcatggtggtgtgtgcctgtagccccagctactcaggaagccagggcaggataattccttgatttcaggagccagaggtggcagtgagctgagatcatgccactgcactccagcctgggcgacacagagcaagactccgtcttaaaaaaaaaaaaaaaaaaaaaaatctctgactggtgacatcctaagtatgagttaaatctcagagctttttttttttttgacagccaagctggagtgcagtggcacgatctcagctcactgcaacctctgcctcccgggctcaagcaattctcctgcctcagcccccaagtagctgggattacaggcgtgtgccaccacacccggctaatttttgtatttttagtagagacggggtttcaccatattggccaggctggtctcgaattcctgacctcaggtaatccg

SEQ ID NO: 44152 - DNA, 1032 bp, Homo sapiens
ctcagaagttaacatttaacctggcttaatttttttatgttcttttttttaattaaaaatgtttttcttttatttattttttgagacagggtcttgctctgtcacccatgctggagtgcagtagcatgatctcggttcactacaacctccaccctacatgttcatgtgatcctcccacctcagccatctgagtagttgggaccacaggcgtgtaccaccatgcctggctatttttagtggagacgggtcttgccatgttgcccaggccagtcttgaactcctgagctcaagccatcttgcccgccttggcctcccaaagtcctgagattacaggtgtgagccaccgtgcccagccacattttagctttttatttttaatatggatagataatgttaagtgtccaattacaggaaatgtaatacctctagtccacacagctataaccacttaacctgtatttctttatcagactagaactgattttccactcaaaggttctatagcgaaaaatgagctcttacatctataacttttattatggtatatataatgttaattcttttgctttcaagatccaagaaaacattcttggccaaaatctaggggaagttactgccacttcgtactatataaggaaaacaaagacaccatggatgctattaatgtactctccaaatacttaaggtgagttactgttgttatgcctatacaaaatcaaagcaacagaaacgtatattcctttttccatgctaatggaaaaaggagcaggaggagcacagattacagatagtaaatgctcctcccaatgatagttttctttctttctttctttctttttttttttttttttttagacagtctcactctgtcactcaggctggagtgaatgatggtatgatcaggctcactgcagccttgacttcctgggctcaggcattcctcctaccttagcctcctgagtagctgggattacaggcgtatgccacaatgccaggctaattttattaggttttagagacagagtctcacta

SEQ ID NO: 44153 - DNA, 1083 bp, Homo sapiens
tcttaaggtatagcagcatttagtttttgagtcttgtggcttcatttatttcttgtcattatacttaattatgaatactccaaaggggtagttgagaaaaatgtagctacacttcatcaacttttatcacaagtgtttttaaagtttttattatggacattttcaaacttgcagtcaaatagaggaaatagtatatggaacctatgtacccataaaccatctttaagattatcaacattctgttgttttattgatttatccttcctccttttttttcttgctggagcattttaaaggaaattctacatagcatggcttttcactcataaatatttcagtatctatttgccagatgaggactgaaaccccaaactattatcacatccaaaaacatcaacaataatttcttcctatcacatacctattgcatatttggttttgctgtatctcaaaaatgtcttttttatatgcagatggcttgttcaaagaatgataaaaacaaggtcagaacattgcactcattgataagcctcttaagtcgtctcttaaatcttttttaatctataaagaacttagctgttttctataatatttaacatttttcaaatttaaaagtctttataattcaatgcaagaaattcatgaaacgcagaaaaagcaaagcaatagttacttgtctcactatcaaaaaaaagataatcacaaatagcattttggtacatgtcctcccatatttaagtaaacagatctctttttggggaagcatttactatccttaaaccttttgcttcatctcatgggtacagacagtgcagctttgagcgtgaactaacatgcccattgtgaagggattgagacaaggaggctgcacctgtagaagagttttctacttgttcactgtttgcctctaaaacattccattgttaatgtctaaatggctgttaacccaccgcataactaccgggtgctgtagaagtcctcagtgtaaacttaaccatgcgatcatttgcatgttcacctctaaagcactttaatattataaattaaacattgctcttttgtgctctttatgctgtgcatttg

SEQ ID NO: 44154 - DNA, 1065 bp, Homo sapiens
agtcacacataaaaaatatggaatatatagaaagacacccttttatctcagcccatcttttgttgtgtatcattcatttgaaatgggcatagtcccagtgagtcactgatatttatgttctaatgtgttatctacagccacaaaagtttctatttgcatataacctttcaggaaaattaggtaattttttttttcacctaccaaattgacagataaaatttaaatgaaaattacaacaagaaaaagttatttcctcaccctcctctcctactagcggtggcctgtattaatgaacatttattcctagatatatttggggcaaaattctaagaccatataacaaaaaactgtttatttattagggctctgtcagtattcttttaggttaattcaaaagataatactgtgatggatgaagccttaattgcttataaccatgtttctagtgaaatgagagggtataacaaaaaagagaacaggaggaaagcttcgctgtgcctgaggaaataatctagtcaaggcagcaagtctggatagtgctatagagatgagatacctgagcagttccagaggaagaggtggagatcagaggccagttttcagtgaacactgtaaagaaaagccagatgatgtgtcctggaactgcttggggcatgagtcctgaattactttttactccacaaacgaatggtgtggttgctgtgtgtttctttaatgtctgggtcatggtataaaatgtcacctgagcagccttttttcagccaaggttgctcaaagaggagtaagcccagtggaaagtgattggagccactgttggttcagttctcccaaggatagtgtgtagctagtaactactgtagatggagaggagaggtgacttctacaaacagccatgccttggggcacttggtcctaattctctcagggaacccagttgggaaggctgctagggagttattttttgtcaagaaacagcccatgttggtcagcagtgctgcccattatgaaggcgggaagacaaggcaaggtcttactctgcttggtgtggtcatgaggaagcaggtt

SEQ ID NO: 44155 - DNA, 1084 bp, Homo sapiens
agcagcgattggaagagctccagctgttcaaaaataaggaaaccagtgttgccattgaggtaactaatgcaaaaatatatgaaaaattatttagggttttagttgctttttgggtggatgttaagtgtttatggaaaaaattacaatggttaacaaagggtgactttttgctctattggatctaaaggatattacactaaaaaatttttttactggggcagataactagtatcccagataaactatagccccccccaaagttacatttttgtttaaaaacatttttatttgggtacagtgttacatgctattccaaagtcctagctactccgaaggctgaagccagaggtttacttgagcccaggaattggagactagcctggacaacatagtgagacatcatctctgaaaaaaaaatttagggaccacaaatgaacagcgacatatgttgtttagaatcccagagtaccaattataccacaatgtccgttgtaacaggaccaccatttgctgtctgtcaggtatgtgacccaggtcagattctggcttcagcagcttcttggcctcagttgggactctgggaaggggaggaaatggggaaaggaagtaggggagcatttatttgctcatcgtgggtcaattctgctattgaagaaaaggagagctcagctactaagtagaatagtaaattttgttgttaaagcttttgttcgccgggcacggtggctcacacctgtaatcccagcactttgggaggccaaggtgggcggatcacttgaggtcaggagttcaagaccagcctggccaacatggcgaaatcccgtctctactaaaaatacaaaaaaattagccaagcgtggtagcgcaggcctgtagtcccagctacttgggaggctgaggcaagagaatctcttgaacctaggagacagaggttgcagcgagcagagatcataccactgcactccagcctgggcggcagagcgagactccatatcaaaaaaaaaaaaaaattatgttaaattaattttgtactacattttaatgagctatggggttttcggttgtctgaaattccccctcccag

SEQ ID NO: 44156 - DNA, 1048 bp, Homo sapiens
gcctcccgggttcaagcaatgcccctgcctcagcctcccaagagctgggactataggcgcctgccacccacgcctaactaatatttagtagagatgaggtttcaccatgttggccaggctggtcttgaactcctgacctcaagtgatctgcctgccttaacctccctcaaaacgctgggattacaggtgtgagccaccgcgcccggcctgaaaccagcttttatataggtgattgttactttctactctttcctaacaggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaaggtacatttagtttatgaataaagttattttgattgtattaggtttcttctttagaaagaaattagctttatattcttccacttagctttccatctccaaggcttgtttatactactgatcaaaaggaataggatgaaggaaacctgcctgaataaatagccttggatttttaaattttaattaattaattttttccctttttttgagagagggtctcactctgtcacccaggctggcatgcagtggcatgatcatgcctcaaataaattcattcaccaggcacagtggcttacgcctgttatcccagcactttgggaggccgaggctggcggatcacttgaggtcaggagtttgagacc

SEQ ID NO: 44157 - DNA, 1050 bp, Homo sapiens
gtaataaaagtttacaacttgattttttcaaaaaagtcaacaaactgcaagcacctgttaataaaggtcttaaataataataataaaaagaactctccactgggcaccctcaaaattgcacaagttccttctgttattagttcatgctgagttgtgatgccagcacttcaagccttgttaatcattggatcaacaagtaccgagctaggtgctagagagagatggaaaaaggcacctgggcccagccctaagcctggatcgcggacagtgacgttggtccacacctcacctgccctctctgccctgctacatgccccaggcttgccctgaaccgtgagctctagaaattccaggtccgggtcgcagccacagggcagtcaggcgtgtcacgtgaccgcgccgggtagagggagacagagtcgcacggctgagacgccaggcagtcgcctagcaacagcgggacgcggagcgatggagaccagcagcagggagctccaagccgcggagtatttggaaaagcatcagatcaaggaggtggttagctacctcaccagcgccctccttttctttcggccgggtaagggcccccatgccccggtacagccatacctccatgtggggttcgcttcccacacgaaacccccctcttacacattcgctttccactgcctcccagccacgtgagcccttctgctgttgattaactctgcggccttcaataaaagtccctcaggctgcagtacaatggcgtgatctcatttcactacaacctccacctcctggtggcgattctcaggggcgattctcctgcctcagcctcctgagtggctgagattacaggcgcccgccaccatgcatggctaatttttgtatttttagtagcgacagggtttcgtcatgttggtcaggctggtctcgaactcctgacctcaggtgatctgcacgcctcggcgcctcaaagtgctgggattgtaggcgtgagccaccgcgcacggccaaagtttttaatctggcaactaaacaattgatagggtaggatagaagatgttc

SEQ ID NO: 44158 - DNA, 1034 bp, Homo sapiens
cagcagaggcaactaattgggagctgaccatgggagaaagagaagaaagccaagtagaaggtcacccctttgggggagtgggctgtgaaaattcagaggcttttggccaggcgtggtggctcatgcctgtaatcccagcactttgggaggctgaggtgggcagatcacttgaggtcaggagttcaagaccggcctgaccaacgtggcgaaaccccatctctactaaaaatataaaaattagctgggcatagtgttacacacctgtaatcccagctactggggaggctgaggcaagcaggagagttgcttcaacccgggaggcagaggttgcagcgagccgagattgtgccactgcgctccagcctggatgacgaagtgagactcctgtctcaaaaaaaagaaaaaaaaaatctgaggcttttaattcattttgttatctcagcccttactaaaaagtcagaaaaggttgcctgtggaaaagacagctaggaaaccaaacttaaaacaaggaagatgagtatcttcaaatgctgttggcacccaccttggagtacttaaggaactggcttctgacagcacctctatgcttatctttcaagccttgagaagacagagaagggataagtgtggagtccatctaatttatgtatttaaagaaaaaaagtgttccattaattgatgacagttaattgcacttaagttcgtacctaggcaagctgtagagtaaaatcatccatcaatgggtttgtcactgcacactggaaattatgataacttagtaaagagctaattatgtcagatcaattacagagcctcttgtgatggagtggaaaggtgtaggcatggctgtggaggagttacctgccacacagctgggcctcgtgggcaagctttgttctccttgggttgttgggattgcgggtccatcctgcaggaggctgtagctggttagggaagactcagccggagagtggtgtttgcccacccaccggcgatgtgagtctcccagtcactaacctgcaatccgtcttatc

SEQ ID NO: 44159 - DNA, 1036 bp, Homo sapiens
ccaggagggtcttgaactcctgaccttaagtgatctgccaccctggcctcccaaagttctggggttataggcatgacccactgtgcctggccctgaattcaggttttattttatgaagtatgggcactaaaaccaaaacaacaccccctaaagagtaacaaagcaccacaaccagtctatcttcagtatcaatacgtaaaggagatcctaacgcagaaaggtagggaggatgtaaactcagaaaaatctgtatgtacatatgcatgtgtatgcatgtgtgtgtttatgtatcacattgtttaagacaaattaacacttctttgtggacccaaattggtagcattagcgtttgggaactgctgtcttagagtgcctgtttgctgtatcctgctggctgccttaattactttaacttaaaaattacctcctttaagtgatttcagaaagggttttaaaggtaactcagttatcttgaaactaattgttctgctgtagattatccttgctcttactttctgcaggcttttttaaaatttggatgaaattcacaaaacataaagctaactgttttaaactgaacaattcagtgacatttagtacattggcaatgttgtgcaaccaccacttctatctagttccaaaatgtttcatcacactccaaaataaaacctcatacccattaagcagttattccccctcccccaccacatacagcccctgctaatcaccaatctgcttttcttatctatggatttacctattctggacatttcatttaaatggaatcatactatatatatatgaccttttgtgtctggcttctttcatttaccatcatgtttttgagactcatttgtattgtagcatgtatcatgcttcattccttcttatggctgagtattcttttattgtatgtatgtagcacagtgtttgtttatccactcatccatggatgggcgtttgggttgtttccaattttttggctcttatgaatagagcagctatgaacatttgtggacatggatttgtgtgagta

SEQ ID NO: 44160 - DNA, 1041 bp, Homo sapiens
ctagaatccacaaacaggcaaaacaaaaagggttttgacctcgctccgctgccttcacaagggaagaggctgcagggctgtggtgctgtcttggtgtgtgccaacctgaaacacatgggctttgacacaaagtgcacatacaggggccaggagcagggtgggcagcctcatcttaaattctttgtggcctctctccctttggctagtgtgttttttaaaggatccattcaggatctgttgagtcttccataacatcataaaactgtgggattttagagctgcaaaagacctaagtgtgattcagtccaacttcccacccttttttatttataataataacagctgctatctgttgaataatataaatactaaatatttattgaatacatactgtgtgccaggaagttttctgagcgcttgatatgtattcacatatttagtcatcacagcaatactttgcaataggaactctcaatatttccaatttgtagatgaggaaagtgaggcatacagagaaaaggaacttgaccaaagactaacagctagaaagtggcagaatcaggattcaaacccaggtgtgtctaaccccgagccctcttagcccctctgctttgcagagacctcagtatgaaatgatacaccccacgtcatgtatccaaagagtgagggcatcgagacccagaaccacactccctaaaaactggcagtggtgctgtacattttttaaaatagggtcttgctatgttgcccaggctggtcttaaactcttgactccaagcaatcctccctcctcagcctcccaagttgctggaattataggtgcacaccactacacctggcttgtatcttattttattattttattttattttattttatttctttgagccggagtctcaccctgtcgcccaggctggaatgcagtggtgcaatctcagctcactgcaacctccacttccctggttcgagcaattcctctgcctcagcctcccgagtagtggggattacaggcacatgccaccacgcccagctaattttttt

SEQ ID NO: 44161 - DNA, 1053 bp, Homo sapiens
tcattggttaaggactaaagatattgtcaaacttcttttgaaaagcccactttctttctcattcttgtttgacttgcagtatgatgattttacccttccttactctcctgtactgtaactataccctaaactctattttgagggctatccagagaaaattctttaatcctgcaaggaatttcctctgaaacccaaaacacttccaaacatttctccaccaaccccttggcctgtgcagacagaatctaaactcatattaacattagtctcagtctaaaatcatcaacaagacaaatctaataaggaaaacagtaaggtggggcattccaaagtgaggggcgaattcctgtgcccccaagctgttcccttccttctcctcatgcagataatttagaatggtgcccaagcattgtctctctcactcctcacattcctccccagcagagggccttcccccaaacactctgaaagctcttttcgtttgcagttttttcttactaacatttttcaggaaaggaaagtttactttagtgtgccctgctgcctcatgagaccacctgacgatctccttatctccggggtgggcccagctctagagacacaggcagccctgtccacacttggccctgagtgctgttttgctcagctccccagagagtttcaagtggcagaggtacacagtgcaaaagccccaagcctcaggcctgagggagaagactctggaagcaggagggtgagcctcagctttctagctcagtcatacccaggcccaggtaaccagggggacacctaactgtgtcactggcaggaggattcctgcaacattggtgctgggtctgcagagatctcacgagggcatagcgtaggacctgtccatttgtgtggtccaacaggtaacatccaatcaaatggaactacagagccatgcagctggagagagatccctaagatggtcggatctaacctccccaaccctttattgcagtagagcaactcgggacctactgagaccagacaggcaacccagccagagtctcacaggtagagaagagc

SEQ ID NO: 44162 - DNA, 1034 bp, Homo sapiens
atatattaaacccacacatttacttactttagaaaggttactattttgagagtatgatcgttcctggaaaaaaaaattttgatgtgcctcctgtccattgaaaagttacatataaagaataatttccattccttggattatgtcttcagattcctgcattcttttcaagctttgtaataaagcaagggaagagagtattgtgaactccttgaggaagacattccctctcattcctccacattgccccagagttcaccatgtctgacaaatagtgggtattcagtcaatagcttatgactgaatgaatgatttagatgtttaatcctttaagtcagtgatacgcaacttgtagtcatgtgtcagaatcccctggagggcttgttaaaatcaactgcggctcccccatcccaagtttctgattcagtagatctgggttggggccccagaatgtgcatttctagcaggtccccagatgacgctgatgctgttggccctgggactatactttgagaaccactgctttggggtccactccactgcttaggtccattgtggttttttttttttctttaagctttgccaagccttctagaaaattgacatctatctctgtctgattttgctccgttaaactgagattgattttgtaaaaattactaggatttgaccagatggaaaagctacctggatttttttgtttttagttaaaaactacagccgggcaccatggctcatgcctgtaatctcagcaatttggaaggctgaggcgggtggatcacctgaggtcaggagttcaagaccagcctggccaacatggtgaaaccccatctctactaaaaatataaaaattagctgggcatggtggcgggcacctgtaatcccagctccttgggaggctagggcaggagaatcacttgaacccgagaggcggaggttgcagtgaaccgagaacacgccattgcattccaacctgggtgacagagcaagactccatctcaaaaaaagcaaacaaacaacaacaacaaaaaaaaaac

SEQ ID NO: 44163 - DNA, 1029 bp, Homo sapiens
ttcaaaatagaaaataatgaagctacaatggtctgggagtttcctgcttcttgtgatacccctgataattgtcatgtaaattaactagtcccatagcaactaggccacacataggaaaaaaaccacaccactgccagatggtaatttaggaatgtgattttagttttcagatgtaaaggatggtgagggagtggccttactattgttttatttttgatttcttgtttaattgatggtggtcagagaacattagttataggttatccattttataattcatgataacttcctttgtgactagctagcatgtgaaccacttttgtaaatgtctcacgtgattgaaaaatgtatataatctctctgttgtgggcagagttccatatatttattgtatattttgtaatttagatcatgtattattagaaaatttatttaatgtctctcttgtgtacagtattccatatattgtttattttgtttaaatcttattcattcttgccattttttgtttgcttgctctgtaatttctgggaagagagttttaagtctcctgtgataattctaagtgtgtcagtctctcctgtaactctgacaccttttgctttacaattttgaggctgtcctgttgggtatatgtaagcttaattgtgaggtctttttagtagtggtgtctttgtgcctattaatgcttttgccttaggttctattttatctgattaagattgctattcaattttctttgggtcaatatgtatttgcctcatttatttctttccaatcttttattttcaacttttctgtgtcattttgttttaggtgtctctcttgtaaagcagtatatcgctggctttttaaaaagtccaatctggccaggcacagtggctgatgcctataatcccagcactttgggaggcctaggcaggcggatcacctgacgtcaggagttcaagaccagcctggccaacatggtgaaaccccatctccactaaaaatacaaaaataagccaggtgtggtggcatgtgcctgta

SEQ ID NO: 44164 - DNA, 1065 bp, Homo sapiens
tgtttgtttattagcgtcatagatactttgcttttctccccctgaattattttctcaaattccgaagccttctctaggggtgcattttcctaagataacaatggcttagtttacattgtggctgtggttttctgctcatctttataagtggctgcctccaccccatatgtaatcttcttaaacaagcaccttcttaaatgaggcaaccctcttaaccaaagcgcattaataatactcattattaatgagtatatggtagtgctcttcttattaatgagaaggctgcggggccgggcgcggtggttcacactgtaatcttagcattttgggaggctgaggcaggtggattacttgaggtcaggagttggagaccagcctggccaacatggcaaaaccccgtctctactaaaaatacaaaaaattagccaggtgtggtagcacacatctgttatctcagctactagggaggctgaggcagtagaatcgcttgaacctgggaggtggaggtttcagtgagccaagatcgtgccactgcactccagcctgagtgacagagggagactctgtctcaaaaaaaaaaaaaaaagggttgctggctctgactgacaccctaatcctgtgacctgcatttgtcagctctgggcatcatcctgatagtgacactagctccaaaaacatgaatcaagtttcccggtgcgtttaagaaggcaggggctagatggtggccctttgaaaattttcctcccactttcttggctgagctgcctttgtcatattcttacaacaaacccatgggtccctagggtttggtggtgaggaacttctagcccttatggccaacctttgccttagctgctctttgaggtgggtactggtgatggtggcagtgcagagccagcctgggagacaagtggggtggccagaggaagagggtgtaccccagagctgccctcctctgtggcttgtaatgtttgtgagccaagaaaccactggactttttgccctccccggtgccccacatgcaggctgaagaactacggtcctatcatttattttttttaacca

SEQ ID NO: 44165 - DNA, 1022 bp, Homo sapiens
gacttttccccacctcttcagttatcattattctataataaaataaagggagttgagcttatccaagctctttaacagtctctctatatacaaattatcaactgcaaacacgtgtatatgtatgtatatgatatatacatatctacatatatataatctgtatctgtgtatatactgtaggcatattttgtgtttgtaatgtgtagaattcaggcttacggagcacctctgggagtgagtccaggactttcaaaccagcacaaggcaaagcaagggccctagaaagcgctataggaggaggtttggtcagaggccaagtcttctgcccctccctgcagccagcactgtgtcctcgggctacttgcttgatgtctcagggctttggtttccttgtccctaccatgggaagatgacttctgtgggtgtgtccagctctgacatgttcattctggcagactgagcaggaaaggagcaagtcgtgtgcctggcacaagttgaccttcttgcctagtgctctgtaccaaatgaccctctccactgcctggaagagagaaagggttaaacctctccaaagagaaactgtcagctggtaccaccagctgagatgacaggtggagaatccaaagcagagccatggcaagaaggtcccacccagccagtggttcagtgaccaggcatagaagctccgtgaccagtgcttctgtgcgtcttgtgagaacgcagaggctacatcatcctgaatatgattttcattcactcaattcacaaggatgtgcagctgttataggcacggaacaaggggttgcattctattgtaagccatcaaaactttcactgggactgggttcaatggcttacacttataatccgagcactttaggaggccaaggcaggaggatcacttgaggccaagagtttgagaccagcctgggcaacatagtgagaccccatttcttaaaaaaaaaatttagccaggtgtggtggtatacctgtaagtctcagctactggagaggcagagggg

SEQ ID NO: 44166 - DNA, 1041 bp, Homo sapiens
atggttaacaatactgtactatacactcacagatgtgttaagacagtagatctcatgttatatggggctttttaaaccacaacttgttttttaaaaaggatgtaatatattagtcactaaccctttgttttattgaattttctcaaggttaagggacttacccaagtgctcgcagcttataaaggaaagagggtgacaagaatgaagcctctgacttccagggctctttgtcctgctccaagtcaggcattagttctgtctgtcaaaatccagattatcaaaggaccatagtataaaagggctctgcaatatggggaggtgcatccacgcttctttgggagaaacgcctcacatgttggcttcataaaactcttctatgccccgtaggttggacaatgagaaataaataatccagacattggtgtttttgataggtggttagagcttccccaacagggggagtaaacaaaagaaccatcttaatttcaagcttagttagaactacggaagactaaaagtcatttttcaaaatggtgggtggtgccagggctctatccccacctggaaggggcacttgatctgtaaaagcagcaaaaataattgtgtcttttatgtcacttaggtagaagctcctgtcccaattaattcttatctcctcctccctttataaatatgcttgggcaaagtgacatcctagcagttttttgttttgttttctctcttcttaacaaggaattctctctgcttaggcattttaggtgctgatttttctcatgtcccagagatgcttctaattagttgatgcttccttcccataatagttcaccacagagagtggatttggactggaggagggagcaattttgtcatcttatcaaagtgccactgatcaggttggctttcctgagtgctcattcatttttccgcctctctggaaacagaagcagcaagctccttgctgagtggagctggaggtttttgggttttgctgtctccccagtgcttcccagcaccctttgatgaaatgctgcctcagagtct

SEQ ID NO: 44167 - DNA, 1084 bp, Homo sapiens
atctatccagtttctaagtcagataacaagctcagaaaatgagagacactgtacatccaaatttatttggtttctgggtttcagatgtgagtagtggaatttcaaatgatgaggaacagattccagaaaagtatccaaatctgttcccttctaaaagatgaaggctaagtgtttggatagtgagaggcatctatactgttcacttacagagccaaggagtatttatttccttgtgtcttaaaaacatgcttattgagtctgtctttgtctaccaatattaggcaatattggcaattccacttcctctcgtatgtaggtttttgcttgtcctaaaattattgcctcatggtttttacttgcattcttacctatatgtttatccttaattttggccactagattgggtatatcctgtcactatttttggcccagctggtcagacatactgaataaacccatcaattcccctgtattttctggagcccattagcccctcagcctactgtgctgctggtctgtgacaacagcttccctcttcattgtcttgggaagtccactgactggaagcctgtcttcgtcctgctcaatttactccctcttttgctaggactaatcttccaggggcatcctacatgaaaggtaaatttttcgagtcttcaaaatatggaaatgtcttggatctgtcctcagacttgattagtaatttggtggctacagaacattcaaagttggaagtaattttctctcgggattttaaagacattttcgtattgtcctctggctctagtgtcactcttaatatgagatgccagtcttgtgtgagaccactttcgttctctgaaagcttttaggatcttctctgtaacactgttgatctgaaattacttaataatatgccatggaggtttttttgttttttttatttttttgtttttttttttttgagacggaatctcactctgtcgcccaggctggagtgtagtggcgtgatctcagctctcagctcactgcaagccctgcctaccaggttcacacccatggaggtctttttttctttctttgggttgggcactccactggtggg

SEQ ID NO: 44168 - DNA, 1023 bp, Homo sapiens
tccaagcccccgttctctaggaccttcatagtaacctcttgactgggctttctcctggttagtgcctggttagtgactctccaatccagctttactgtctccagcatgacttttccagaactcagatcggattgtcactctgctcctacactcatgccagtggctccctggggtctgctgggtgaagttggcatacagcccctcactgtggcccttgtgggccctcccaggcccagccactgcctgccggcagagtccctgtgctctccacagaccactcaccctctcctctgactcctctgatcctgactgctgccttggtccacctggcaacttcctactcatccatgaaggcccagttcaaatgaggtttccctgacaccaccctaaacctcagacccatgcagaattagccaagtcctcatctgtttacatagcacatttcaggtgtttctgttacagcatataataatattgtattatttcttatttcacctgtcctcctttctggtggactctgggtgcctttaacacagaccgtatgtctcatttatattcctctttcccatgcctggcacatagtaggtgctcagtaggtgtattttcccatgggtgttcatgggctctctgagtgcaacaaagtagatactcatcagtcctctctgccctgcatatgaggctggacctaaggctgtcatcccttgtggggtgtttaagttcttcctctcctctgggtatcatgagcagagatgcagggagaaaagggagaagactcatctcatctcaccttgtgctctaactgtaacagctgccattcagacaccccagatggaccattcagtgtaggctgaatggccaaacaggctcatatgtgctaatcaggtaccatcttgaacccagtccaaacggggaagctgccagcatttacacccatgtgcccagcaaactgggagtgaaggcagtaaagagtgcatcgggctgagacatggaaagcccagggttggatttggagtgtttaggcca

SEQ ID NO: 44169 - DNA, 1026 bp, Homo sapiens
actggaggctagaagaatagtcactgggccgaggagcagcatgctctaggctgggtgcacggagctgcaatcatggagggcctggacctccatgagtagatttatttaatgatgctttttcttcatgcaaaagtgatatgtgatcactgtagaagatgcacatcaacaaaagaagaaaaaagctagcctatacccctgtcatctggaattaaccagtgctgaccttttgtttgtttcctgtaacttacaaaaatgggataattttgtattatgttgattatggtgagtacctttcctagttattaagtattccattgtaaatgtatttcataatttatttaactaattccctgtcattggatatattggttgttttcaggttctcattattaaaaataatattgcaatcaaatgaatatccttgtagctaaatttttgcacacattcatgattatttctaaagcataaattcttagaagtggaatgctgagtctaagagtgtgctgtttttgaggcttttgatactcattgctaaattgccctctagaaatattgttccaattaatactcccatcaggagtgtatgagagtggctgttttcccaactctggccaatatctcaccaaagattgtcagatatttgatgatttaataagttcaaatgttatcttattttagttttcattcttatgattactaataaggttgaacatttcgttagctttgtgtatgttcttatatgagttgctttttcatggtttttgcttaattttccattggcctattaatcttttttcccattgttttctaagagccctctatagattaaggctaacttacccatgtctgtcatatttggatcacatgagttttaggaaatcttaatgctcaaacattttctatccaatcttgcctataggaccaaagtagctaggaaaatagaaatttccagataattctcaaaccacatggcaggtgttactgaatgctggcaggggccatttcgtatgaatagttatgctgaca

SEQ ID NO: 44170 - DNA, 1032 bp, Homo sapiens
aatgctgtgtaaatagttgtcattctgaattgtttaggggataatgacaagaggaaaaggtctgtacatgttcagtatagactcaggcatcttttctttttcttccacatatttttgatctgcaattaagttgaaactgcagatgtggaactcacagattcagagggttgactattcttttaatttaacttacatcattaaaattttctccatcactttcttaaattttgataatcaaaaaaataataaatcatgccctgatttgtagtatgtgatgatttccatggtgtaaactctcctaccactgcatttcaagctgtcaatgtgatatcacagaactcagagttgggaagagatatgcatcagcacactgttacgtaggatatcctccatacagatacattagatggtaaatgactttgagagcaggattaagcaacgtgtggcccatgggctgcctgtttttaataaagttttattggaacatagccacactcattttttaatgtattgtctgtgctagcttttgcactacaatgcctgcatggagtagttgagacaaagcctaaaatttttactacccacagtggctcacgcctgtgatcccagcactttgggaggccgaggcggacggatcacgaggccaagagatcaagaccatcctggccaacagggtgaaaccccatctgtactaaaaatacaaaaattagctgggcgtggtggcgcacacctgtagttccagctacttgggaggctgaggcaggagaatcacctgaacctgggaggtggaggttgcagtgagccaagatcacaccactgcactccagcctggtgacagggtgagactccatctcaaaaaaaaaaaaaaagaagaagaagaaaagagaaagttcccaacccatactcaaagcatagataataagtgaaatgtagcaagataaattggaaatgatgagttttatattcaattgtaagcttatgtcatataacttttaataatttaataattggctcaccacattcctgagaatt

SEQ ID NO: 44171 - DNA, 1021 bp, Homo sapiens
cttttctgtacctcacctccctttttttgtctataaatcttccaccacgtggctgcgctcgagtctccgtgaatctgctgtgattctgggggctgcccgattcgcaaatcgttcattagtcattaaactcctttaaatttaattcggctgaagtttttattttatcacagccaaatgcttcaccccttcgaaaaaattaatgagtaagcaaaccccatgtatttatactacacacactgtcaaacacttcggagagattaagtaagataaggagtgagaatcaaccatcgcctttgacattgtagaggttattgtccttgacaagggctatttcagcggaattctgggaacaacagtacttcattacagtagtccaacagagtaatttgtaggtgagagagtgaaaactagcaggtatggatgattcttttgaggtgttctgctataaaggggagcagagaattggaatagctgaaagaagatgtgagatcgagggacgcatttttgtgtacttaagacttaagctatgacagtgtgtttttaacctgagaagattgattcattttaaaatagaaaaaaaaaatgctgatacaagaaggagaggcagggtgattgcagagccaactccttaagaaggtgcccaagaggaaaggttgatcttggcgagagcacacacaatccattcattgtattgggagggaaacacaaaagtttaaaggaagatttgtttgtagattgtatggtgattagactaaggaagttctctctacacttgttttctcagtgaaataagcaagttcatcacttaagaatgagtagcgacgcagtgcagacatttgattgaaggggaggccatattcatagaatgtgtaaaaatgaaataacattgtactgacgatcctagccaacacaacagaacaagaaaaaaagtaaatattagaaagctaatattagaaactaaactgttatcagcacatactatgtgtccagatagaaaacccaaaataatctaccactaacc

SEQ ID NO: 44172 - DNA, 1051 bp, Homo sapiens
tttgggtttttgtatttttcatttctaaaatttggttctccttttatttactgagactttttattcgctgagactactttttcgtttgcttcaagcctgtttatgattgcttgttggagcatttttgttttgttttgttttgttttgagatggagtctcactctgtctccaggctggagtgcagtggcacaatcttggcccactgcaacctccacctcccaggttcaagcaattctcctgcctcagcctcccgagtagctgggactacaggcgcatgccaccatgcccagctaatttttgtatttttagtagagacggggtttcaccacgttggccaggatggtctcgatctcttgaccttgtgatccacctgcctcggcctcccaaagtgctgggattacaggcgtgagcccattgttgaagcacttttatatgactgcttcagaagctttatcagatgattctaatatctctgtcatctcagtgttgttatccactgtcttttttcctttgttggagatctaactggttcttggtatgaagagtgattttcgataggaacctgagcatttcgggtactatattttgagactctgggtctttctatgccttctgttttgcaggctttttctgacatcactccagcagagagaaagagggagggccacctcattagagcctccatgggtggaggtgttcatttggcctttgctggtgtgggtgtgggtggaaccatagttttttcctgtggtgctgggctagggtagagtcgttatttcctaaaagttttctgtcttgctaggttgcctttttccttgtcctttagctaggaagagccaacttttgttgggactttatttttttttttctgtctgcattattgctgttcacatgttgccagtttcttcagctccaagtctgggatttataaggcaaaaggaaaatccagacaactcaccactatgttgtttcttgggttccaaggtccctagccagtctcccttcatctccgcctttcagagacatcttaggtttgttttctattaagttt

SEQ ID NO: 44173 - DNA, 1026 bp, Homo sapiens
tgatcaaaacagagtatggaaggatacagttattggtgatgacaaggtctaaggtatggtcctgggagtaagtggctgaggtgaggttatgttgaaggctgtataaaactttggtttctagtgtgaaaatcttagacttctgaggggatgactgagtcttatttactgttgtaactcaggcactgtgcttgtaacactaacagcaatgtttactatgctgactgacttttttaataaagtatatcatgaaggccatttctcagcaccataaggttgaatgtaatctcagtttcttcatcatggatttgaaatttagtattaaaattaactgttcattattaactcttactgatttttgctttaggactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtggtatgtatgcattatttataatttttttctttcatatatttgtttaaagtactagtaattcaggaaagcaatagctttcagtaaatctctggatggtttttatttttactcagctacctgaattctagtaacaatatagtgtttagtgaagaaaagtttgtctaaaaaaagtattacctgtaaccaagatcatgattttattcatctctgagactttctttcatctagtcagatttatatctgggaagattaatttctttttttttttttttttttgagatggagtttcgctatgtcgctcagactggagtgcagtggcatgatctcggcacactgcaacctccgcctcctgggttcaagtgattctcctacctcagcctcccaggtagctgggattacaggcatgtgccaccactcccagctaattcttttgtatcttcagtagagacagggtttcaccatattggccaggc

SEQ ID NO: 44174 - DNA, 1047 bp, Homo sapiens
tttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactg

SEQ ID NO: 44175 - DNA, 1460 bp, Homo sapiens
aatacagaggtgccagccaagccatacttactcttccagttgtcattggccaccctgaatgatgaatctaaagaagtatcattgtgaaacaaggaaatgtcagtcaagaaatattccttggaatataaaacaaagccttgactctgctggcataggtctgagttttcatagactggagcttcacaaatctgtaaaactcataatattaatgggtgctttttcagaaattatagaatagctgccacctcttctaaattaagcattgactgtcatcagtattagatttagccagatagtataagtgttatgcaggcgtacctcattttattgtgctttgcaaacattgcatttttttacaaattgaaggttgtggccaccctgtgttgagcaagtctgttggtgctatttttccaacatgtattcacttcatgtctgtgtgacacatactggtaaattctcacaatatttcagactttgtcattatatctgttatggtgatctgtgattagtgatcttcgatgttactactgtgattgttttagggcaccacagggcacacccagataaggcagtgaacttaattgataaatactgtgtgtgttgtgactccttcaccagttacccattccctttctctgctcacttcaagtttccctatgccctgagacacaacagtatttaaattaggtcaattaataaccccacagtggcctctgagtattcaagtgaatggaaaagtcacatccctctcattttaaatcaaaacctagacatgattaagtttagtgaggaaggcatgctgaaagctaaaataggcctcttaaggcaaacagtaggccaagttgtgaatgcaaaggaaaagttcttgaagaaaaatcaaagtgctactccactaagcatatgaataagaaagtgaaacagctttattgctgctagggagaaagtttgaatggtctgaatagaagatcaaagcaaccacaacatttccttaggctaaagcctaatccagagcaaggccctcgtttcaattctgtgaagcctaagagaggtgatgaagctgcagaagaaaaattggaagctagcagaggttggttcctgtggtttagggaaagaagccatctccatgagtgcagaatgaagcagcaagtgctgatgtagaagctgctgcaagttacccagaagatctagctaagatcattgatgcaggtgactaaacagattgtcagtgtagaggaaacagccttccattggaagaaggtgccgtctaggactttcataactagagagaagacaacatctgctttgaaaggacatgctaactctcattagtggataatgcagctggtcacttttaagtggaagctagtgctcatttatcattctgataatcctaggacccttagaatttgctgaatctactctgcctgtgctttataaatggaacaacaaagcctggatga

SEQ ID NO: 44176 - DNA, 1062 bp, Homo sapiens
gttttataccagtggcttaccgcagtatgctaaaatagattgtgtattccacagtcacatttaagtcttaggtttcatttcccttatgtttttaggggtccttataacctattttacatttttgtctttttatcttaggaaaaaggacaaaaatgataatcttgaggttagaagtaatgaaacttatttagaaattacacgagaatgttacatatccttatcagtgcttacaaactattggccaaagttgggaactctagtagtttcagatgtgttgatgaagagagcaaaatattgttgatttcttctttctaaaactgaagaaagaataattgattgcctaagcactacgaaagttattttgcaagtagatggtatggtagcaagcacatgacaatgggagttttgttttgtcttgtatcctgtcaagagagtccagaactatttggaccaaaggagcatttgaagtatatacattcacttctgtaaactcatactttattgtatatagtaaggaattaaggacactgacgactgtggttcctctattttcatcgtggttcttgttagaagtaaggacaccgtttaaaccgcattatccattagttatgaaatgtgctgtccggtgtaggttgcttctcaaagggtcatctgtaagctggttatctagaattcagcatatttttaaccattcatttaataaatgttggtgacctattgggtattataaaagaagacaaagataagtagtattttgaaatccaggagggacagaagttgattttatagaagtttcaaagagctgtgaaatttatatatggtgattaggaattcaaggcagctttttttcaaaaaaaaagaaaattttgcttcctctaatggccaagtaacaaatttttgttgcttgtctttcactgcttctgagcggatgcttcggtattgtcacggtggctcctgagtcaacctgagcctcatgagtggggtactgttgcagcttgtaccccagagactgcctatgcattcataaagatatatgtgacattgtacatatatttcaatttt

SEQ ID NO: 44177 - DNA, 1046 bp, Homo sapiens
gcttaatgctctaatggagaaagcaaatcctcactcatattattaaatcatttcaagactcaatgctatcagtatcttatggtcacacgaattgaggacaaatggtgagaccttgatcttcttaagtctttccatcaagagtcaatgtatatgcaaatatagacttaagaacataagcatcctggtttaatgttgttgtgagccctgtggaaataaaattaaactcagtgaatgtttacaaatcaatacatagtaatcctatatatgaaagctaagatgtataagatgtttataaatttactattagaaaatactgctttcttaaaggtgattttaaaaagctagctgatatctgatggctcaagcatccagaaaatgtatgcaatgataagacattgactaggatgaacagaaaagggatacaggaaaagtccgaacacatgaaattctaaattaaccaagaactgccaaaattcagttcagccaccctctcatctgactactgactgaccactatttttaaagaaattgtgaaaaatttaaacagatatgacctgcattttactaagaaacaggcacatgtacacaatgaatttaaaacatctttggccagccctcctactataaaaatattgatatcttcccttcatctttcaatgatacttcaaattgaccccactatatcacatgtaatttttttgcaattaatctaaaaacgctgaacctaaaagatgctagtttagtaatggaaaagttataagaaacaagtctatccaagatagcttatcatatagacttgtttgccaccattcctgggcctatttcttctcctccttgaaatttttcaatctagaaattctgtgccaatggcacaagtccccatgaatgacagctaacataccccaacacctccagccttattggtccctcaccaattaaggaaaaaaagctgttgagacaatcccaaaattattagagaaattttctactgtgatattaatggattaataatgcttatctttcaacccaactagaaacactgcatt

SEQ ID NO: 44178 - DNA, 1053 bp, Homo sapiens
ggtgggcggatcacgaggttaggagtttgagaccagcctggccagcatagtgaaatcctgtctctactaaaaatacaaaaattagctgggcatagtgccatgcgcccctgtaatcctgtaagccacctcagaaggctgaggcaggagaatcacttgagcccaggaggcagaggttgcagtgagccgagataatgccattgcactccagcctgggcgacagagcgagactccatctcaaaaaaaaaaaagggggggacaggtgattacccagaagattccattttaaaatgagctggttcttaccaggcctggcttagacaggcatctcagccagaaacctctgtgtgggctgggctgctagacatgctgttatgcgcatgtactgttcaggttgtttccctctcctcgtctgtctccgtccttgtccttccccttctgcccttctttccttccttgtatcatttacagtttgcgtcaagaatatattggaagaaaaaaagaaaaatgtaaatattcgaaccataaaactaacttaaattgctatagataagtttcaaacttggctttaaacttcatgaagccaaagataagagagaaacagaatcagctatctgattctcattatcagaaggaagaaaatgtatcaattcctaagagaaagttaagcatctctttttttttttttttttgagacggagtctcactctgtcacccaggctggagtgcagtggcatgatcccggctcactgcaagctctgcctcccaggttcacgccattctcctgcctcagcctcccgagtggctgggactacaggcacacgctaccatgcccggctaatttttttgtatttttagtaaagatgggatttcaccatgttagccaggatggtctcaatctcctgacctcatgatctgcctgcctcggcctcccaaagtgctgggattacaggtgtgagccaccacacctggccaagaaagttaagcatttcttggcacttaattctaaagtacttataaggacttttatacagagagcttcatacgggaagtact

SEQ ID NO: 44179 - DNA, 1031 bp, Homo sapiens
ccacaacccaaatggagcaaaacctactctgtaactccaggcagcttcactagcgttttgttctcattcctaaatgctaatctgttcctttggcccctagccagtactgagatagactagaggttgggggaaggaaccaagcaaaggaaaagtgaaaagaaaatttgaataagacatagaattgtctggagatagaaatatgtggtattaccatttttaaggcattttacagtttacatagcatactttggtataaactgtattattagttccgtgttacagattaagaaattgaagctacaagtcactcagctagcaagcagtagggacggcagacattctgggaacaggagttttctgattgcttctattttttcagggaaatatacagcaaagtcatcaactgagaataaggaggagggaaggaggtgtcggagattagagaaatgaggagaaggtgaggaacaatctcctaggggcttaggagcatgaatgggatatttaacagtattgacaggcaacgccaagaacccaccttggtttagtgatcatagatttaaagtccaaccagtgagaagctcattcagcttctcacactcaggcattgacttggtttcacccaggactagaattttcctaagtgaccatgaatatatgtattcttaataccctgccccgcttgctctctgaaaactaatgaactctccaggccccagtttaaagccagtatctccacagttgcactggatcccatttcctttcaagataccactcactgctgaagatatcactcactgctgaaattgattttaatgaatcacgtaatctaatccagaaaggaaggaaataaagaagtgggtatcagggactcctgtgagatagcatgagaaggtggtacatttgggaggtctcaaggggttactgaattattggaattagaatcaaagggacggccggtgcggtggctcatgcctgtaatcccagcatgttgggagtctgaggtaggtggatcacttgaggccaggagttca

SEQ ID NO: 44180 - DNA, 1024 bp, Homo sapiens
accaagatggagaaaccccgtctgtgctaaaactacaaaattagccaggcgtggtggtgcatgcctgtaatctcagctactaaggaggctgaggcaggagaatcgcttgaacctgggaggcagaggttgcggtgagccgagattgtgccattgcacttcagcctgggcaacaagagcgaaactccgtctcaaaaaaacaacaaaaagaatttcttactacgaaaagtaataatgcatgtaagattatagatttaattacatttttaaaattattttttaaaaatagaggtggggatctcactatgttgttcaggctggtctcgaactcctggcctcaagtgatcctcccacctcaacctcccaaagtgctgggattataggtgtaagccaccatgcccggcccttaccccagttattttttttaaattgtattgattaattagggcttaatactaggaagctgggattttagttattctgtatccctcaaagtaataaactgtcattcttttttgaaattctgtagtttgaagtttagtttgtactataatcaaattactataaatcaaagaagccttattctgtacatttcatgtagatatgaaggattgtttaagttgttaataaattacttacagtattcattattggaaagtgggaaaagctcagcatacctgaaagtgaacagttctttctttttcaaataattaaaaatatgcagacttatgactctaaatttaattaacaaggccagtgtttaggtcatgggtagatagaaattctatctgctgttcaaaagcttaagatcctttcaggaaaaataaaagctcttagagaggataatagatttgattagatgattcattcttagcaaattgtgtttgcgtttcttatcccctgtattgccaggtggagattttgacaggagcatgggtaatctagagaaggttaatgagaaagttaggttgagaaaggggctttgtgtggtaggaattggtggtatttgagcaacagagttttgagt

SEQ ID NO: 44181 - DNA, 1025 bp, Homo sapiens
aaactgcatgaacccaggaggtggagattgcagtgagctgagatcgcgccactgcactccagcccaggcaacagagcaagattctgtctcaaaaaaaaaaaaaaaaaaaagaaagaaaattaagatgaggaggtttgaagaacagaaagaagccagtgcagctggaacatagtgaatgaagaagggaagtgtttaagattggatcagagaggaaaggaaatgtgagatcaggtagagctttacaggcaatggtaaagggcttggagtttatcttaataaagtgagaaaccattgatttagaggaatgatgtgaactgataaacattttaaaattagcactctgactgctatgtagacaacttagggggggccagcacagagttggagaagtggaagatggaagctattttgtttatccagataagagatgataatgacttgaactaggatgagcagatgaggtggtaatttggttagattgattcaagatgtatttttgaaacaggatatgtagagggcaagccatggatttgagaggacaggggaatcaaggatacgactagttaatggaagactgactggttaagataggaaaaattttttcaaagcattgtatttaattaatatttttcttttgaaactggtgaattgaaaatgcaaatagagttgttgaaaaggtaattaaatatgagtcagggctggaaatatgtatttggaagtaatcatgcacttatttttatttttatttttttagatggagtctttgctctgtcacccaggctggagtgcagtggtgtgatatctgctcacagcaacttttgtctcctgggttcaagcgattctcccacctcagcctcccgagcagctgggattatgggcacacaccaccatgcccagataatttttgtatttttagtagagacagagtttcgccattttggccaggctagtctcgaactcctgacctcaggtgatccatccacctcagcctcccaaagtgtgggattacaggcctgagtcaccgc

SEQ ID NO: 44182 - DNA, 1028 bp, Homo sapiens
ataaaagtgcttcatcagatatatgtgaaattgattttccctttctggggcgtgtattttcattttcttagccgtattttttttgaagagcagacacttttaatttagatgttgtccagtttatcaatttcttttgcagaccatactcttggtttcatatcatgtctaactcaaggacagaaaagttccctcagatgttttcttttagaaaatttaatcttttttgagttaatttttgtataaggtacagagtgtgggttaaagagggtatttttgcatatagctattcaattgttacagtatcatttgttgaactctaccctgtgtctactaaattgtgtttgcacctttgtcaaaattcagtctgtcagatatgtgtgggtctatttttgtactctctattctgcaccattaatctatgtgtctgtctttaccccagtactagtgtattaattattatagttttatatgtcttgaaatcaggttgtattagtactccaacattgttgtttttgttgccctgactattctgggttctttacattttcatatgatttttggatcattttttcaatttctactaaaagaaatcctgcattgattttaaattagattacatttaatatatagattaatttagggataatttacatttaacaatatcttggaactgtgaatattctctctttccatttatataggtcttcttcatctcagcattgtttttgtagttttcagtgtgcagctatttcccattttgtcagatatatctatgtatttcatatttttagtgctattctaaattgtattcttttaaaatttcaacttctgattgttcattgctagtatacagacatatgactgagttttgcacattaatcgtatcctgcaactttgctaaattcagttattatgttaactctagtagcttttctcatattccatcagattttccatatagatgcttgtatattatctttctaaaaagactgtgtgcctttccagtctgaatgtcttatttatttact

SEQ ID NO: 44183 - DNA, 1041 bp, Homo sapiens
ttctttgttagttttctacctccatgatctatggaatgctctcagtggggtattgaagccccccactataattttgtggctgtctatatatgttttgcaggtctctgagaacttgttttatgaatccatgtgccccaatgttgggtggatgtatatttagtatagttaagtctttttgttgaattgagcactttatcaccatataatgcctttctttatcgttttttactgttgttggattaaagtctgttttatctgacctaagaacagtgacctctgctcttttttattttccatttgtgtgatctttctccaaccctttactttgagctgataggtgttactgcatgtgagatcagtctcttgaagatagcagatagatgaatcttgtttgttttacccaatttgcaattctgtgtcttttacctggagcatttagggtatttacattcaaggtttatattgatagctgaggttttgagcttattatgaagttgttagctggttgctttgtagtttctattgtgtggatgatttgtaggatgtgttggccatgtaaagtgtgtgtgtttttgtagtaacaggtatcattctttcatttccatggttagaactcccttaaggatctcttgttgagtatctgttcttatgcttgttagccattttaatatcatctttggagaaaaatctattaaagtcttttgtctattttaaatcacgttatttttggctgttactatatattctagatattaacttattgtccattatatggctagcaaatattttatcccattctgtaggttgcttttactctctgttgtttcctctactgcatagaaatcttcaagtttgatgtagtgtaatttgtttatttttgcttttggtatcatatataagtaattgccaaatccagtgtcatggagcttttccttattttggtctaggagctatagctttaggtcttatgtttaagtctaatcttttaagttaatttttatgtatggtataaggtaagaattcagcttctttcctttgcat

SEQ ID NO: 44184 - DNA, 1070 bp, Homo sapiens
acaattctgaaactgaagtttgattttgggaagcctttttaatatttttaaagcacttgattttatgaaatagaattccagattaacataaacgattttattttgtcaaaatgactcagaaattttaaagaagcaaaaaccttttataaaccttttgaatttaattaatatgttcacacagagaacctcttctgcaagattaattcccacaatttatgtgggaatttatgggttctatttatgtgatggattacatttattgatttacgtatgtggaagccaacttgatcagggtggataagctttttcatgtgctactggttttggtttgccagtattttattgaggattttcacatcgatgttcatcagggatattggcctgaaatttttttttgttgttgtgtctctgccaggttttggtatcaggatgatgctggcctcataaaatgagttagggaggaatccctcttttcctattgtttggaatagtttcggaaggaatggtaccagctcctctttgaacctctcgtagaattcggctgtgaatttgtctggtcctgggctttggttggtaggctattaattactgcctcaatttcagaacttgttattggtctattcagggatttgactttttcctggtttagtcttgggagggtgtatgtgtccaggaatttatccatttcttctaggttttctagtttatttgtgtagaggtgtttatagtattctctgatggtagtttatatttctgtgggatcagtggtgatctcccctttatcattttttattgtgtctaattgattcttctttcttttcttctttattagtctggctagtggtctattttgttaatcttttcaacaaaaccagctcctgtattcattgatttttttttaagggtttttcgtgtctgtatctccttcagttctgctctgatgttagttatttcttgtcttctgctagctgttgaatttgtttgctcttgcttctctagttcttttaattgtgatgttagggtgtcgattttagatctttctctctttctcctatgagaaatttccctct

SEQ ID NO: 44185 - DNA, 1050 bp, Homo sapiens
acacgtgtggagattgcctgtgagctggcaatctgggcattgtaggataatttgtttagccagtttctgggtaagttgaaattgtttagataagtttctccaattttggtggaaaaattgatgtgattgggtggcttggtcaagcagtgatgtcataacctgaaggtctgcttgattattaccataagccaatgggccaggcagagagccatgggctggaatgtgtgtgataaaaataggttgtgtatgttgatctagcaattgctgaagtcgaagaaaaagagcacacagggtgggctcaagaatgtacctaattaaggctgtttcaaggttctgcaataaataaacagagtaagctgagtcactcacgatatttatgggctgagtggaaaaagtttccaaggccagtatcagagccccgatctcagctctctgagtgctagtaaacccagatcgagtgattgagttatgtggtctccaccagactgctgcttttccatgtttatcatccggtttttaactgctccttaactaactcatgggctctttgttaatttcccttcagaggttactgtttacttaaactggatttggagagagtcacattaggggtaagagagagaacagtggccatcatcagaaataggtctatcaaattcttaaattttacttaaattttagcagcaaattataatctgagatgttgcttgtatacaaggaacacacgaaattttgccctgggcttcctgcggagctggagagctgagcaggtgggccccagggtggcagccactttgcacttgcttaggcgctgctgcttttctgctgctggctgggtggaccttcccgtttgcacctcctgcccctccccagcaggccagctctggcgtgcctggcctggcttcctgttgctgcctctgctgtccaggctgagttcccaggagcatttgctggctctgggtttgtgagcttacccgctgcagagcctttcttttaatttaccatctgcttgaccatggggctctggcctctaatgctttatctttttat

SEQ ID NO: 44186 - DNA, 1018 bp, Homo sapiens
tcagaattgatgggaggactggttaaaacacagatagctgagcccaacacccagaatttctgattcagtagatctggtaccaagaagtattccccttgatgataccctcaaattatttcacccttgcctttctactactcctgcacagcaaaatgccatctgtggaccatgcaacatttatccctattttacttctatgcctagtcttttcattgctcttaaaaaacaaaaacaaaacaaacaaaacaaaacagacaactgtaagactgttgtaactaaaatttatgattcttagatgcagctgggcttcaattacttttttattacgtccagttccctcttccatttcacagatggttgtttcagattttctttattcactgtaaacctccagtctcttctctctcattgtcatgagatgatcttgtcacactccttacaaggaaaatcaaggtcacaaggcatgcatgtttttgacttcatgcaaagttcattcttaaggacacaactccatcagatctctaaccttcctatttaaggctaattccacaccatcctttctgccctgcttctttactttgctttttggcttatctgaatcttcaaccttttcctttttattagcagcaaacaaagatactaaaatttctctcacttgaaaggaaaaaggattcttcaatgttaactgtttacttagttatatcttattatgtaactatttcctagtctgtttacttcaaactatttggaagaataagctgctcttactgtctccttttcttgacttctcatatagtccccagtctacactattgtggcttctaacatgacttcttcaatgaatctactgaaagtagattactttcagtaatctactgggtgactgctgggtgacctcccagtttcccaaaggactttttttttcttttctcaaatttttgatattggtaaccatttcaacttcttgacaacctttcttctcttcgtttctttatctcaatctctcctgttttctttt

SEQ ID NO: 44187 - DNA, 1039 bp, Homo sapiens
cttgcatcttgagaattttctgaaaatgtgagaatatttatttactttaaaatactaaatttgacacttttaaatgtgatctcttgacatttccttaaacttgtaataatcatcatttctattcttgccttaccaaatctgtcttatttggagcatttaactccagcataaattacttattaaatagaaaatatttgggaaactgtattttttaaaatacggattttgaatggcaaccctgtttaatagcgttttttgttttttttttttgagaagttatacatattttgataccttgatatttattcagtattgaaatatttgaatgtgtatgtttttgttttaaacagattatctttctcaaggaatagatctttctggaatagaagtgatagaaaatgatctactttttattgcaagagcccgacttgaagtggaaaatcaagctaagcgcctactagagcagggtttggagactcaggtaataaaaataagactgttttttaatgtaaaaaatgtgtcataatacaggtgaacatttgactttgagttcaaaaaagtaatatatgtcttatagtaatatatcactgagaaagtatgtctacaatttaaatcaaagaatgggtcatcgttaagggaaattttaatatatgtttaatatatttaatttaaaaatagacctaatgtttctaatgtataatgtatataacatgaaatgtattttttatgatgtgcatatatagatagataactagctgaccatgcctgctttgtctaaagcacgattcctcatttaagcccttcaacaacccagtaagattggtattattgttaattatattttgcagttgaagaaacagagcttaaataagttgttgaaaatcacatagctagtaaattatttagtttggattcaaattttaatcactctagtcccagaactttgcactcttaatcattatgccataatttaaaaaatttttgacttgacatttctcctaaggtatcattttcctgatgcttaattttctgaattgga

SEQ ID NO: 44188 - DNA, 1028 bp, Homo sapiens
ctctcttttgtatatcaattactcttgaattgccaaaatattttgcagcctggcatattttatcagtttgaattttattttaacccagcaatgttttgtctgacctctctgtgtttactttttcaactttagtttactacagagcagttatttttatagaacattatggtcttttcacttggtcattattgtcatactctttttgattattctttttgtacttaagatttaatgcttatgccaaagcattcaaacacatgagataggatatggtcaaaataagaatggcaaaatgatggtaattgttgaaactcagtaatgggtacaaaggatcattctctcttctttcatgatatttttacaataaaatgttcatgcacacacacacaaacacacacacacacttcctgtttaaaatagcagttctttaggctctgtatttgcagtctgacctttatttaaaagtcattgttgattgggcaggttcgtacctttaatcttagcactttgggaggctgagggcaggcagattgtttgaactcaggagttctagaccagcctaggcaacaaagtgagacattgtctctacaaaaaataaaaaaattagctaggtgtggtggtgcatgcctgtggtcccagctacgttggaggctgaggtgagaggaagttgagcctcagtatcctgaggcttgagcttgggaagttgagaccacagtgagctatgtttgtgccattgcaatccagcctgggtgacagaacgagaccctgtctaaaaaaattaaaaagaaaatcaatgtggcaaataggatttttctagtaaataataaaatctaatagtaagatgatagagtttgatgatgccccaaataaaaaatagattatctttcatatattctctatacttcagtgattttccccatctttttattttaaaaagttttaaattagagaaaagttgaaagaatagtaaaataaacaccccttacccataacctagatttgccagttgtaaaacctttgccatgttt

SEQ ID NO: 44189 - DNA, 1113 bp, Homo sapiens
ctttgttctatcaggcagttaagttacttgtggatcaacttgatcctttcacacttgtttttaagctatattagggcagcttcagaggaacatttattctaaggctagtttagccctactgttaaggcatactccttcatagagccatattgaatgctcctgttatttaatggtatctccctttttagcattccaagctagaatattttgcagtatcctgtgagtttgagagttgatcagttttgcagattttctggtagtggttctttgcctggcctttttgagtctcactgtgtacatttataacttaatatttctttgaagattcaagagtccctatatagaattttctggtactgtttctctgcttagcttaccttttttctgttattctgacctgagaattccagctttctcagcccttccttaactcaaatttgtcccttcaactaattgagttcgttgtgtttactgaggttttccccttacattataggggaaagtatatttagccgaaagctaaagtatatttagctgaaagctatattttagggatcacagtcctgcattgcctgctgtctaatatctgaaaagagtagtttcataaattctgccccattttctagttgctagggtaaatcctataccaattattctgttaggttggaagtagaagttttaaatctgtttttacaacttaattgtcatggcacttcttttagcaattatgaactaccttgaggcatttcttttactggtatcttaaagttatgtcttaaagttattgaaaatctttggtggttgttttactttttactccttgtttcttatgttagaaccgataggttagcaatattctgaatcatgcagatctgattcttgatgtttaaaatatctgctctgggccaggcacagtggctcatgcctgtaatctcagcactttgggaggccgaggcgggcagatcacttgaggtcaggagttcgagaccagcctggccaacatggggaaaccctgtctctactaaaaaataaaaaaaaaaattagccaggtgtggtggtgcgtgtctgtagtcccagctgcttgggaggctgaggcacaagaatcgcttgaac

SEQ ID NO: 44190 - DNA, 1622 bp, Homo sapiens
aggcggttggccttctctctttggaaaattatgaaggtcttgggacttagaattggataatctagatttagttgctatttattacctatataacttttggcaagtcaaacatcctttgggtcaactttgattccttttgttgaagtatatttttgtgctttgtttaactctttgtgagacagtgttttcaagttatattcagattatttcaaaaaaacaaaatctggggtttctgagccataatggtagctcgagcacagacagtgctctttattttctgtatgagtaacttgtctccaaggataaataagatatcacaaactttttttattgtgtacagtgcttagtataattttatttcctttttaaaaaccacaaattggtgattaacaaggtatgccgaaatcttaacaaggtaattccaacttcccctgtttttaacaaatatgcaaatatctcaactactgattgagaatcagattatattattttcatgaaaaaaattaattacagaccgggtgcagtggctctcacctgtaatcccagcactttgggaggctgaggcgggtggatcacttgaggtcaggagttcgagaccagtctggccaacatggtgaaaccctgtctctacaaaaaatacaaaaattaggcatggtggcacaagcctctagtccagctcctcgcgaggttgaggaatgagaatcgcttgaacctgggtggcagagattgcagtgagctgcgattgcaccgctacccctccagcctgggcaacaaggtgagactaggtctcaaaaaaaaaataataataatttcagattatcaatttatgaagatccttgtttccgtagtaacactcacacttgtgcatttaatatattttgtgcaattaatataacctttatatactaacctaggagagcagtttgacttcctaataataactaagcactagatatgattctaaccccaaaatacagctcaattaaaatccttttttaaaagtcgtgcttttctttttagttataaatattttaattgcatatctgttttaattcctcctatgggaagtctctaactaattttatgtatttgttttcttaaattttgacaaccgtgactatgacagagtaatttattgtatatttacattgtactattcatatcaaatcattcttacccagcttgtggctagttctgatgccacagttttgaagattctctgagtttgtaaataaaaactcagctttgtgaaatattggaattcaccataactgaaagtactttgaaacaattttaaggtatctatgtacaaacaatttttaattgctgaaaatcagttttaagctgtattgcgacaagggtcctttttcagtggatacttagcgtagtaaaccttgaactctctctgatactggagcccatagaaaaaaggtttattttgctttaatgccaattcagagattttatttggcttctcaactttacatttctttcacaacaaatactttatcagaaaaatagaaatggaccatctgctgaacttccatcaagtggggagtagcagaagtcgtagagaatcaacaacattggtgattcattttctatatgagaataactgaata

SEQ ID NO: 44191 - DNA, 1047 bp, Homo sapiens
catactgaaggcttcttgtctccagagacaacatttagattcagtctttctaaaaaggaacggcactgcttttcagaggaaagcctgttcgggcagcttttgcagaatgacagcctaccttgtcgcttctctccactgcagagagatgcagtgtattcactaattttgattggtcagttgtattgggcttaaactgtgcttcatatgtatagcagggatttcccccgctccccactgttttatataaaggacacttttaaaaaggctaaatttatgagtggttgtatgttgttcttaaatagaatatgtgtaaattagtattttaaaaatgtgtattctattctggtttgttggtcacttatgccaaacattaaaaaaaaatgcagggaggtgggggaacaggaaagaattacatagtaaaaagtatatatgctttctaaagccttgataattgcatttgagaatattttagtcatatataggtttttgattgagattctttgttctacaaatagaaacccactgcatctttactgtgagccacagtgaattttaaatagtttgtttgtattcaagtcatcttctctgggtattccaaattgttgtgagcatctcaaggtgttaaacattgtcatgacttcagtattcattcatttgggtattcattcatttcattcattcattcattcaaaataataatcagattgacctaaggtgataataccctaaaatattttttaaacatttcattatagtagcttagtctcgggtataaaacttcaatcagtaatcattgtattacttttggagattactacttggtcttcacctttcataacccttttatttggtagatgtatactgatcatttgctataatattttatttcaattggcttattctatttttgacctgggcacatttcttagtagattgctgtttcttaaatatgatatgtagctacacgctaatattgttagtaaaatattattttaaaggataaagtaagttacatgtctttataagttataaagccaaatcattata

SEQ ID NO: 44192 - DNA, 1035 bp, Homo sapiens
gggaataatattgcagaaacacaaatggtaacattatttcttttgaattagtatgaagtattactagaggtatatttattcgagtaagttaaggtcttagctaacattgaaatcctataaaaatggaaaattttaagtgtgccaaattttctgaactgacagattaaacatcaggtctttgtcacatcagttagatttataattaaataaagcagaaatgtcaagttaaatgatgattaagaaaaatacattttctctagagcaagattctgttctttcgtaaatgttaaacagtgtggtggggtgcatgcatcttctgacctacctgtttgctgttgccttatgggccttttggttcactatgacagtttttggcaaattgatacatgatatcattgacagattttgacatgaatttttacctgacaacagtgaagtagctgtgttttatttcatgtcttgtaggaattctttcgttttctctccaatacttcaactgcatgcattatgagatttagttggctgatggatttctaaagaacagtacataatatttgtatttgttttgctttaaaaagtcacggccaagaggaatttcctcagatgataggaattatgtttccctttgatggagtacatgataatatttctttattttccagaatatgtgaaaacaaaaaaggaaacataacgtttgtagcttctaaaatatatttagacatccttttgttaccattgtaaatctgtttttaatagcagtgctcactattttgaaatgatttcttgatcacataacttgctttatattataaatccaggccatgtccttttgataaaaaccatctgctgtttaattttgtttgttttcattagaagaggatacataattggtcataaaagtcagatagaaaaatccattagtcataccaattgatatgaatatctgaatatttagtgcagaaaacacttcctaaatcttccttttgtgtgctgataaagtattttcttttctttttggaaattcatgtttcatta

SEQ ID NO: 44193 - DNA, 1006 bp, Homo sapiens
acattcaagaatctatccctggattaaaccagagttgcagagggttttatacctagacaaccattcccatctaattctttttacttaatttcactttagtttgatgttattattgtacattgaggaaaactataatcattagctatgtgagacttcttgttgccttttctataaggttgttgtggccagtgttatacattgagggatataagaaacaaccatgtgagacttaaggtatcattaagtgtatatagttgtggaatatatagttgtggaaaacattgagaagacccatagagacatggtaaggcccatgagagtcactgctctctggtcttagtaccaatagtttgtacttctactgagcatctagggagtttttaatcttaccaatgctgagacatgtaatcagctccttttccctgtttaaatgacctagtagaaagtatgtagaattcaaagaaagagcctaaaataaaaattaaaaagaaatcataaggagcaatttgtggctcacctcttgtaagaatacaggacttaatgatacaagtattgtttcattcttttcatgctgtttgctctgattttattattttttcatttagttcagttgtgtctaaaattcttaaagtcatcttgctggtagcgttggtgcacgcctgtcaccccagccactcgagaggctgagcagggaggattgcttgaacccaggagtacaaggccagcctgggcaacctagtgagaccttgtctcaaaaaagaaaaataaaatgctaaagttattttatattatctttaggataagggaggatatatataaataaaattatatctaacatttaccagttttgcttccctgctttcttcctaacactgatgatgatttttattttagttttggattacatactctttggaggatcttactgaatttgtgaatctttgttctaggaaaaaaaaaaatgtataaccatacccgtgacattttgcatctgatttagggtact

SEQ ID NO: 44194 - DNA, 1025 bp, Homo sapiens
gacccaaaatgtaacagaggaaggaatttttatgaaggcctgccatgtgctatattttaaaatttttttaaataaatgggcttggaataatcagctcaattttgtatatttttaaaatgaaatactactgtcataatgctttcaatggtttaataaaacaatgtttcttataaatatttttaatttgtaaagttacattaacaatatatgttcattgtgaaaactagaaaattgaggcatatgttgattgctgaaaattaaaaactacagatataaccttgagattcattatcagcattttcagaaactaacctctcaactgtttgcttatgcattactgtgtttattatacatactattttgtacctaagattacattatggacataatgccatgttaataaacataaatctatgtcataattttagtggctggataatatttaaaaactatccaatactttatgtaataatctattgttaattattttagtcatactttttttttttactggtatagacactgttttgatcatccttaaacatacatctttgcacagttgttcaatttttttccttatgatacattttagaagttgaatttcttggtcaaaggtcatgtttgaggtttttgcttaatatttcaaaataaaatatattttgtgtagtaatgtgaaaaatactcataggtttatcaaaattattagtcataagcatttaaaaattatttgctagccaggcacggtgcctcacaccttaatcctgatacgtcgggagtcccaggtgagaggattgcttgaggccaggagttggagatcagcctgggcaacatagtgagacccccatctcttaaaaaaaattaaaaattgtttgccaagcacatatgaacattggtatattagttttaaaatttattctaatttggatttgtttttgctgtatgtggttgaacagttttgtgtttgtcattctttttcattgatgagttacctgtttgtattctttgcctattttccttttgccatg

SEQ ID NO: 44195 - DNA, 1045 bp, Homo sapiens
ccctgtacctgtgtagttagctatcgccaaggattctggcaaagttggtactaaaattatggcccttacctctttttcctttgtgtgtttcttccctatcctttcagttgccgtgccagccatgagctcagtcctctgacaccgcaagttagtaaggccccagctttctgccattatagctgtgcactgtttagggaatgctatcagtctgaaaaagcagcagactcactcattttacagatcttgtaagggtagattcctctctgactttcgattgcttttttctccaaatccccattggatctctgccacgcatatgtatgttaatgataaggcggggatttggtcttgctcctgtggctctcaggattccacccactgacccctcgtccccagctttatgtgaaataactactctgcctgccctgattcctgttctcagccatctccagaatgtaagtctgtatctatgggacttggaatgggagttgtggtagtgagtgccattagacaaaaatgaccagacttggaattcttactcattgcaatttctataattaaaagtaaatctttctttggttatttctgtcgccttcaaatgcagttattcatcgtttaatgatggggatatgttctgagaaatgtgtctttaggtgattcatctttgtgtaaacatcatagagtgtatttacacaaacctagatgatgtagcctactacacacctaggctatatggtatatcctattgatgttgctgtattgaatattgtaggcagttgtaacacagtggtacttgtctacttaaatatatctaaacatagagcaggtgacatattatgctaaggtcactgtggctgtgacatcgtaggcaataggaaattctcagctccattataatcttatgggaccactgttactaattaaaacatcattatgtggcacatgactatggtgtgtttttagaagtgctttatataggtttagagcttatctgctggaaactatgcctgaccagttcactctgccattagtggaagctagatga

SEQ ID NO: 44196 - DNA, 1044 bp, Homo sapiens
cctgggaggcagaggttgtagtgagccaagattgtgccactgcactccagcctggacaacagagcgagactccatctcaaaaaaaaaaaaaaatttactcctcttccctttgttttttaaacttttctggataggttaataggaataccttacgttagtgtggtgattttcttttttaaattttagaatggtaagtacgcttaatatgagatctaccctcttaacagatttttaaatgtataatatggtattgttatctataggcatggtattgaacagcagatctctagaacttacttatcttgctttactaaaattttatgcccattgattaacaactcctcatttcttcctctcccccagcccctggcagccacaattccattattcgcttccatgcatttgtctattttagataccttatgtcagtggaatcatgcagtatttgtctttctgtgactggcttattttactaagcataatatccataagattcatccacattgttgcatatttcaggatttctttcttgtttaagtcggaataatattctgttctatgtatatatatcacatttaaaaaattcagtcatcagctggtggacatttaggttatttctgtattttggctgttgtaaatagtgctgctgtgaacatgagagtgcagatacctcctcaagatcctatttcagttattttggataaaaacccagaagtgggactgctggatcgtatagtaattctatttttaatttctttgaggaatcaccatactattttctataggggttgtacaattttgcattcccactaacagtgtaaaacgattccaatttctccgcaacctcaccagcacgtgtctgttttttgttgtttttgcttgtttgttttttttaataataaccattctaacggatgtgaggtggtatctcactgtggtttcgatttgcattactctgatgactggtcagatattaatgatctttttatatacttgttggctatttgtatgtattctttggagaaatgtctattcaagtcctta

SEQ ID NO: 44197 - DNA, 1094 bp, Homo sapiens
catttggaggagaagacgcattctggttattggaattttcagcattttttcactggtttttcctcatctttgtggatttatctacctttgatctttgaggctgatgacctttgggtggggtttttgtgtgggggtctttttgttgttgttgttgttgctttctgtttgttagtttttcttccaacggacccctcttctgcaggtctgctgcagtttgctgggggtccactgcagaccctgttcacctgggtatcaccagtggaggctgcagaacagaaaagattgctgcctgctccttcctctggaagcttcgtcccagagggtcactggcctgatgccagctggagctctcctgtatgaggtgtctgtcaactcctgttgggaggtctctcccagaaacatagaagatttctgtgactttgaattagacagtgattcttagatattacccaaagcacaattcacaagagaataaagttgataaattagatttcatcaaaatttaagaagctcttcaaatgatactgttacgagaataaaaagacaaactgtggacaaggagaaaatatttgcaaagtatatttgatagaggacttgcatccagacatatcaaaagactcaaaacttaataggaactccaacaacccacttaaaaaataggcaaaagagttgaacagacacttcacccaagatgatgacagatacgcatctgtaaacatgctcaacatcgttaggcattagggaaatgaaaatgaaaagtatactattatcttattgtcagagaataagcagaattattttagtgcagacatatttattgtactttttaatgcaggttattatgtaatagtttaaaaaataaaactacaaagtgtagattgaatgattaagttatatcacatagattcatgatttttctttaagaagagtcttgggactagatgaaaatttagataggcattactacaaagtggtgatgttatttaagcatgagtaaggtaatgtacttaactacattcatggctgccaagagacagtatttacctgggtaaatttgtcataatccaggatctgttctctttcttactctttct

SEQ ID NO: 44198 - DNA, 1030 bp, Homo sapiens
gaaaactacaaaatattgttgagaacaaagaagacctaaatcaatcaatcagtcaatgttgttcatcagttggaagacttaatattgtttattaagatgtatgttcttcccaacttgatctatgaattcaacagaatttcagtttaaattccaggggggcttttagaaattgacaagctgattttaaaattcatatagaaattcagaggatctcgaatagctagaataacttttaagagaaaacagagttggaggaataaccctacctgatttgaagacttattacaaagactccttgaagtaatcaagacataaagatcaatggaacagagatctcagaaatagacccacatatatatgaacaactgatttttgacacatttagtagagaaaaaaatagtcttttcaacagatggtgcaggaacaattggatctcaatatgcaaaacagtgaacttgtatccatacttcatttcatataaaaatattaactcagaatgaattcgtgtcctaaatgtaaaatctaaaactacagaacttaaagtaggagactcagaagatttttttatttttatttttatttttttcttttcttcttttcttaaatttttaattttactttaagttccgggatacatgtgcagaacatgcaggtttgttacatagttatacatgcgccatggtggtttgctgcatctatcaacctgtcatctaggttttgttgttgttgttgttttttgagacggagtttcactctcgttgcacaggctggagtgcaatggcgcaatctccgctcaccgcaacctccgcctcctgggttcaagcgactctcttgcctcagcctcctgagtagccgggattacaggcattcaccaccacgcctggctaattttgtatttttagtagagacagggcttctccatgttggtcaggctgatcttgaactcctgacttcaggtgacctgcccgcctcggcctcccaaagtgctgggattacaggcgtgagccactgcgcctggcctaggttttaa

SEQ ID NO: 44199 - DNA, 1058 bp, Homo sapiens
tcttttctctaggaaatattctagagaaatgctgtttttaacatgacaaatcccatgctgatactatgcctagaagattttaaaaatttatttctttgttcattcttttctcagacatttattgcaggaccttgacagtcaagagtttaatgttcatggttttgactattaaccagctgcaaagtccatgatgcagcagttcataatttttcaggcaaaattttgaatagctagtgagtgcacatagaactgcccaacacttttaatgtggcttggtggttttcttcttttcactgggtacccacttatttttctgaagtggatatatgtagtggcatttgtactttgtaggctcagaagtctttaattatatccatttcagatatcaagagtctgcttactcttgctattgtgctttgaaagcagttatgccaaaatagtatcagagaaatgtacattacatgttctttctgaattttcctgtctttgattttttgattatatagtcatgctatgctgtaatgcttattccatattttttgttaatcaaggaaatccttcacaaataatgcttcaacagcattgcaattgtatactgctgaaatataggttttgcttaggaaaatcattgggaatatctctaacttgtgatttagtaggcttggaaaatgtcatataaaaagttgaacttttaagctgggtgtggtggctggtacctggaggcccagttacttgggaggtggaggcaggcagaattgcttgaggccaggagtttgagaccagcctgggtgaacagaacagatctcctcttggctctaaaaagtaaaaattgagaagtaaaggaaattaaaacaaaataaaagttgagcatcatagcatgtgcctgcagtctcaactacttgggaaactgagatgggaggatcactcgagcccacaagttagaggctgcagtgagctgttattgcaccactgttctccaccctgggtgacagagcaagatcttgactctttaaaaaaaaaaaaaagttaactttaaacaatgaataatgcttgtgtgt

SEQ ID NO: 44200 - DNA, 1018 bp, Homo sapiens
agtgtggttttccatgcttgtgttatatttaatagtaaaagtctaagataaaaaaacagggagggaaaggaaattgattggaggggaggcagctatattgggaaatggtgagaactgatgccttatagatcaacttataatagcttagacttattaactaaggattttattaaatggtattcccagaagattcaacataatctgtaagtagagagccattaaagtttactaaaaagggggttggagtgctgaaaactgtgtttttttttttttttttttttttttgagatggagtttcgctcttgttgcccaggctggagtgcaatatcacaatctcggctcatcgcaacctccgcctcccgggttcaagcgattcttctgcctcagcctcccaagtagttgggattacaggcatatgccaccacacccagctaattttgtatttttagtagaaatggggtttctccatgttggtcaggctggtctcgaactctcgacctaaggtgatccgcccgccttggcctcccaaagtgatgggattacaggcataagccactgcgtccggcccaaaaactgcatttttaagaagataaatctggctgggtggatttcaatgagagacttgaaagctagccgagaaaccactatgtaaaggtaatggtgataaagatgtggattagggtgatgcttgtaggaatagaggtaaaataacaacttttgttttatgcagtaggatagttggtaagacttggtgacagattaagtatggttgctaaaaataaaaacagtagaaataaagattgcatgttttgagagcataccctttgttgggtaggattagggaattctggatgacagtcttagagtaagagcttaatttcttcttacgatgtatttaaaatctcagaggaatgagattttacgttccaaattgtttatctaaaaatgtcagttctaacagggaaggtgctgataatgtttccagtgcaagatatccaagttactggtgtcgaatccg

SEQ ID NO: 44201 - DNA, 1046 bp, Homo sapiens
cccccactttttttttttttgctttccatttgcttggtaaatattcacccatccctttattttcagcctatatgtgtctttacacatgagatggatctcctgaattcatcacatgaatgggtcttaactctatccaatttgccagtctgtgccttttaattggagcatttaacccatttaaatttaggattaatattgttatgtgtgaattttatcctgtcattatgatgctagcttgttattttgctcattagttgatgcagattcttcatagtgttgatggtctttaacttttggtttgtttttgcagtggctggtaccagtttttccttttgatatttagtgcttccttcaggagctcttgtaaggcaagcctggtggtgataaaatctctcagcatctgcttgtctgtaaaggattttatttctactttgcttatgatgcttagtttggctggatatgaaattctgggttgaaaattcttttctttaagaatgttaagtattggctgctactctcttctggcttgtagggtttctacagagagatctgctgttagtctgatgggcttccctttgtgggtaacctgacctttctcttgggctgctcttaacattttttctttcatttcaaccttggtgaatctgatgattatctgtcttggggttgttcttcttgaggagtatcttagtggtcttctctgtatttcctgaatttgaatgttggcctgtcttgctaggttagggaagttctcctggataatatcttgaagtgtgttttccaacttggttccattctccccatcgctttcgggtacagcaatcaaatgtaggtttggtcttttcacatagtcctgtatttcttggaggctttgtttgttctttttcattcttttttctctgatcttttcttcatgctttatttcattaagttgatcgtcagtctctgatatcctttcttccacttgatctattcggctattgatacttgtgtatgcttcacgaagttctcctgctgtttttcagctcaatcaggtcatttatgtt

SEQ ID NO: 44202 - DNA, 1216 bp, Homo sapiens
caaatcctaatttagtcaagatccaaagagcctccacttcttcaatatgggcttctctaatgtctaatctacttttgaaaaatctgcgcttctctatgtaatttgcaatacaattatgctacaacttttctatagaaaagtaataatcaggagaatgaggacttagccctaaggatttgctgcaactccagaattttttgaaatgttctttaaaatcatgtcaattttgcattcaattccactgtttgaagataaaattttaaattacttaccagtgaatatccttggtggcccttaatccagaatgcatgccatgattacactattgctcttaaatgtaattactgacactaacattaccacttctttctgtctaaatgtggaactatagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaaggtgggtcttttcacacaggcttattttttaaattactttaaggcatccatagtttatttaaaagtgaaaaatatattcactttgtcttgagatcatcatagtataaattgctcagactttatatatatatatctccccacagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaacaaggtaaaacaactacattttaaaaactgacttaatgctcttcaaaataaaacatcacctatttaatgtttttaatcacattttgtatggagttaaataaagtacagtgcttttgtatatattttggtgtacttgttactttcactgattgttgatgaatcccttttttcactgtaaacgtggatttataaacaagtttactgcgtccatgaagaccctaatttatgttgtctataaacaagctattatatttatttgacaggtaaacatcctccaaaactccacacccttgactcccctcctcccaatcacctcccagtgggattcccaggttgaggttaaggaggacaaatat

SEQ ID NO: 44203 - DNA, 1033 bp, Homo sapiens
tgagaatacctgcactgggaagcaaggctgctagggccaatatttgatcagtaaatatttgctgaagagtatgaggagtgtggctcattggaaagcaaagagtcggcaccagaaagagaagccgttttcagaggatgggttatggaggctgcagaaagccaggcagaggcatcatggcttgatatcataagaaacaattgtgggttttcgtgaaacaatgaaagcagcactgtaggaagatcggttggcccgtggtagacaggatggactaggcagaagaggaagaagaatttgagaggtcagtttaggagattgttagagtaacaggtatggggtgatgccatcctggactgacgcagtggcagtggcagtgacaatgagaggaagctgctaagttgagaaacattttgaagtaaaagctgagtattgggataaaggaaagagaaggtgatgtctcacctataccatgagaagaattttaaatctactggcagaaacagcagagctgaggataagaagtcagtgtgggtggtgatgatctgtttgggacaagatgaattagagatgacagctggccagtccatggaaatgtcccattgatggctggaaatagagaagcagagcccagccacctgctgggtgctgagagctgtagggtgagggccatctgcataggaaagccacaagaatgagttcactgaaggagccagtgttgaatcagagccatgcctatctgtgatgacaattcaagcctgtggacacagacttgtgattggcagggccgctgttaagggaattcctttcacatgatcagctctcatggagccattccttgtttagaattgtgctgcagatagaggcagcaccgggagcctgctggcgcctttgtcctcaccttcatttgctcgttctctaatggttgcatgtgaaggtctagttgttttcttctttggtggttcatgttttggatatttgttgtctcagtaaacatctggggaggaaagaattttcttttgtccatatgatgtaatgt

SEQ ID NO: 44204 - DNA, 1206 bp, Homo sapiens
aaagctccaccagaagctatcagaacacacatttggcaagatgttaaatctgtgggagtttaaccaccttcgagtcaaagagaatgttggtctctgttcctggctcagagtcagaacatctggaacagatagtgtaagtgactgctgagagaatagacagatgtttccctgtggccttgagtcttcccagagagaacactctgaattcattgagcaagcttcatgtactcaaaaatggactttctttcccaattatttcccaacaccatagtagtctgctgggaaggaatgaggtattcagcagcaagaacatgttgtgtttgtcctctttatttgggtttgttctgttcgaggtcgtgccatagacccagtacagcatgtagcctctgaaatccggtgtgaatatctgttcttagaaaacctccagagaggaggaagctaggataattccataaaagcagggaagaaagacagaatgctgtctgcttgtggaatcacttttctgacttttcctttgtgactcccagaacacatgttgaatcctttagtaaatgactcctcagttcaaagctgtcatcactcctaaagtccttcttgatgagataaaagtggcatatgcaattccccaaattatgtcataaactcaggaatgtcctatgattcttaaccctaagtaagttttgttcctacactcccttcctctttttctctattccatacacacttcctgtctgtctccacccacgcacaggccctagcctgccctctaatctcttgtgcaaaaatttataaaaaccagaatgtattcaccaagagagtttgggaagcaaaattgtctagtaaagatttttaaagcaggtaatcatctgatctttctagcatgattgatgggatgccctatctttgagaatcattggtggaggggaaaaaaagaacatttaaagatgccttgtagtctggtgactctagagtgttttatggtgagccttttcaaagttgttgtccctcaagaggaatttccccaggagccccttaggcagggtcaactgaagcactgattctactgggagatgtgcacagatgccgcttgggaaatgtttactggatgattggtttgttgcaatcactcatcaaaaccttttacctgatatttctttttacgtagtaaaagaaatacgttgtaggtactgaataaatgctgattga

SEQ ID NO: 44205 - DNA, 1051 bp, Homo sapiens
agattagtatgaaaaagggttttaaactttcaattgattatggagaaacgtggctattcatacatctcttcctttgttctctcctgtttttataactttcaaggttcacggacactgcatgtgcaggcataacaccaagggcttaaactgtgaactctgcatggatttctaccatgatttaccttggagacctgctgaaggccgaaacagcaacgcctgtaaaagtaagtctgtgttgaagggacattttaaatccattcaggctctagtatccatttcctaattagaggtactgtaacagtgtactgttttgcagagggtagaaaagttactgtcttttttccagcttcaccctgatactcctagacaaccaacaatctgcattcagttaattaatattcactgaacagcctctgtgtgtttgacactgagctgagtagtttggcagctacagtagaaaactaaggtgctgtccttgacattgtatctgttttgttttttggtttttttttgtcgcctaggctgtagtgcagtggcacaggcggctcactgcaacctctgcctcccaggttcaagcgattctcctggagtagctgagattacaggcacgcgccaccatgccctgctaattttttttgtaattttagtagaggagaggtttcatcgtgttagtcaggctggtcttgaactcctgacctcaagtgatctacccaccttggcctcccaaagtgctgggagtttacagatgtgagccaccgcgccagggctgtttttaaggcaagatgaccgtgagagaaaaatgaaagaactatatggcagggtagctgatgaaggtctaagagatatggagtagcatttttggccttgtttctgtgccagtccagctgcggcctctggcatacctccctccatccatctcaggggttttctccgggtggagatgtagccggcaacaccactgcccctccccactccacaaacagtgattctgatgcatgtcctccccttgaagagcagctccgcctctgcccccactgagaaggactattat

SEQ ID NO: 44206 - DNA, 1033 bp, Homo sapiens
gatttagactagcaaaagctcatttagcatgtacacagtatgtttttctatattactagatgtttcaaaactcataactcttggccaggcatagtggctcatgcctgtaatcccaacacttgggggtgctgaggtggggggatcgcttgagcttcaggagttcaagaccagcctggacagcatagcaagaccctgtctctacaaaaaattaaaaaattagccaggcatggtggcacacgcctgtagtcccagctactcaggaggctgaggttggaggattgcttgagcccgggaggtcaaggctgcagtgaactatgattgtactagtgcactccagcctgggcaacagagcaagactctatctcaaaaaacaaaacaaacaaacaaaaaaaaacacaaaaaactcataggtcttttgtttattataaatttggaggcaactgtgcagcaatggcaggcctgggaaggttgatgactaagcagagagtatggaaaggattctattcgttaggtaaaatgtgttgttctggtttccagcagcttcttaactccacgggaaattggatgactcgtcaatggtcctttgggacttaaaagtttccaaaagagagggagaaggaagcacagccagaaatggctttcacagagccattggcacagagaagtccgattagaccttcccctctcttcctctccccaagcctcccagccaggctctcacggggagtttgccatggtacgtggcacacatggttcagttagtccttagggatttttctctcttactttaaaattcttaggctgatattctcttgagttgaatacggtatcattttcttatattcctgggtaggtgaaaaataaacctaagcagctagtgagtgaataagtcaaagaatctgtcaaaatgtaattgtccatgttcttatccttgacatcttttatcagagaaaaagctcagcaggattattaaggagggctaaaggaagcctaagcatgtttctagttttcaccattaaccctcacccaaatt

SEQ ID NO: 44207 - DNA, 1132 bp, Homo sapiens
tctaaaagagggcccaaattttagatttcaggggtcatatttatacaaagtcaaaagtaattttaaaagaagacacaaagtgtaaaatattcagaatcagaatacttttccttcatttttaaaaaggaggctggccgggagcaaaatggctccatgcctgtaatcccagcacttagggaggctgaggtgggaggatcactggagcccaagtgttcaagaccagcctggacaacatagactcagtctctacaaaaaatttttaaaacttagctgggcgtggtggtccacacctgtggtcccagctgtctgggaggctgaggtgggaggatcacttgagcccagtaggtcgaggctgcagtaagcgataatcagtccactgcattccagcttgatcaacaaagggagaccctgtctcaaaaaatttttttaaataaaggctgatatttctggcctctaacaaaagcagaaagtatcagtttcacattcggggcaagttccaagctaattgctcagaacatggtcagcccacccacctgtacaattgcccttcagaaggaggacagagtattgtgtgtggtttgcacagcagatcccttaaaatggagtcacttttacaaagcagaaagcccattctggagacctgatcaattagaccaaaggaatgtggtaaagtggattccgttcatttgcttccaggtttatacagagatgtctagactgcttcctcctgattagaagggaggctgtaattaaacttttttaaactttttttttttttgagttctggtgattgttctccagtactagtttccttgactacaagttattgaaggcagttgatgttacttttctaatattagcatttaaattttacctacaatattatgctaacacttacttgagaggccaggacatcctgtaaatgaatcaccagattctgaaatcagctttgaccaaaatgagaatcacactgtttgtattaaaagcaactggaaagactatcctctcagtgatgatttctatagttcgttactagagaagtttctctaaacatgtagagagcatcagaaaccacaaaaaagaggtgcagcggtctctcctgagtgtgaagctggctcttggtattgcttct

SEQ ID NO: 44208 - DNA, 1029 bp, Homo sapiens
ccgccatgcccggcctctttttattttttaaattatgtttcccctttcttctcacaccccttctaatattggtccatatgttctctgataaaagaaaaaataattaaagagctcagggaagcgggggagcggaaatagaaaaacacctcagcagttttctaaggccaaatgagcagacccttagctataggatcacagaaatttagagctgctccgggcctccgtagagctacagattcctcagaaaccctgggtaaataatttccatttggtcacagcctcctgctccatatttttgcccatataaggaactgtggattatttgcatgtttagaaaacattggtctgaatctttctgtaataaaacgctcttcttaagtttgatggcaaaattaaatgtcatgataatgaattatatagtcaaaccaatttcccatcatacctttcagcattccacatgtttctctgactctctgactaaaatgatgtcctccaagaacaggctgaacattattttggtgtgtgggggtgtataccagctttaaatttttttttttttttttttttttttttttttttgagagagacagagtcttgttttgtcatcaaggctggcttacagtggcacaatcatagctcactgcagccttaaactcctggactcaagcaattttctcacctcagcattcaagtagctagaactacaagcatgtgccaccacagccatctaattttttttttttttttttttgagagacggagtctcactgtgtttcctaggctggtcttcaactcctgatcccaagcaacccttccgcctcaccttcccaaagtgctgggattctagacataagccactgtgcccagcccataacagctttattgaatataatttacataccatacaattcaccctgtaaacaattcaataatttttagtatattggaagttgtgtaatcatcaccacaatcattttcatccccccacaaaagaaacccctcttctgcatatatacccaaaataattga

SEQ ID NO: 44209 - DNA, 1034 bp, Homo sapiens
gaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaagg

SEQ ID NO: 44210 - DNA, 1041 bp, Homo sapiens
gcatattttctggagtcagacacaggttgctccaactcttgggcaagttcttaaccttctctgggcatggatttatttctgatgcctacctcagagaattgttgtaaagattaaatgagatgtgccttcagcacagtgcctagcctatggtaagggtccaaaactgttagccatcagtgctattaccattgtcctcatcttcatcatcatgactatggtatgtgtatggaaaggggaaactgcctaaactgatgctttacttgtgtgtggctatgatacagctcaaaacttctctaataaggcacgagggcctattgggaaaaggctaccagcctttgacttgtatttcaaataaggtatttttgcttctcattttatttcttctacatatgtccatattttttttaaccttcctcttcacacttgatttttagcatttcctttttctccctaaactttgtatggagaaaaagaggcaatgagatgctatttttgcaacattagctgaacctgggatatgcgtagtcatgtttatttctgcatccagagatcacacacacctaactcaactgtgtaaaatatattcggaagaaattcagtcaaattaaaagcatgatataagcatgcttatagagtcaaaagaagaaaatgttttatcttgattatggtcaaaagagagaaaataaaggtcttttaaaaaagaatttatactagttaattaagcaaatctgcatgggcatgtctgaatagccattgatgctgcactttttcccataagattgatactttaaaataatacccgaaatgctcattattctgtggttttcttagaaattttgcatattatgactgatggaataaggggtttcacatttattaaacagaatagatgcaaactgaaaggatatgtatacacctaagtgagtactttcttttcaaactggtcatgtaggcaaataatgagttcactgactgagagatattccggtcttttgaatggatccttagcaataacgaatattgattctttgagggtggatt

SEQ ID NO: 44211 - DNA, 1067 bp, Homo sapiens
tggggcagctttcactttcagcagtttatgaaaagccagtacccccctcctaagtgcagtgtgcttacatagaacaaatgaggtggccaataaatgtttgtgacaaaatgttgaacagagtccaactttctgtttaagcctttatcatgcaagtaaatgtttttagaaatgacgatccctttagaaaaaccggtacttgggaaaggttgaatcgattaattggatacgttggaaggcatttaagtttactaaaagattcatcttgtgaatcataaaaaaacaattcttcccatagttcacttaagctaattaatgtgtatcagttcttttgagaaacatctttagagaaactcaacagtttcataaggcaaggtgcagataaagaaccttcctttgtattaaagaggagaattaatacaatgggaatatatacaattaataagcaagctagatacccagtctatttttctttgaggatattttcctgtaggtcattttaattgatttgtttgacatgactacatttataataatctaaaatggtaaacctaagcatcctacatcttgtctttagcttataaagaattttcctttcttgaagcattaagtgacttctggtcccttaaaatattcaaatgtgttgtttttgcaaaatttccataggcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccaggtgaggctcacaccacacctgttctggctcccgctcagaggtggaggccgccaggtgctccagctggagatgggggctggtggagctgtgttatgggtagggcatgaatgtctttctatggggccctgttgggttgggagttttggtttttgtctttggttctttatatcaaatgaattacggaatttagcaaatcatctagccacattattaccaaaaaccatcagaaaaatagacttaaatatgatttt

SEQ ID NO: 44212 - DNA, 1045 bp, Homo sapiens
cagagaagaaaaatggatgcttatgcagatgattttcctagtgaaggtaacagattcacactcactttgtttcatccgtttcacttctcctctctgacatacatgcctttttttcttccctggttattttcctattgatactttcaaaagtacaatccttctagccttgcaactttcacattcatcatggtcatgttgaccttgaacatggcattttatgtctgacttcaaaatataatgtgtttttattctcattgtgataatttctgtaatgaaggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaaggtaaggcagaggtaatgtgtttaatttttaaatgactttgaacaaattctccagctttgccaaatggataacgatgactctacatttcagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggtatttgaagacgatttctttactttctcttcattctttctttaagctattcttgaactaaaggtctactatgtagtcaattatggtgatgtttttagtttctgaagtctgctgtctccaaaatagagagataagcattttctccctactgtaaaatatatgcacccaagaaggtatcaggtgattgaaataggaccctgagaatgtttgtctatctttgcgtgctggtctcttgtgtaattcaggatgggaaaaaaccctcaggcctggacagcatccattgttttataccttgaacagcgaagtctcaacagatgttttcattacctttctacaaataagcagaaatatgacctctttaat

SEQ ID NO: 44213 - DNA, 1048 bp, Homo sapiens
gagaaaaggtgctgttatttagttttgattttgatcatcgtgctgagacagagacctaaatccctcttagtgtacttctaaagcaatataagctcaaagcctaaagtgtatcgttcacagaaaggaattcatctccaatctcacagaagttccaaattgctgggcatgcccgggactaaatcctcacatactgtgttacccagccagttctattccacttcagtaaggatcaagcctgttcctaacgttttaatacttgagagatttagctgaaaacattgtcttcaagaggaatttacacaatttatttatacttcagcttcaagaatatccacagcagaaaattaaatattttcacatttggttattagccccgtagtgtttatgtatttgttgatttatttatgtcaagaagaggctcctaaaaggaacaggtttgaacaagctggagtgtttctatattttttactagcttttgctatttcctcttgatcgttaactttttttctcctaaataaccacaatctcttgaacacggcaatgttttcctgaatttgtaatgcaattttcacctaaacttgtaagagttttttttctgcatctctcaaaataatacttggtgttcaacatggcacatgtatacatatgtaacaaacctgcacattgtgcacatgtaccctaaaacttaaagtataattaaaaaaaagatacaaggggcaagtgaatggaaaggtctttaaaaaaataaaaataaaaataaataatacttagtgttacagaatcaatcgacttaagactaaatgaatattgagcacatacccttgctaatatataactcaattctgagaaggaaaatgttctggtttctgcctaaattctagtcttattcttactgcatgtacttagagcagtctttatttatgtcctactgactttacaagcttaatatacatcttttaagcaaataggaataaatactttctatttttacatccaaacagttgcccctgatgaccccagcagaaaaatagatggcgataccattatt

SEQ ID NO: 44214 - DNA, 1103 bp, Homo sapiens
atggtcatagatatgtttatgagtttttctctgtacatgtttaatcccagctgatgaaaaattataattcagtatcattaatataatagtaattcttttgattaacatagtagcttcatgtaaaaatttccaagagttccttattagtcacaacgttgaaaaaaataattaggccccatcagtaaagcaactcatgctggcattcatactgtatcattgacatcgaagtttatggtgtgccatcaattagtatagttctgattatgtgaaaacgtaaaactgtgagcattatttataaaagtgtggtgctaattaaaatatctatgtatttcttatgattttttaataaagatttgttacaaagttgcatgaaaattcatcctcaaaagtagtcataggtggattccttttttgtaacatcattatttatttatcctatcaggcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaaggtatattgtttaaaatccattcttcttgccttcatgagagaccctgaaactttaattaaatgtggttttcattacatttttagtaatggtaaatgtaaagttatgtcaacattcatggtaccttgactctcttctcattgctattggtagtgcatctaaatcaggttaaaaatttacttgttcaaatcttcctcacaaaagaatcccagttaatgaatataggaataatgaaggaaatagaaaagtcaatattagaatcccacagtaataactagagccggcaagatcaaacaatgaatgctaaaattagtgggtgaaactttaaggagaaacaggatatttgcatagcttcaaagtgtttctatcccgcagaaattaattactggggaagttttagcgtgtccacaaatactttattactcctttctttagaagatggagcttactttccctcttcttgagtgtatgctggacac

SEQ ID NO: 44215 - DNA, 1038 bp, Homo sapiens
gaagagcattagtggtccagatacaggtttcttcagattagattgttctgggtcagaacagtttccccataggatttgataataaaagatcagataacactttgaagagtaaatgggaacactgtctcctaggacagagaacttcctcaattccatttatcttctaaataagactcttttatctttgttcctcattcacttacctcctggctctgataagagatgtcacatctccagtttaacagtctgtttaatattaacttctcaaatgtatttgtccccaacatatattgatttatatgagcacacactaatgacctaagtctgttactctttcttaagaaagatgcaaatttatcataacttaaattcctttgaaaaacatcatttgaaccaaaggaatcaaaagaatttctcattgttacatcagaaaagaaactgtcttaatattaggtttgtattgataattatttccccaaacttttagtgtgagaaaatggactttgcaagtacacatagttaccgaaagaaagttaaaccttgacttcacagttttagcagacctttagcagaaaaatctactgaagtatatgctgctacactagaaattactaaaaatacttgaagcatatttagtctaaggtaagtgattttgatacaggaaaaaatggctactattatgattttaaataatttgtttttttacatttttttttttctacaattaagtggtacagcctccaaccatcacccaacagtctccaaaagattacattattgaccctcgggagaatattgtaatccagtgtgaagccaaagggaaaccgcccccaaggtgagtgtgcattctgctttgttatagtactgagaataaatcaggaaatctctctgaatagagaaatatgtttgggaatttccatcaaacaaggcagactatgtagagcacttcctttttcagttggatatttctcactgtgactcactagattgccctttggttcatctatcccagcccatttcagcccttcaaagatactg

SEQ ID NO: 44216 - DNA, 1060 bp, Homo sapiens
caggaaaacaggtgtctacagctgtggctgaaataagaggaacaacccaagaggactttgaagtggtgcacacgaggggtccaatacaacaactctaatggggatgtcctgtctttttgcctggaaagaagatgctaaaataaagaattccctggagtgtctttggcctttcaagtctatgattcatggagataaaaccaaaatttgctaaaaatctgttgattaataaaatataaatagacacagcaataacatttgctaattttattctccaaatgatacctgtcagctgtagacaatgtgtggagcaaaagagagctatactatctacttactggacaacagacctaacttaggcggtggtgatatatgctgaaaacaaagagagcagtgcttgggcttcaggaaaatctagtggaaagttgagtttattgatccttaggagcacaacctttacctgggtcttaagtgggttttataatgattaggaaatcttattaaagaagaaacttcggaaggggttctgggtgcttttagaacaaaggagaggacatagggaatatttccaagtcagcttggacccagacaaaattataaagtggattaagtttgttttcagcccctttctgtccaccatttctcctcatgtccccacattcacttcccctccatcagtgtccccctttaggaacctagtacctagtatcatactggcctgcttagatgcctctatgcaatcaaccagttgattcttattgatacttccaatgtacctagaaccttgccaggaattgaatatgagaacaccccacataaaccttccccaaatggcctatcctccagtctcaagtcctgcccatgatggtagataatttaaaaggctaatttatatacattgtgcccaacacctgtttatgcaccactccagagcctcggcctccccatctcttgttccagctctgtgtgggccccagccaatttcacaccagtacccctctcatctcccacccaacactcccatgttgacatcactgcagactccactaatgcccacgctctg

SEQ ID NO: 44217 - DNA, 1027 bp, Homo sapiens
ttttgaaagaaattctaacttgcattgaacccaatttattttatgatttgggcatataggcatttgattatttaactgactgattaatggagtttattattcaagcatataactcattacagtttcatctagctttgtattcattaccttttcagtgtgttcctccagttggatagaattgtatcatatgcgagtgtgtaacctgtagggaacatgtcgctaccttcttatgacacctggaccccttccccgtcacccatcctttccctcccagtgagacccttccttctgcgtgacttggatgaaaggtgacccaagacagacccctggtctcataaagtttacatctagagggaaaagagacagtcaccaaacaaactcactatatttgtacaattacaaagtgaaatcagagctatgaagaaaagagagatgtttaaaaaggaggttttatgccctggaagataaaacatagtctaaagcaactccttgccaagtcctgttgaaacctgagacaaaagggaaaaatcagcaatgctgatcctgtctttatttaaactttggttattttgttcaaatggctattttacattactgttgagtttcttttttcttttttttttttttcaaatacagcacgaagacatgattcgagtttttgatgcctccctggcctttgcatctgaggtaaatgcctcacttgctccctgtagtcccagcccaaagccatacttcccaggctcaagtcctggttctgccacttatcaattgtatgactgtgaacaacctgcatatactgtgcctcagtttcctcttctgtaaagcgaggataataatagtacttgataaggtcattatgaggattaaaagaagttaatatttgtaaagcaggagagcagtgcccggcacaaagtgccatgcatgtaagaagagtaatgaagatgcctgtatactgtttcaggtattgaaccattcataggagctggatttcacatgactgaattcaccaggctgccatcagcatttc

SEQ ID NO: 44218 - DNA, 1048 bp, Homo sapiens
aagagttaactatcctaaatatatatgcacccaatacaggagcacccagattcataaagcaagttcttaaagacctacaaagagacttagactcccacacagtaataatgggagactttaacaccccactgtgaatattagacagatcaacaagacagaaaattaacaaggatatccaggacttgaactcaactctggaacaaccagacctaatagacatctacagaactctccaccccaaatcaacagaatatacattcttctcagcaccacatcgcacttattctaaaattgaccacgtaattggaagtaaaacactcctcagcaaatgtaaaagaaaagaaatcacacaaactgcctctcagaccacagtgcaatcaaattagaactcgggattaagaaactcactcaaaaccgcacaactacatggaaactgaacaacctgcacctgaatgactactgggtaaattacgaaattaaggcagaaataaagatgttctttgaaaccaacgagaacaaagacacgatgtaccagaatctctgggacacatttaaagcagtgtgtagagggaaatttatagcactaaatgcccacaagagaaagcaggaaagatctaaaatcaacaccctaacatcacaattaaaagagctagagaagcaagagcaaacaaattcaaaagctagcagaagacaataaataactaagatcagagcagaactgaaggagatagagacacgaaaaacccttcaaaaaatcagtgaatccaggagctggctttttgaaaagatcaacaaaattgagagaccgcctgcaagactaataaagaaaagagagaagaatcaaatagatgcaaaataaaatgataaaggggatatcaccatcgatcccgcagaaatacaaactaccatcagagaatactataaacacctctacacaaataaactacaaaatctagaagaaatggataaattcctggacaaatacgctctttgaagactaaaccaggaagaagttgaatctctgaatagatcaataacaggtctgaaa

SEQ ID NO: 44219 - DNA, 1051 bp, Homo sapiens
aaatccgtatttagttttattaatgatctccagattataaagtgttttattctgggtgttttactgtttctttgtcttaattaagcttgtacaaagccaaagccctgtcctgactctgctgcaggtggactggcctccttgatgccccatgagcaagccaggatgctcccaccacagggtctttcaccgaggctccctctgtctggaacactcttcctgcacatatccccatagctcgctgcttcttctttaggtctttgctcagatatcattttctggtgagttatttcctgaacctgtggcaagaaagtatattacgcatgtgcatatacacacacatacgtgcgcatgcacacacacacattgacatgttggaacccctgtaccccttcctttgttttattttttttctctgtaataccacctaagaaactatataatttgcagttgttgttttttttatgtttccctccctttagaatgtaaggtttgtgaggacagaaactttggactattgtgttcatgaatgtatcccagcaccaagaacactgcctggcatgtaataggtacttaatttgctcaatgaacaaatgaatgaatgaatgatgacttatgaaacattaaagtttcagctctttgtcagataatgaaagtttcatccctttgtcagataatgttgttagctaattaaatgctgctttaattttctgtgacaccctgatttctaaagctttagaaatggcatttttttggaactcagcttactcacaaattctgctagcaggaggaaagggtattgtggctttccattgttaaaatgcggaggtagagttggaaaacaatcaaaagaaatgttcctctcattttttggaccaaatgaacaaatctagcatttgtttttgagagaataaatactcttcaaaaagaacagaaactgttctcaaaatctttgaagtatgtcactgatcctttaaccagtagttggagaagcaagtatcctactgacaaacacaggctttgtggggttgaaagccgatcataagtttacaaa

SEQ ID NO: 44220 - DNA, 1014 bp, Homo sapiens
gaaatattgaaaaatataccaatttgcatcaagaacattttttcagtcattctccttaactcagcatcatgatgcctttctagaattttggcattttgcctatcagtaaattatgaaaaagcaataggatgtcagtctgctgtgccatcaaattatctgtggggttcctgggtctctgtacagtatttacagaaacagatgactcctgtggcactttcctcaaatgacgtgacacttaacttgtctccactatgcagatctgcagtgttgagaaacacactctttgatgcctggtgagcttcttggcatagcatagcatttcaggagagaggaaagaaacacttggttaattcatttttcccacttagtttatgggctactttaacaaaaactttacctcatgttcagccaggtaattgacactctttttacttcctgtagaagaatttcaaaagaaaagcatccatcatttctgtgctaggagaacttataaagacattgcagaaaaaaactggcaatgaatgtgaacttgggccattataaaggcctgctaaataatgtcaaaaataaagatcatgaaggtaaacgagtagctccaagtagaactcttgcattctggatgaagtcctgaaagaatcatctacacatcttttcattcatagatggtgtctgttttatttctatttatttaaaagaaatacttacatagcatctgctatgtgccaggcactgaggtaagtaatttatgaatattaattcatttaatcctcataatagccttccaaagaaggtactatattatcctgattttacatataaggaaactgaggcacaagggcaaatataccacacatgcattatggtgtttagaactataacatttgcatagtaagtactttattaaaagccgaaaatttctgattatatctatttttttttttaagtttagagacagggtctcactctgttgcccaggatggagtacagtggtgcagtcacagttcactgcagcct

SEQ ID NO: 44221 - DNA, 1031 bp, Homo sapiens
acctaaaaataatttttacattcagttgtttacatgaattttacaatgtgtgtggaaaatttttgaaatgtgtgaggatgaagagagagcttaggtttagtagatctctatagaattaggttgggtttcctcagataaaatcttttagaacattttaaagtttctagtgaaccctagaagaatctggaaaactatattcttcgctggcacaatactgagggtagtgaaagaaaatcaggagaaccttttaacttttaacatattcgtaatcaatacccatgatttaaaaaaattcataatgttgtttgaaaggcaagtcgttttagttgttaattcctacagataatgttaaatcagctaatcgctctggttttcattcttttaaaaaatttctgtgctttttatcattttatttttgtaaacactgcgtccattcttctgggtgcatacaaatggatgcaaacataccgaataacagaagctctatcagaaaaagcatcaaattggattagacagccgggaaggggcactggacttgtagaagaagcttaaggtcctgtcctggatttgcctgcctcagttatgtaaatgagttggatggtattagacaacctcttaaatatgagtaattatagaaaataaggtcagcaaaatcctgaattagaagaaaggtcacttgaatgaagcaggggtcatggacaactaacaatttatatagaccagaataaaatggggctctggacgtccatttatgtgtaaggtcatttcaaatcaaataggagagaggcattttcagaagtagtgtcttgatttaaagataggtaattgaaaatattcttttgttctttatagtaatccccatcaatggtagtgctttctactgactgtggaaaatagaaatagaggggaaaaaagaattaagcaacagagggaaacagtagatagttaatagagtgatggatctgtcctatgtgtgagctagaatctctcccaggaatgtaatttgagatacgagaggacactgttcagtt

SEQ ID NO: 44222 - DNA, 1113 bp, Homo sapiens
acccagactttctgttctcattccaggcctcttttatgtccatatataatatacacagtaaaacaatcaattttcctatttgaattcacttcatcattccactatttctttataaaatattgaatttatcagggacccacattctttatcccctgttcatcaggtcctgctaatttgtttcagtaaaacttccacagattgagttgaatcctattctattgatagagtcagaagcaagccttccttcttatcttctccctcccccttatccttgacttcatataatgaaaggcagcaagaatgatgccctaatttctaaaatgtatttttgtttggaaataaggttaggacattattgcccatactaggcaattgtctctatgtactttttttctcaactatgaagtaagaaatataagctaaataattcctgtggtttctcccactataaaatttctatctatacccaatagctcctaaaatggtacatttcatgtaatagtcatttaataaatacttagggaattggtatttaatgggacagaatgtcagtatggagtataaacagttcattgaactttattattaattgctcactttgggagagtagtacgtgctgttactcttcatagcagcaaaaaatgagttatggaaatattagacgtgttaaccagtttttcattttggtttggtttttgcaggggttttttttcagttgcaagatttaatagagtgaaaacagagctcccatgcaaaaggaggggacccgaagagcatagccattgccagctcgaatgcctgggtttatatcccgatcattgtccctctcactgtgctctcaggcgatagatgattggctatttctttacctcctatttttgcctaattagcattttagtgagctctctttactacctgattggtcgggtgtgaggtaagttgcaagccccgtgtttaaaggtggttgcagtcaccttcccagctaggcttagggattcttagttggcctaggaaatccagctagtcctgtctctcagtaccccctctcaacaggaaaacccaaatgctgttggggaggttggccgatgaccgctccaactgcttcctgctgaa

SEQ ID NO: 44223 - DNA, 1030 bp, Homo sapiens
acgatctcgtctcactgcttcctccacttcctgggttttccagtgattctcctgcctcagcctcccgagtggctgggactacagggcccagctattttttgtatttttagtggagataaagtttcaccatattggccaggctagtctcgaactcctgacctccagtgatccacttgcctcggcctcccagagtgttggaattataggcatgagctgctacgcccggccccaattcttattttctgcaaactctgcctcaaaaatcaagcccagggagcctttccccctcatttaataccctagtaactttttaaatgctatttttgcctttgatcctctcctgcagcacactgttccctaaaatactccttttatcctgtcagtcctctaaataagatctttctgaagctcctgttccctgcccaaggataacagccaatctccttacttggcagataaggcttatttctgactcctccctcacaacccccaggctcagcctaacagaacttgtcaagctctgaacataccttgttgttacctactctgggtctttgccctggctctgcccctcctctgaaatttatcactgtgtctcccacacatatattcactcactcacacacacatgcatgcacatctctacccacaagaaaatcacatcttaaatctatctttttctcaaatttattccctgcccagcaaaggagatacgacacatcacaaagtagcacagttacatgtattacgtagacatttattcattttttgagtgcctacttcttacctgcgtatttggggcacaaagatgaatacagaatgctgttctagcctcaaggagctccatcctgtgggacagatgaatgtataaatataccctcctagaacatggtgagtgcagtgattgggatgtgcacagagtatgggggtggagaggaggcgggtttaggcagagtaaataaagcagggcagggctaaggtggaggggttcagttcactggctggggaacagagtctgagctcaaccaaa

SEQ ID NO: 44224 - DNA, 1033 bp, Homo sapiens
tctgtgttttctttcacttttctttagttaggaatgtcttcccatctcccattgccaatcaccaagtgtcaaaatgatcttccttcaagtatcatatcagaggtcaccctccttctctcaaacacctgtcctggtagcttttgtgtttcttttatgggactcttgactttctcctagttttattgtaattatctatgttgctatgtttatagtgctcacaatgtgccaagcactgtttatgaacatctgattcccacttcggttacattaaaggcaagacttacatctgcttcatttctgtctcccataggacctagataagcattgattaaatggatggatggatgaatggatgaatagattgatggattggaaggtgtggggcaatggggagggaatattggtaaaagaaagccatttcaaaaactctaaaatagcctacatcctacttgtaaggctaggataaaaggtgtaatgaactagacaaaatatggtaggaggtgagtataactctggtggttgtcagccaggtcctgagcttatagacatatctatgcaaatctgaaaagcatgacaacccctagaatgattcttaaacaatttcatgcaatctgttaagtcatttcccctgctacagccctttaactgctgggagttttgtgatgtcctcatctggcagtgcctttagactttggcctcaggcagaattcctgaccagacatctgccgcattcacatacccagaggcagtactcagttcgttttgctaatagggtaaacaaactccccttgacaggagggagtgacttacagtgttcagggcatacgctggggctgaagcagcagagcgccagcagttatgcagttattgtacttgaaagcctggctcaggcttcagagatgcaagctttcaggaggagctctgtgcattaccagtcatgggaatctgtgtgtgaatgcattagacatcacctgacattggcgaagcttctgtatgaaacctaccaacctatcaccaacatctccctacctct

SEQ ID NO: 44225 - DNA, 1120 bp, Homo sapiens
aagtatgtttaaatatatgtaagaactataaagtcagggataattatttgaggcagcaaaattgttgggatatatttctgtatcttgacagactcataatagattgtgaggaaaatggacacactatgattttgaacctgaaagccttcccaaatcaccacatataaaacccactgatttaaaatactgcacatgtatcatctcttctggggccagattcccactttgcagagtcataggagataaatctttgggatttagtattgtgcaggggtgtcagtctccatgtatattgggagaaaataatcaaaatgaatttggaaatatctatgaaataaaagttgggaaaataaaactttgtcttttaatgttccatttcttctgagttattctcttccattaccatcatattttcttataatcttactaatattctagcaaagtggttcttaaccttttgggtcataatcttttaaaaaatctgatgaaagccatgacatctcaccccagaaaattgctcatgtgcacatgcttgcaaaaaatttccatgaaatcgaggggttgggggaagactttactgaactctaatgtcctaaggcactaattgaatgtaatgaattaacttcttatctatgcactagctatgtaccatccttgagagaattgagaaaataatcatgcaaataattttctccagagcttaattctttcagaagtaagtggaatcctgcttgagaaaggctgcagatgaaacaaaatgaatacactaatgtaatgtatatttcatatatattctattagacattggactcatagagctatagtcatattgctgctcaaaaataacatgcagatttgggatttaataattatacatgttttaaagacaggtcagtttccagtacattctttcccccctgatattttcatgatagaatatattattcaatttcactgaaatgactattcactcaggcgcctttgagaagcattgcactccaggtgtagataggactaacctacattcagttttaaaaatcaagagcaatagtgtaaaccccactgacaaaaactacgaagtctgaaaatgatgtgttttaacattttgtgtaaagtgccc

SEQ ID NO: 44226 - DNA, 1029 bp, Homo sapiens
attttccaggatggacaactccttttgtgttttatttccatggtaacagttaagtttgggcttaagaacaacaaacctacaagataaccatccagttgacattaacgggcatccccttagagaatttgcagtgcttcatggtgtccagatcgcacctgaagtagaattacagaggcctgttgtgttttttatacagcaagctctttaaaagctgaaggttctcagagtaggctgaaattaggaaatacttcgttttagataacagttcagcacacacaaaaatattgtgagcagccagagacttgaaaggcattcccaggacaccataaagaactccagaactcaccgcttctgacctttgggtgaataaatttttggaagtgtgcagctggcaaaatggaggcttcatgtgactaaacatttttgctcatactttgtttgagggaagctcaaaatggagccactccctagcagagcaatcagtagagttacctttagattgtctttggaagtgtgaaatctttgaatgtaagtgagcctccattcattactaagaaagctgacagaggagtaaaacccaactaatggaaaagttgactgctgtgttcttgtgtctgaagtgattactgtaaattaattggtgtaacaaattataaagggtatggttgatgaatgtagaaaactttttttctgttggatcagttccttaagtcctcggcttaattcatttaatgaaaaaaaaatgtaacccaaattaaaaaatggaattatggtactatggacaacattttgttgtaaaatatattttacaactttattaaggtatatgccttttctggacatttcatattaatggaaccatatactatagaatcttttgtgtctggcttctttgaggtagcataatgtttttgagggttctccatgttgtaacacgtatcagtggtattccctggtatgtagataccacattgagtttacgtattcaccagtggatagacatatggactgtttccaatttgagactat

SEQ ID NO: 44227 - DNA, 1035 bp, Homo sapiens
ccaagagatcctccatcacagaatggcagagtatcaattacttggaatggatgactcgtggcagctgctgtctgtgactcaccgggctctctgccctgcactgacagctgcacatcacatcctgtgatcataccacctcagccacctccatgaccaattcatcaaaaaaagggggctgagcctactgatcccaaggtattactgtatgggcagcctgctcccgaggtattatatgtaaagttgtctctctgaattttaggaaatgagatcacaatgatttttataacttattactattaataaataacaataatccctgccatttattagttgcttacctatatggaacactttaatgaatgatcacatttaatcttcacaaaaaccctttatatgagaagctagcaaattgtttctatgaagggcgagatagtacaaatatgtaggcattttaggctatttgatatctccaaaaattctcatagacactatgtaaatgaacaggcatggccatgtaaaactttcttttcaaaattggcggcaggccagatttggcccacggtcaaagttttccaaccctgctttatgctattatactcattttatagatgaggaaactgaggcttagggagtttagctgattaaaataacatagctgctaagttgcagagctaggattctaacccaaggaatttgacccttatccctcagtcgtaattcctgcacattactgtgtcatcctactatgatatataacaaggaaatggacttttagcttctgcatggtgagagttacagttatgacccaaacttctaaggggaatgttgtatagagaactgagtcctgaagatgctatttaggaaagtgtagatagtctaatctaatctacagcacattcaggtaatgtaattgcatccttgactaattgaaaaaagcttctaaagttctttgagcaatctgatattgtggctgttttagtcaataggattgcaaaaagcaaatgaccctaatttttaaaattatgtacattatta

SEQ ID NO: 44228 - DNA, 1038 bp, Homo sapiens
cttctgactgttctgcggctttcccctctattatctagttgaataaatacagaaatgcccaaccagcttcccttgtaaaattgcatcgcagtgttgtggtgttgtccacagattgttttgatgtgcaacaagatacatctgtcctaaatattgtctaaccagtgttttttcttcccagataagtatatttatgaagtgtgattttggctttctgctcccggtgggagtccatcactcttatatttactctcgaagtttttcatatggcacatggttttccattcattttggtaggcagcatctgattgaaaacatttcagtaggaaacgttttctagtgtgtgcatcactagaataataaaagcagctactaggaggtagagggtactagaatgtattataataagtgaaataaaaagcaattttgggtaatttgaaattcttcctggtattctgtaaaactgcgattggaaatggaaaaattgtagtatttgaaaactgaaaaattgaaagttgaaacatcaccaaattttgctttcgcatctttgactgcttaaatgactcgacatagtcttttcttctgatgttagtagcatgatggctaaaagccatttttgtaaatgtatatttagtacattcaaatgaatatttctacttttagggaaataacattgacatggcaatatttgaacagttagtaacatggaaattccaacataataaatactctaatgtgaacaacatctaatttacttcagaatgattatattaacttacacgacatgttgtgttttacatgaatcatgatatataccttgtgtgtttcatgaattttaaggtaaatttcattttaatagatgtgctggggtttaaaaaactccatggttatgtttacgtttctagtaacagttactgtgatgtgaaattataatggaaggtaaatagatgtcaagggttcactgctgtcctaaaaccatgagggggttcattaaacagcagagagggagtgagttcatgatcagactcattacctctaaag

SEQ ID NO: 44229 - DNA, 1048 bp, Homo sapiens
ctatttctcccacccataccttggaggattaattaattctcttatcaacaaatacgtaatgggcatttgtattagtcagggttctctagagggacagaactaataggatagctacatatattatatatatacacacatatatatctatacatgcatccatctatatatatatatatatatatatatatatatatatatataaaggagagtttattaagtattaactcacatgatcacaaggttccacaataggccatctgcaagctgaggagcaaggaaagccagtccaagtcccaaaactgaagaacttgggagtctgatgttccagggcaggaagcacccagcacaggagaaagatgtaggctgggaggctaggcaagtctagtcttttcatgtttttctgcctgctttatgttctagttgctttggcagctgattagatggtatgcaccagattaagggtgggctttggcaacaccctcacagacacacccaggatcaatactttacatctaccaatccaatcaagttgacactcagtattaaccatcaaaagtccaccccttgtcaacttgaacccatacaaatctcctgagatcatacataatctttaagtaaagacaataataaggtcataattactcctaacataatacgactattctttgtacaaccagaaacgcatcaatccccaacccaaatactattacataaagttaacatacttaaatgctgatgtgaagtcaataaatcttatgtcccatgataaaggagaaaggaaataaaatgaagatgttttcttagtacaagtgtatacatgcataaacgtgtttttaacaaaagaaggaaatattcatgacaattgcagtcctcgtttctgcagctggtcacgtggtcgtagctggtattgacaactaccttcttctaccaccattctgtattccctttgctttcagcaagcacctcagcaggtcatggtttttttcctggtggagtgacccaaaccttcattcctgaagggtctgggctatttgtagtcctgcctgga

SEQ ID NO: 44230 - DNA, 1033 bp, Homo sapiens
cctaacaactaatttggtttagttagaacttatttaattggaaattatacgtgaagtaattgaatgtgtctattgtgagtttttaatcttccttttaattctttaatgcagaataattgtatagcaacagaaaatacagtcaatatctaaactcatagattccttttctgctcaaggaatgatcattctttttttttttttttaaatagaaatggttgccattaaacattcatctccttggggcatattaaaaattattactaggctcaaatggatgccatgcttctataaagctaggtcttttcatgttagctctaaagtggtgttgccaaattgctcagattactagagaaaataaagagcagagtaactggaaattgacttgaacaacttaaacttccagccttatttttagctccaaagaacaattttcaacgtatttttcaaatgccttaacaaaagtcattaactagagtgcacacttataaataaaatggcttgtaaatactaaattgtatatatattaaaactcaatggtgctgggcatggtggctcatgcctgtaatcccagcactatgggaggccaaggcaggtggatcgcctgaggtcaggagttcaaaaccagcctggccaacatggtgaaaccccatctctactaaaaatacaaaaaattagttgggcatggtggcaggtgcctctaatcccagctactcaggaggctgaggcaggaaaattgcttgaacctgggaggtggaggttgcagtgagctgagatcacgccattgcactccagcctaggcaacaagagagaaactctgtctcaaaaaaataaaaaaacaagaaaataaaaaaaaaactttaatggctaaataagttcatgaccatgttagagttcatttctcagaatacacaaaaatctatgtcattagtggagtgtcttgtatttggcaatcatggtcagtaaatgagtagaaaagctatcttatcacttgagactagtaaaatatagagatattcactgagcagactaaatt

SEQ ID NO: 44231 - DNA, 1040 bp, Homo sapiens
gacacctttgtggcagcccctcccatcacaggcctggaggcccaggacagaaaaatggtttcatgggacaggcccacagccctgggacatggcaccctgcatcctagctgctccagctccagctgtggctaaaaggggccaaagcacagctcaggctattgcttcagagggtgcaagccccaaaccttggcagcttccatgtggtgttgggactgtgggtgtgcagaaggcaagagttgaggtttggaagcctccacctagatttcagagtatgtatggaaatgcctggatgtccaggcagaagtctgctgcaggggcagagccctcatggagaacctctactaaggcagcacacagtgaaaatgtggagttggagcccccacacagagtccctactgggacactgcctagtggagctgtgggaagagggccactgtcctctagaccccagaatggtagatacactgacagcttcccccatgcacctggaaaagctccaagcactcaactccagcccatgaaagcagctgtgggtgctttaccctgtagagtcacaggggaagagctgcccgaggccttgggagcccaccccttgcatcagcatgccttggatatgagacatggagtcaaaagagattgtttcagagctttgacatttaatgactgccctgcttggttttggacttgcatggagcttgtagcccttttgtttgggccagtttatcccttttggaatgggagcatttacccaatgcctgtacccccactgtagcttggaaataaatgacttgtttttgattcatttttacagactcataggcagaaggttcttgacttatctcagatgagactttgaacttggacttttgagttaatgctggaatgagttacgacttaggggaactgttgggaaggcatgattgtgtcttgaaatgtgagaagaccatgagatttgggaggggcaaggggcagaatgatatggtttggctctttgtccccacccaagtctaatctcaaattgtaatccccatgtgtgagag

SEQ ID NO: 44232 - DNA, 1050 bp, Homo sapiens
taaaagggctccctggacattgtttttcttagaatgtaactgccttccttctgtgtttaaagcaagttttgattcaactggaaaatgtagccttcgagaccacattacctagtcataagtgcaacacacttgtactcactctgagtctcaatgaattcccgtgcttccttgatccactagacttccgcgctcatggagcaatgctatgtgcaaatggaatgacaagaatgggagagcacacagatggtgcctactcaatctcctctgcttgcatacatagtctttgttaaatcagacatataaaacacagaatcagttgcagctttccttgcatcactgctgggatgaagctggtcctactgtagggccatgagcaggtcattaggcaggtgaagtataactgtgaaggagacctcctcttcaccgtggccaaggaacctatcattaatgcatgatactctgtgaatggtgagaggctgggcatctacatgggccataccagagctgtgtggtatgtggacgctgactgggacaccaagcatgtcctcacccattcagctgacaaccatctttgggcctgtgaaacagggaaacagctggccctactcaagaccaattcaactgtgtggatctgcagttttgactttgggggcaatatcatcacgttctccatggagaagcagaaaagctatcagtgctttgtgagcttctttgacctgcaggatctgagccagattgacagcaatgagtgctacctgaagatcccttgcagtgactctaaaatcactagtgccatttggggctcctgtggggagtgcatcattgcaggccatgagagtggaaagctcaaccagtatagtgccaagcctggagaggtgttggtgaatattaaggagcactcctagcagattaatgacatccagttatccagggacatgatcgtgtttgtcactgcatccaaagacagcacagccaagctttttgactctatgactcttcaacatcagaagactttctgaacagaaagccccatcagctcagctaccctct

SEQ ID NO: 44233 - DNA, 1027 bp, Homo sapiens
tcatcacctgtttaacctattcatggaggatatcattgtccttttttaatatcacatgcagagaataaagttcattttattcctaaattaatggtacaatataatcttcattttgtataagccattcttcagttcaaattaattattttaattaatagacaatatatttaaagtttacagaagaatttaacaaaaaaatataaatagttctcatataacctcacttctctcccccaacacacaaagtttcttatattattaatattttttcattagtgtggtatgtttgttacagttaatgactaaatatacataccttgttattagctaaagttcatagtttacatgagggttcacttttatgttacacattctataggttttgacaactgtataatgacatttattcattattactgtctcatgcagtagagtagcattgccctagaaatcacctactcatgcctcttgctctccccacccagaacccctgatagccactgatcttttcacgtctctgtagtgcctgttcctgaatgccatacatatttgccatcatacagtaggtagcatttttagattggcttctttcttgtagcaatacacatagcacatttctttttatcactgacaatattccattatgtggtttaaccaccgtttatctgttcacctattgaaggatatctgggcttcttctgagttttggcaattatgaataaagctgctgtaaacaatcattttcaagtctttgtgtggacataaagttttgaactcacttaaatagcaggagaatgactgtgagatcatatgaaaagagtatgttcagttttataagaaactgtcaaaacgtgtttctgtgtagcagtattattgtgcattgtcaacagcaataaataagagctgctgcttcacctactcgccagtgtttgctgttgccagtgttttagattttagctattttaatgggtagatagtggtcatcattagttcaatttgcaattccttaatgtcatatgatgttgaa

SEQ ID NO: 44234 - DNA, 1022 bp, Homo sapiens
ggtgccacttacacaaaaggaaattaatttggtcattaaacatcttcattttgttcactagtaattacataacttaagtaacattattacaagaagtcatctcccatcaatccacacacttcgggattgttttctctaagcaagcctagtatattccaggtacatcctgctaaatgcattctacagataaggactctcatactccgcttttcaggagataatcttattagcaggtttgcaaggggatttgaccaggtcatctttctttgctttaatatcttgtgaaaaagaaaaaagatcctttcattctcaagctgaaacctaaacatctcctatcaccaagcacccttcactatttctgttatgctcttaacttggtagcagcttctctctgacaggctttgtggagtcttgtgtttaatatttgcagacaagtcctcagccaataatatgtgtgcaatcctaacatagatgtatgcccttcacttccacccttagggatcctcctctcaagactctgcccccaaattgcagtcacttctgcagtccagactccaatttgtgcctctaagttcagtgggactactgtgttctgcttggcttctacctcactgtgcttctgtgctgctcttctcagggatcagtcctgtggttcctgttgtccagtgattgaaaactgtcatctcacagtttgtccagttttatttttgtgtatgtggcaggagagcatgtccagtcttagtctatgattccgtcaaaggcagaaatggaagtcctcatttttatcttattttagagttcaggagatttaatttttaatgcccatctgtctgccataggcttttctattcatattttggttgggtgaatttgatccctgttaggtttttctagaagttaatagggatgatgtttcctgagtctttgtacattcaaaaatcatttattgttggttgtgttatatgactgacaatttggtttagtgtaattatttttagtcataaacgtatgacttttcataa

SEQ ID NO: 44235 - DNA, 1040 bp, Homo sapiens
taagaccattgaactcatgaagataaagagtagaaggagggttatcagaggctgggaagggcaacatgggaatttgggggagagtggaaaaggttaacgggtacaaaaaaaaatagaataagacctagtatttgatagaaaaaaagggtatctatagtcaataataatttaattgcacacttaaaaataactaaaatagtataattggattgtttgtaacatgaaggataaatgcttgaggtgatggataccccatttactttgaagtggtcattatgcattacaggcctgtatcaaacgatctcaacccataaatatgtacacctactatgtacatgcaaaaattaaaagtaacaacatttttctaaaaattgaaaaaaaaaaaaccctcagagaatataaggccaacataaaccatatgaagaaaatatttgagcaaggattccaagcaaacgaatacatgaatcacatcagaggcctcaggagcatgaaagacaaagtagagaggaaacattaataggttaaatgaagattctgaaagtcaaggagccatagtgcaaagaaaatctagtaagagtctgcaatgaaaagttctaagccatttcagtgaatccaaggttttggtctgagaaaaagggcagatgtaagagcctgccaatttcttttctgtcattgggttggggtcggggaagtattgacaccccaagtctcttcctgaattggggagaaatagttaacattttattttcaaataagagtagagatatgtgttcttgactgtcctcagaatgagagtataactaatctggagagtcataagtctccagattaacaagaggaggctgtgtaataactctatcaaattgtgtaataactctataaaaaaggagtaaacaaaaacccaatcagataaataagaaacataagtgagatcaagaaataaaattaaatataacatttgctatgctaaatgtgaataatctaaatgtgtctgctaaaacatagagactgagaatggctagaaaatattcattgaaaat

SEQ ID NO: 44236 - DNA, 1047 bp, Homo sapiens
atttaattatcaaactttcaaagatcaatgaaaaataaatgcttctaaaagtggcaagagaaaagcaaccaatatcatacaatagagctatagtacgtctggcagcagactttgcagtggaaatcttacaggctaggtgagagtggcatgacatgtttaaagtactgaaggaaaaaacttttaccctagaagagtatatccagtgaaaatatcatttaaacatgaaggagaaataaagactttccagagaaacaaaagctaagaaatttcctcaaccagatctgtcctacgagaaatgctttaaaggaagttcttcagtcacaaagaagaggacattaatgagcaataaatcagctgaagatacaaaactcactggtaatagtaagtacacagaaaaacacagaacattataacactgtaattgtggtgtgtaaactacttttattataagtagaaacactaaaagattaactgatgataatagatacagcttttcaagacatacacagaacaagatataaacagaaatgataaaatgttaaaaaggggacaaagctaaagtgttgagtttctattacttttttcttgtttctttgtttatgcaatcagtgtcaaatcatcatgagtttaaaatagtgggctaaaagatagcatttgcaagtctcatggtaacctcaaatcaaaaaatgtacaatggatacacaaaatataaaaagcaagaaattataccaccagagaaaattaccatcactaaaaaaacaaaaaacaaaagacaggaaaaaggaaagcaggaagagaagaccacaaacctaccagaaaacgataaacaaaataacaggaataagtacttacttatcaataataacatgaaatgcaaattgactaaaatcttcaataaaaagagtagctgaatggattaaaaaaccacacctaatgatctgttgcctacaagaagcatacttcatgtataaagacacacatagactgaaaataatggcatggaaaaagatatatcatggtagtgggaactaaaaaaaaaaaaaaagc

SEQ ID NO: 44237 - DNA, 1034 bp, Homo sapiens
tgtataagtttttgtatagtttggatattaacccattatcagatatatggtttgcaaatatttttctcattccataagttgcctttccatttcatttcctttgctgtgaagaaacttttattttattttttattattttaagaaaatttttgtgagtacatggtaggtgtatatatttatgaggcaagtgagacattttgtgcagaaagttttaaatttaatacagttctacttgtttactttttcttttgttgcctgtgcttttcatgaacaatttcataaagacttcccccaatattttcttctgcaagttttgtggtttcaggaattatgttaaattttttagtcgttattatatgatgcaatcttattttttaaaatgtggatatgctgttttccccaacaccatatattgaatggcttgtcctcttcgcactgtacattgttggcacctttgttgaagattagttaactgtatgtgcataggtttatttacgagctttctactgtgttccatttgtctatatgtctgattttaatttccaagccatgctattttggctgctataactttgtaatataatttgaaattagaaagtgtgatgctgccagatttgttattcttgttaaagattgccttatttaggatcttctgtggttccatattaattctaagattttttttttaaatttctgtaagaaaagccactggaatttttaaaagtagttaattcatgttaaaaaactgacaaataattattgtatatatttatggtttacagcatgatattttatacatacacacacatacacacacacacacacggaaatggccaattaagccaattattatagcatatttattacctcataaacttatctctttttttggtgagaacacctgattaattttgaataatctgtattcaagtttactagttcttctgcatcattgagtgtgctgctgaagctctctactgcatttttctgtcctgtgattgtactctttaggtcctggatttctgttggttctt

SEQ ID NO: 44238 - DNA, 1072 bp, Homo sapiens
tatacatattgggttatagtagaaattatattaaacattactaaggtattagtcaggtgagatctgtgaggttgtttggtggagagtaaatgaaagggaaaggtacagcagtgtttctcaaactaaatgtgtcagaatcaccctggaatcttattcaaatgcatattctaatttagtagttctgggtaggattcaagctttttctaagaatctcccaggtgctgctggtgctgctagttcaggtatggtactttgagtagcaagttcctgaggacaggtcatgactgaaagaggcagacccaggactggcccatgtggagtatatagttgcagattggcatgtgttttcttgactcggggtcattattaaaagcttcagtatcaaactaaagggaaaaaagagtttggccactgtccatgtttctcttatttttctcacaaatgcacttaggaagctaggtttatcaactgcttgttaaaatattaatactcagaaagaagtttttttggatcttctgttagaaacagctgaagttataacctctaagtgtctccagggctaatgaaagaggcgagaaagataatcaggtccaatcacttttattgactaaacaaagcgagttccctgctttccttttagtacttgacatttcacttttacctgtctggcttcacaataactataatgtgatttcaatgaccttcagccctgcaaaaggatgccagaatatattataagtttagtttaacattttaaaaacaaaatagagcccgtagacactcaaaaataaatttcctttgttaacgaaaagagtcaaactctgtaaaatatttgaagagatttattctgagccaaatatgagtggctatggcctgtgacacagccctcaggaggtcctgagaacatgtgcccaaggtggttggggcacagcttggttttatgcacaaaacatcgatcaatacatttaagaaatacattggtttggtccagaaaggcaagacaactcaaagtgggagttgggggagttgggggtggggagggttccaggctataggcaaatttaagcatttt

SEQ ID NO: 44239 - DNA, 1071 bp, Homo sapiens
tcacgcctgtaattccagccccacaagggctgaagcaggaggatcgcttgagcataggagttcaagaccagctggggcaacattgtgagacctcatctgtccaaaaaaaaaaaaaaaagttagctaggcatggtggtcccatactcaggaggctgatgtgggaggatcacttgagcctgagaagatcgcttgggctcaggaggtcaaagcagctgttagctatgattgtgccactgtactgcagcctgggtaacagagtgagaccctgtctcaataataataataataataatagtaatagtaataataaaatcatcctgctggtggatatcattcctttctctctccaattgaaaaactaaggtaaaacttacttcagtggaccaaccagaaaatgaggttagcttataagtgagattgtttttcttcgcctctatattgtacttgggttcttctgtatgagatacattggaattttcccaatttttaaggtttttactcaggtcctcaaatttctgtgtctggtatgttgtctaacagactgtgactttacttttctgtagagaagcaactattgagaatgccacagacttgagctttccatgctatatttagaagataatttgctgcacattcttggatcgattttgccatctcagttactttgtgggagataattgacattctttgtgctatgacaactgtatgtgatggattagttctagtgtttgacactggttagcttcatatcagtcacagaatttcatgagcaacccgattcaaatcctatgcaagacacaagagatttctaagaatatagccaaactgaactttagtaaaagaacaaacatcttctctctttgaagaaatcttcaattttccaaagtcacaaaaaagatgaacactcagtggactataattaaaacagtttctaatggtcagtatatattgcaattgaaaaatttcagtgtgactatagctagatattgtgatacttttatatcaaagcattaaaaccttaaaaataatacagttaaactcactttttacaaattaatcaagggtgtaatt

SEQ ID NO: 44240 - DNA, 1025 bp, Homo sapiens
acttgagaaggagggactcctccttaacttattctatgaggccagcctcattctgataccaaatgagacacataggaaaaaagagaacttcaggtcaatattcctgatgaacatagatgcaaaatgctcaataaaatattaccaaatcaaattcatcagcacacaaaaagcaaatccaccaggatcaagcaggctttattcctgggatgcaaggttggttcagtatacacaaatgaataaatgtgatttatcccataagcagaactaaaaacaataacaactatgatcatctcgatagatatggaaaataccttcaataaaattcagcattccttcatgtttaaaacccccaagaaactaggcatcgaagcaacatacttcaaaataataagaggcatctatgacaaacccacagctaccatcatactgaataggcaaaagctggaaacattccccttaaaaactagccaaaattcttttcaagataatgataacttgaactcatggatccaagaagctcaaagaatcgcaagcctagtaaaaatgcatatggctacacaaaggcacaaaataagcaaaattttttaaaaaatgtgatagtggcaaaatcttaaaagtagccagaaaatatacctgtaaaatgaaggcaatattactgtaaaatgaaggcaaaataaagatctttttcaaacaattggaagctcaaagaattatttgctagcagacctgcacttcaatgaatgttagaggaattttctcaggcagaagaaaattggtatcagataaaatttgggtggatgacaataaagattgttttaaattcatggtagaaatctcttaaaagataaaaaaattaaaagcaaaaataggattgtattgtggggtttataacacatgtagaagtaaaatttatggaacacttcacccaacagcagcacagtcacattgttataatacacatgtaaatcagtgcatgtggaaaaagccacagcaatttcaatgaaaattgaatgagagggaggaaa

SEQ ID NO: 44241 - DNA, 1058 bp, Homo sapiens
ccgcccctttaccttaagtttatgtgaatccttgtgtgttaggtaagtctcctgaagacagcagaaacttggttggtgaattcttatacattctgccattctgtatcttttaagtagaacatttaggccatttacattaaatgttagtattgagatgtgaggtactattctactcattgtgctatttgttgcctgaacaccttgatatttttcattgtcttattgttctatagatcctgtgagatttatgctttaagaagtttcaattttggtgtatttcaaggatttgtttcaagatttagagctccttttagcagttcttgtagtgctggcttggtagtggcgaattctctcagcatttatttgtctggaaaagactatctttccttcatttatgaagcttagtttcactagatacaaaattcttggcgataattgttttgtttaacgaggcttaaaataggacctcaatcccttctagtttgtagagtttctgctgagaaatctgctgttaatctgataggttttccattacagaacctgatgcttttggctcacagatcttcagattctttcctttgtctttagataacctgatgactatgtgcctaggcaaggatctttttgtgatgaatttcccaggtgttctttgagcttcttgtatttggatgtctagatctctagcaaggctggggaagttttcttcgactatttcctcaaatgtgttttccaaacttttagacttctcttcttctgtggaaacaccaattattcttaggtttggacgtttaacatagtcccgaacttcttggatgctttgttcattttttaaaattcttttttcttcgtatttgacatattgggtaaattcgaaagtcttgtttttgagttctcaagttctttctttctgcttgtttgatggatgagactattgctgagactttccagtgcattttgcatttctctaagtgtgcccttgattttcagaagttgtgattgttttttatttatgctatctatttcactgaagaattttactttcatatcctgtataatgt

SEQ ID NO: 44242 - DNA, 1033 bp, Homo sapiens
aaaattaaccttatttctgagtaaaggtaatttctaataccatgttttagaaaatgttttacaagtgtttcttgtatctcattttaaaatgacgtcatttaacatggaattataattttaaattttatgtcagtgagtataatctctgtggtgagtggctaccatgctggacagtgcagctctagagaactggctgttaaccctggtagcacaggggagctctaagtagagctttgaaaaatctgctctccagccccactccagaccaattacataaacatctccagggtggggtccaggcattaggattttcaaaagagctttccaagtgatttcaatgtgcagctaagatgaagaccactgcatgaattggagacctcattgagaggttttgtttttatcctagaaccatgatacatctttaaagctttaagcatggatgaggggtgatcacatttacattttttaaaaatcactctggtgaaagcacagagatcagattagagggaaatatgatagatgtaaatgttggcagatccttttagtggcttgggcagtagcccagttcatggatgatggcttcatggtagatgaagatggaatcaagagttatttggaagatgaaaggtcttgattacaaattgaatgtggaaggggaggggaggaggtgctgttcagtgtgatggaggatactgcaagtagatgcagtcgttacatgattttttaaagatcaaatatatgcaaaaacttgtcatgagttttgagaccatgcagacagatgcattaaaagtaaaataaggtctttccattgctgaagaagtccataggttttgctatcgagtatttaaattactaactgtaacactgacggaggttaggaattataccaatgatgaggaatattacttattgtattcttgttatctagaaagtaagtcatccaaaggaagggcaaattggagagtaattcttttattgtgggttcttgcatgacccactaaggtccttctgaagaaaatatttatttgtgcca

SEQ ID NO: 44243 - DNA, 1046 bp, Homo sapiens
cagtgaataatataggtatttagaatggcagatattcttatactagtacccagtgtgctcacacttacaagcacgaacttgctgtggcacaacagaaacgtgttgtctaattgcctcttctcttagttaattatttttcagacttcatttaaatgcatgtttcaacataagatgaattttatctgctgaattggttaattacatcagggagaagggaagatgatattgaaagcatgctttaattcaacctaaaaattaaaacttttttccattaataatttattcttgaataaaggtagacacttaaaaccaatattatttcttccttaaagctcctctactacacatatgttctactgtgtaattttgatgaggagtcaaatggggtgaaatgtttcattcaggatttttatttcacttagactttcagtttgtgaaataaggtaataataatttaaatttcatagcattttttttttattttctgagacagaagcaaagacagaactgttgcttcctgaggaaaaggatcatgaaagatcaccttgctctttaccttttaaattgagaatcaaagttccatagatcctgcattttagtacttacataggagttgtttactcataggtagtcaggaaaatgaaactggcactcttcttggaagtggggagttctgatttactttttgctgcctttgctctacaaaccagaggcttacaatgaatcaactcaatacttgctgaggtcgcaataagcaataaatggctggctaatgtaggcaaaggcatttagctatactttgtatgcattgtaaatgtgatattttctggagtgttcggctaacaccttgtagatatccttggttaattaaccaagtattgaaagaaggaaccctatcttttcacctgtgatcttgcaggtcttgctttctaggtaagcagagctgtgggttgtaatacaaagatttttgttggtatgtgaaatctgagttcttccttatctagcttaaactgtttcctcttccaaaaaggaaaaactatattcca

SEQ ID NO: 44244 - DNA, 1058 bp, Homo sapiens
aagggacagtccaagagtcagtggtttagctgggggccagtttttgtgaggatgacaagatttgcatacagaattgaaaattttctgtttccttggtaggataccttaaataactataacactaatgaagttgtatttaaaaggatagatttaaagacttctttacaaaaagttgtaatcattttcttccaacctgtttgtacacaattatatatgtcttcatgtatatttatttaaattttttttaaaaattaatgctttgggaatatcagttgctttcataggagtcttaagtaatttatctgaaattatcaaatatttacttggttaaaattagactttgtgtttgggtgactagagaaaaggtacaaatgaagggaagtggttaggaagagggatgatttgtcacttgttttgttcaggttggagatggatacaagcacaatgagatttcttgtttgtattttttaacacacatcagaaaattcagacacgctttcaaactaggttttttaatggccaaagaaatgtcctcctgggttgagaataagaatgaacatactgtatttgaccgaaaggagctaactctatcagctttaaaatggggtagactccatagggactagaagaataggcttgaagaataaagcttcgcatagaggagaaaccagagtaagcacatacaaggaatgtagaaaattagagcatattaggttttaacctatcttctagtaagattttaaaactaagagccagaacaagtctcttaaacagtgaccaagaattgatacagagatggggactgactacttagcatagattggtcattatggtccaacatccatggataatcagaacagacatatacaaaggtaatattaaaggatttacacctatcctgaaacatattaaacctcctcaaaccacagtcgggtcatttggctatttcatcctaaggaaatatttaactgtttttcaaatgctttttactttctaagagtcctttgtactttctgacataattaagatttttctcatctttcatatcaccttttctg

SEQ ID NO: 44245 - DNA, 1061 bp, Homo sapiens
agccaccaacctcttagagttggcgttggtgtgctttgtctttcgtgtttttcataatgcaaagctactgctgtttccaaagtgtatgtaaagcttttggaactgaagaatgggggaaagggtgagcagtggcaaagaggagtaatttttattttatattcttagattattttcggtttggtgtcattggatagtagggcttcagaatatattttgcctaatgaattgctttgttgtttaaaactcatgaagtatccaactgatgaaacagatagttgccctgttagagaaatgtagtaattgtttatttcaggttttgaagaacttcattttaacactattttctaggagatttgagaaaacataaagaaattattatatttatctagttcataatgtattttacataaagtaatattaccttttggtctggcccgtttgttattaatacagtatgtaacatagtcttttaggtaacttttctttataaagataatacaatatatgtttatttaggaaaaatctggattggcacctgaccaaaaaaagttaaagcaagttatccataaatactagtcataatctttttcataatcttattcataattagaactaaaaaggctaatattttggtctttcttgctatatataaaataatgtatatatgttgataggcatgacaggtattttgttactactgcaatcccaatgtctaagagtatttgtttttagtatttacctgatttgtttttagtattaatatcttagtcttcttcagtgagctaaatacattattatttattacctactgaatattaacaggccaaatctcttcattgatatgactttgctttttgcctgcccaccaaccaggctcttatttgatggtttctttctgccagtgtagaaaaatgatgtgaagttgaaacggtaattgagcttcactgtgcatttttatttgggaaagatgacagggttttaggttgccacattaaggaagaagaatgaaggttaacggtgattttcaagtaactcctataggaagggtgattttagcttta

SEQ ID NO: 44246 - DNA, 1050 bp, Homo sapiens
gtcagcaaactatggcccgtgggccgtatctgggcctatttttgtaaataaagttttttttggaacacagcatgcccattcattaacatattatatatggctgttttcacactacaagggcagagcagaatagttttctgagaccatctggcctacaaagcctaaaatgtttagtctggtcatttacataaaaaatttgctgacctctggcttagaggagagatgactaaaaaatctggataggagcactttgagaacagtctttttagtttgcacacttgtttctagttcttatttagaagaaactgcatggctgttaggtgaacttgtctaactctctcatgattaactgctgatttatttaataaatttgcatatatccttgcagaaggatcagtacatattttccagaggtgtttcttatgtgatttgttttctatgttcatcttcataatatattcttgatgatattagtatgtctttattcaaagtactggaaacttacatgggatacacaatagctgtattcaagtatgtgaaggactcttttcctgtgaataaagggattagatgtatttatccttcaagtccaattaaaatgtgcttttgttgtcaagcccctgattccagctactcccttctttgggcagaattaatcaccctctcttctgtgcttccaaaattctttgtacaaagtactgttacagtatttgtcacacaacgctataggtcttgtttgcacatttgtctccccagttgattgtgaaatccttgaaagtgaggacaatatcttattcattttggcatcctcatcatggggctcaggccctggctcatagaagcaacctaatgcttgatgagtgaaggtatattataatcccagagggcaaagcaaggaccattgtgaaatctcactaaaaagaactctgtggtagtgctggcaaccaattgaaaagtctcctaagcagtgtgcttggacatcaaggacaagaacttggggttagaatgcctaggtttgcattttgactgtcctgtttaataacggtcttt

SEQ ID NO: 44247 - DNA, 1089 bp, Homo sapiens
taagatgttatttagcaaaacccatgaatataccaggataacgacagtacagtgcaaaacctggctaaaatcagaatgacagagtagggtttttttgtttgttttttctttgtttgttttgagaggagtcttgctctgtccccaggctggagtgcagtggtgcaatctcggctcactgcaacctccacctcccagttcaaatgattcccctgcctcagcctcctgagtagctgggactacaggcacacgccaccacacccagctaattttttgtattttagtagagacgaggtttcaccacgttggccagggtagtcttgatctcctgacctcgtgatccgcacacctcaacctcccaaagtgtggggattacaggcgtgagccaccgcgcccagccctacagagtggttttaaagtcaaatcagttcggaagcagttttaaaaaaaaccctgctgggacctttagcttcaattagggactttcaccgaagcctctaacaagtctgagagcactgtttgttttaaagcactaaacactttagacttcacctggaaagaatacctgggtacctctgaataaatcagtgaccccaaatgtctagagaacaaatgaagattctgcagattctttccctctagtattttcgtcaggccagagcattcttcttttagtgcatggttatttttatacttgctattgcaaccctttattgaaatatttgtaacctctcataacagcctcttttgataagtttccatttcggttttcattttgcaaatgagatcttatttaccaagttggctgcttgtgtcttttggctaaatatgcagcatattttaggggctataacaagatacgtttgaaaggccaataatttgttattaccatatggtagaaagaataaagaagttttctcaagattcccattcccaaattgtgtaatcaaacactcacccagatacttatgtgaagggactttggagacagaattaagtttaataattctgaccttaaattagataaggaacctgaatgtttctaggggagggggcaatatttaatgtaatcacacaaacccttaaaagcaa

SEQ ID NO: 44248 - DNA, 1062 bp, Homo sapiens
attattacccaaagtctatagttcacattagagttcgttcttggttgtgtacattctatgggtttgacaaatgcatatgacatatatccctcattgtggtatcatacagaatagtttcactgccctaaaaatccctgtgctctgactttttatcctttcctcccaactaatttctggcaaccactgatctttttactgtcataatagtttttttgtttttgtttttcttccccagaatgtcatatatttgaaatcgtatagtatgtagcctcttcagattggcttctttcacttagtaatttgcatataagtttcctacatgtcttttgatagtttgatagtttgtttctttttagcagtgaataatattccattgtctggatataccacagtttacttatccatttacctgctgaaagacatgttgattgcttcccagttttggaagttatgaataaagctactataaatattcgtgtgcagatttttgtgtgcacataagttttcagtttatttaggaagatatcaagaagtgtgactgctagatcctatgttaagagtatgtttagtttgtaagaaactgccacactgtattctaaagtgactatcattttacattcccattagctatcagtgagatttcctgttgctccacatcctcaccagaatttggggttgtcagcatttcggattttggccctcctgataggcgtgtggtggtatctcattgttgttttaatttgaaattcccaaatgctatattatgttggacgtctttacatatgcttgcttaccaaccatattttttctttggtgagttgtctgttcagactttttgctcattcttaaaggtgatttatattcttattgttgagttttaattagtttttgtatattctagataatagttctctatcagacatttcttttacaaatactttctcacagtctgtggcttattgtctgattctcttggcattatctttcacagagcagaagttttaaattttaatgaagcccagcttatcaattatttctttcatgggttgtgcctttgatgtt

SEQ ID NO: 44249 - DNA, 1034 bp, Homo sapiens
tatgtctgcatcccattgatattgggcttatcagtgtgacttgctttggtcagtagagtacagatgctcctcgacttgtgatggagttacatcccaataaaaccatcataagctgaaaatatcgtacattgaaatacattcaaaatacctaacctaccaaacattgaacttagcacttaatatttaagtattcagaacatttacattagttgggcaaaaatcatctggccacacagtatactgttgagtaccagtttgttttaacttcatgatcatgtggctgtctgggacctatggctcattgccactattgagagagagtgccaccatcttgagagagtattgatatagcatattgctagccgggggaaagatgaaaattcaaagtacagtttctactgaatgcatattgctttctcaccatcagaaagtggaaaaatcctgagtcaaacctttataagttagggaccttccatgtaagtctgccagtatgccatgaccaagcaaaaatgttgaaaaatcatactgtggactttccattgctcttttctttgtgtcatgagaacaaacatgtcccagtgggggctgctcttttaacctggatccccaaaagaaggagatgtgtggagcagagctaagctgatcccccgtgacccatgaccaacatgtaaagtgagtaaaatgtaaggaaacaagaaataaactggtgttattataaacccctgagatttggaggttgacaagagctgtggagggtctgaaatgttaccctgcttgcaaactaatgtgtaagccagccattggatcatggattctaacagaggatttaagactcaggtcagagaaaaagggcagtttattactcatagcaacagcagtagccagagtatcagaatttgtgctggttctccgatcccccagtttccacagggtaatgtgtggagggccaggcgttataggaggtgggtcttgaacttcaggaatctgaattttttatatgaggaggtaagtgggccagctctctgctttttagg

SEQ ID NO: 44250 - DNA, 1088 bp, Homo sapiens
acctggataatcctgagggcagctaattagtgaacttaattccatctccaaccctaatttccctttgccatgtaatgtaacatattcaccggctctaggaatcaggtcatggacagctttggggagccattattatgcctttcgcacaagagtaacaaataatctgatattcctagagcatctctctctatgtctatacggctcaggtagttgaagttgaactccttatatatgttgggtaaggtctccaaagcatgttggacaggagggagagagagacaaagagacagagagagggggaaggaagaaaaagatgggcgggagaatagaggtgaagtgggggtaggaggaggagaaaggaaatcaacaggcagaaataaatagaatctgtgttgttttttatatcccaacctccaaacattctgcagcatcacttgtatcagtttctgtgcattagaagtgagtcactaaagtgagaccaaattcaagggcaaggaattatattgaaagagggtcaaagaacttgcagacatgttttaaaactgcacagtcacttaaaagatttacagtgtcccctgaacagcttttcttggggataacaagtaaataaaacttttttcatgggtctcataaaaggacactgtgtgtgatataaaagatgatggcctcaccaatatctgtacaaaaaaattgtaatgataaaattcatagagatgtttattatagcatttctaggtgctagcaccaaagcatgtttcaggaaaaaaatcattctacaagttgcaaaagcctttattccaagtatacaggtttcaaatggactaaaaagaatataagcaaaaacttaaagatgagaaaaattaacggaatacatatacatcctttaattgatgttccatgaatattgtatattgtaataaaaaatttaaaaagacttaggcatgaaagagatgaggattatatttcttgacaagaataatgaataaaagtaaattgcatggccatataagggcagatctgtaggcttttaaacctagtttggtatttacttcttagatgaaaacacttcagacataaatatatagaaa

SEQ ID NO: 44251 - DNA, 1019 bp, Homo sapiens
aactttttaaatggttatcccactgtgatatctctggaattagatctcccttatttccagataaggagactctctcagtcaatggtgtagtaatgtagtactactgttttgcccacatgagtatataatgtcagaatgtgttttaccttttagcaaaatatagcattgggttcccttcttttgctgtgtcagaacttcaacagtcttttctgtgtaagccctcttttgctgcacttgggagcttttctaacagcctgctatgttctattgttgatgcaatgaatacagcgagatacccacattttgtttaaagatagtcactgagctgtaccctactgccagcctagatgactgcttaattataggcatgcttttctaaaggacatatatttgttatcttccataaacagggagacagtaaaagtcatttggcttaccttcctagggatgaaggttcaggaaggggagcttcattcagtgcttcatgctgttgtcaacactaactttacaggtgacccaggaaattgtgaagtagttggggccgtagaacagacttcgtgccacagcacaaaaaatcttattacttttttttttattccctgtgtactcgctttacaattttagaaacaactgatttttttttttttttttgcaattttgcattagatcaatggttttaaaaatctggccaaacatggaagctcttgggacactgaaaaacacagatttctggaagtcacttcagaacaacttaattggaaacacccaggaatgcagcccagggatcggtaatttgtaaaagcttccctgggacacaaaaagtcttggtcccatttcagaccagttaaatcagaatcccaggggtgatgccctaggatcaggcattctaaaaactctccaggtaactctcatatataaccatggttgaaaactacttctctatactttcttctacctttagaagtcagctttgggagctctattttctgctttagaggatttagcaatgtaaacttagc

SEQ ID NO: 44252 - DNA, 1038 bp, Homo sapiens
aagaacatgagtctcagccatctgttttcatttttctctctccagcagcataagtgctgcagggattgtccctgcatagcaaaggggatgaggatatgcttgtttattattgaaaagtcttaaatgggccccgtgtcagtcagcttagactaacttcttctgtggtaacaccctacccccacatctcaatagcctgcagttaatagaggctggtttcttgctccattatatgttccccatgggttgcatgaggctctgctccatattttttttcctgcagggaataaagctatcaaggtattaatagtctcaggggagatggagaacaaaagcatggtggaacgatgggatggatcttaagcttctactcaaaagtggcatgtattatttccacatacatgtcattggccaaaagaagccgctgcatgaccaagtctgaaatcaacagggtgggcatgtactcacctatccctctgtcagggatgggaaacaaatattttgaacaaggatacactctactaaagtcttttttagagttctcttaaaaatgaattggttttgcacttgtatcaaggtgcatattcaacacacatcgaatgagcatgtaccacaaacagaccacagtagggaatgtgaggctaagtcagaaactctcttttcaaggagctgactgtcaaaagggcctaaaaatacctatgatattttcctgcacagtagtcatgccagcattgctggagaaacccttggaggagagaaatctggagttgggacagcgtgaaactgtatgccttagctagtgatcctgaactaaatttctattagtattactttttagtctcataagtaaaggtatactgttcagggattcatcacatccatctgtcctttaattgttgtcttcatttcagagattgtgtggtcaatatatgtcattatttttaaaatatttgcatgtttgataataaagtattacactgactttgcaagtcactgataaagatagctggcattgccttatttgtcatattacttgggtgc

SEQ ID NO: 44253 - DNA, 1029 bp, Homo sapiens
gtgtcaggaacaagcagtaattatttccatatttaaatgttgatatgaaactaaaatctgtttgctgttttatagagttggaaaatgtttattgaaagaaatattaatgatagatttctattttttaaaaaaagtatctctagttttcttctgcaaagtaatcttgcatgagagtctgaatggttctcctcagcagaactaatcagattttgaaattgatcatcctcctggttgggattcaaatgagaatttgagtgaaaatgattaaatgtttttccttatttagggggctgacagttgttgatattttctttcagaagagtaaattgtgtagtgaaacctgtatatttggggtatggagagcagcaagtcattaactttgggctctgcaactggacatctgggaatcaaagagattttctactttgtttattacacaaataaattatattccctgaccactgtgtgatacctgattttaatatgaagccaggagcagacagtgaaaattgctgcatcccacgctgcttcagctctaggtgtactgatacttccaaagaatacttctgaagcctagatttcaattttacatacatcaaaaagtaaacgactatttaatcttttactgtaacatgaagaggagtgagtaatacatactggaatggagtttagtaggatggaaagccaaaatggaaagattttctatttgagatgaaagtataataagcagtaagctttacaaaaccctggaatatgcttttgaggagaccaatgaacagattagaatttggtttatgtatgggaaagtaaggtgacctttaatggatttctggggccgtcttttgaggattatgtaaatgaagcctgaattctaaatctaatacagctatcattaaaatcaagagaatgtttactgcatgatggtaattgaaatgactcctagctttataatgttcctgagccctagtattctcacatgactttcaaaaaataatgcctattttttattaaaacctgcaacatccttaa

SEQ ID NO: 44254 - DNA, 1098 bp, Homo sapiens
acacctgtaatcccagtactttgggaggccaaggcggttggatcagttgagttcaggagttcgagaccagcctggccaacatggtgaaaccccatctctactaaaaacacaaaaaattagcagtgcatggttgtgcatgcctgtggtcccagctactcaggaggctgagacaggagaatcacttgaacccgggaggtggaggttgcagtgacctgagattgtgccactgtactccagcctgggtgacagagagagattccatctcaaaaaaaaaaaaaaaaaaaaaaaaaaaagtctgaaaacaagctatttaaaatataacagccaaatttttttgctcccattacaatcacagttcttgaaccccattgcctcctagcccttctctccactttcttgcttcccatgatcttttccgtccacgctgattagcctttgatctctgtcattgtgttgaatggttcttatcagtcacttgcacgttgccaaagtctctcaaatttctttgttcttaaagattctatgtacaaatagattttctcttgatattttccgcatttctgttttttgatcgtagccaaaagtactgcaaaactatccttattgctaaaaccaaatacgtgattgcaatcttggccaaaaccagaaatgaaaggaaaaacaggtattggaatgtggaagttaaaaaggcatttgaagaaaaattgagactctgtcacccttttctattgtgatcaagccccattaggaagaacattagaattttggtttccagctgtgtctgtgtagatgaaaactctgtgagccaacttcccttttccaaagtgatctaaatattgttcagagaattctagttagttggcagagaaacaagtatttaggcagaaatatgtccaaaaatgagaagactaaagatatgcatcatgtgcccatgtattttacataggaccaagattaactgggttttgctccgaaccttaagaaagaaggctttttcagcattgctagaaataaatcttgctttaaaagtttattgcaagtgtggtgtttatgaaaagcaaattagtattctataaattctctcaaacacaaagtgat

SEQ ID NO: 44255 - DNA, 1031 bp, Homo sapiens
tacagagttaagaatatatttttgtctcaatgagacctttagtaaggaaataggaaatagctctggactgggagcttctggaattctatggtcatgcctctctgctctttgcattctggcaagtagattcacattttagactcaaatcacttgtaacagccattatatttggaactccccatctcttctttttgtttttcttcctcttttgtgtgagagactgtccccttctctctgctttctttttctgtcttccccactgttctagaagccatgaccctctcgttctaaatagattttgccctgcttccaatgagatgcgaggctgggtatttctatgcatatttttaatttgataggaagtgtagcttacagcttattgtgaatacattaacatctcatcgcttgtgacaagtccttcacacttttcatccctgctattaattttccttttctccacatttaaaaatttttctttagcatttgctccccgaatcaaaaagactagatagggggattaatgatgagacttttctgttatttagcatgatttacaactattgctggcaaccatactaagtagtttcacatataatgtcccctcagccttttaaaaaattgatatcagcttcaatagaagtgatggtattagttactaaagtgacatcatatcaaaatatataaacatggagcattatcaacagaagtgagaacaatttctagaacaaaatgtagagtttggtaaatctaaagcagataacaaaagaaattgtttcattctctacaataaatttgaactgtggattacagaagtaaacatttacaggaaattgggacacagagggagtgggagaaggaaaatcatatgacttttgtctctcccctacctggagtttcatcatttccaactctgcaaaattggctcaagatgcgaatagtaaaggcaggtatgtgcatgcatgaatgaaggaaggtatcctccagcaaatttgcctttcaaaaaagttgcctgaatataggcccaaactcag

SEQ ID NO: 44256 - DNA, 1047 bp, Homo sapiens
attgattacaagtttatattcaatactctagtcccatgccattaacaaatttaggatcagtgaattttagtcattatggggcttttaaagactatcaaattagttacctgccattatttctattttatctttttatctacacagtagtaaacaaactagagagttactttaatcattaaattaaggcagactaaccagtaggaagtaaattgcctcgattagagcacttcatctaaattcagatgtgaattcaaattccttcattttgcctctaaagctcagtcttaaccactaagttctactttctctcaaatgtttatttttaaaacagcaccacacaccttggtatcttctcagaaaggtgtttcctccaactgtataggtgcactgccttttttgttattattgttgggtgtttctcttcctttgataataaagtttcactcagatgaaattataaggcagttgagtattgtggaaggaataaaataaaaactgttttctaggcctagttttgctatgtgagagtaatcacatcgctctctgaatcttagtttctcacaaaatatgcactaaatttttactcttgttttcaagttgattgttaatgtcctgtgaaattgtagagattttgtgtgggattgccattataaagaaatttgtttattagagaaaaattatttttgttattgttcaaaatttatatagtaaaatgtatgtcatgtatacccatatatttaatggatgctgtcttttagagtggttttagagtggattctgatattttcagattctcaaatctgatattttgagattttcaaactggcaaaaatcctcttattatcattatagaaataactatagatttttttaaaaggaggggcaattttattttatgtccttgtcatgtttaagaacttttatttttacccagcaagcattaatgcagatcataaacaaatcatgtgctgtttccattcctctggatatagggctcagatgagtcctttagatgacaatataggccttgtaataaagttctctcag

SEQ ID NO: 44257 - DNA, 1089 bp, Homo sapiens
tctgtaaagctctgtttgtggtgctgaaacctctcatgatgtatgagcatgtctggctgataaattctaacgtcagcctctgtgtgatagtgattcatcgggttgtaaaatttgtgtttgagaaacacgttgaattagcaagtttcatattttggttgtgttaaaatcaactcaatttaccctcttgttttaagaaattcttaacaattgccttccacattgtcaaaaacagctaggatttaactggaaactgtccatgctatcacaaaataaatgtctaatattaacaaataaattgatatgactacagtgctggaaatgtttataggccagtgagatgttgatattatgcagaaagctattgtaagaaaagttaaaagttgcttatgagcagacacagtagcaattaacatgaaagctttgtaactttgagagataaacaatttgcctataaaaactgtggtattttattgtctcagaatgtttgctttgtacaaaaatacttctatttttgcaggactgtgggggtttgtttgtaaaaatgactgaaatcctcaaaaatcttaattctctttttttttaagtgaaatccgtatattccctatataagatttttaaatgactactaatgtacttggcacttcaattcaatgatttgtaatcttttaagctgtgggtttccagtgccttaaatatatttttagaggactggactaaaaaattaaattcttaattgtttcttttactttaaaatagtttcagaagcttttcctttagttaacatcattcctcttaaatttgtgtcaaactctgaaagtatctgaattgtgtcatttttatattggagtgagctaaataaaagaaatttcagaaagtcgaacctgttaaacttctactactaatgctatatgttttatggtgtaattttaaaatcttagtgttggactgaaacatgttgtttccttgccatgtttcaatatagtaaattattaagttatttgcttgttacttcagtgaagctccttaactgttttgaatcagagagagatttgaaaattatacctagagcataagtcataatgaaatttg

SEQ ID NO: 44258 - DNA, 1045 bp, Homo sapiens
agtgagctgagatcatgccactgcactccagcctgggcaacagagcaagactccgtctcaaaaaaaaaaaaaattgtagggtgacatataagcaactgacctactatttactatataatggtaatgtctgtcagtcacatcattgggaggtttgagggctgtaggaggataacaggatgggcactgaagccatcttttattctgagataagaggtctttgatgataccttgaaagtgtgggcagctctagtctggattaagagtgaaatagtggagtcaagagataatattataaagtttgtcaaaggcagaatgacaggcttttgtaatagtgtatttgggagacagggagaatatgaggccttcttttttgtatgttcttgattttgtataataagcatatgttaattctgcaataaaatatactaagttattaacatgtaaaaattatttcatatttgaaatggtgtattttaaaataataatgtggcatcatgatggtaatgttgggatttcaagtcaagaactttggaagaggtttaatattaaaattattttctgaagccagagtatttaaagatcacagggttagcttttcccaatacagtaaaaatctttattgataaggcccatcacttctaagaaagacacagctctgtcacagtgctcactttggaggaatggaaagactcagtgggattgcagatttgtctgaaaatatttttattcagtttctccttccttatgaccaataattcatcaaggtaggttagcatggataataaattaaatcccaggcataatatgtatgagtatgtcttatatcttaaaaagtactttatagatatgtaatcagtagagtgttataatatcctcatatttgattttagtttcaaaatcaggggccattggtctcatagatattatggtgttttatatcttctggtttcagtaaagctaaaactggattcatttttttccagaatgagatgacagtttgtgccgaattacttacatgttctacctgatattctgagtattcaca

SEQ ID NO: 44259 - DNA, 1034 bp, Homo sapiens
tttataagcaaaggaaaatggattgctaagaaataaatatttgtgaaatgacccaaggtgagttttaaaaaatgtgtttggatagagcatttctactttattttcttaaaaatccaaaattgttggtctttcacggggaacatctcagtgcttttaggataacacctgttgttatggatttatttttggaatttttgacctcaagtgtgaatgctgcatagccttgtgtcatgagtgtttacctcgcttatttagcctggcgcagaggttgggggttgggggtaggattcctcagatatgtattcagaaaattaaattacttcttagtagttataacatcacaattgcatttaatatttatacagtatcataattatctgtcacctctttttgaaatccatgcttttgttttcttctcattgtgtaataaaatggcagtttccaaagatggatgtctttagtttttaaatgacatgttgatttttttcatgatatctgcaaatatttttgtcttttttgacctcagaacaaatgtaaagcattgattggagcacacacaaaagttaggaaatatgctgcttggcaactgagtaaaagtaaatatatagtctcttaaacttccaaaaaagtatacaatagtacaggatgggttctattcacaagctttctgtctgtaacgtaaaagatatcactatctaaaaataaaatcagaatgatgaatttcagtgacaacaataaaagttttgggaccgtgagagttgttcatctaattgagggcactgccttttcttgtcctcaggtataggatattgctccattttaagccattgagggagaagggctttgtatttaaattgcaagctaataaatagtctttttctcattaacacacatgacctttatgatatgtgctctcatgcatactggcccaatttctcagtctctgttaatgatgtttggaacctctgtttaacatgaattattttctacctgaatccctgtaaattcacgataggtgttaattgtagtgatct

SEQ ID NO: 44260 - DNA, 1022 bp, Homo sapiens
tcatctagggtacatgctgttcctattgtatcttcttacttacttggcagtccattggaacaaattgttgattttattatcaaatccattatcattctgaacttcttactatctctgctgctgcttggcctacccagaccagagcaatggccttttgtttggtctccgataattaattcttcctaatagagccagtgagttaaatatctagatgacattgttttcatttaaataggtaatagacatacaaagataaaattgaaaaggcacaacagcctatacagtgacaagtaagtctccttcctgcttctgtcctccagccatggttcctctctacagaggcaactacacatattcccttttgacttatgtgcatatgttcacaaagctgcttcttgctagatgaagatccaaatccttagtatatttcatatacttgcatgagtatatgtcttcagttgtatttctcagcatattctctagtttcctctcctccagccacactgtacctagacatattcttttgttgtagatcctaccttgcttttcccaaactctacacaacatatgcacatttctaccctgaaggttcttcctccttctttgcacctatttagctcaactctcccaggttagacaatatcttctcagagaaatcctccctgaacctacagttcagatcaggcccctttaagacaatattcatgttttgctttcataacatttatcacagtttgtatttatatatttaatgatcatttgcttaatgtctttctcctttgcaagactgttagtaacattagggcctgtgtgttgctcgacattgtttactcagtactggcacataaatagttaagaaacatctattgaataaatgctcaagaatcctcatttgcttgtgggaggtatctctttcattgtaatccattcacttatttcttgtctactgttttttatatggccagtctcctagaatttctgtcccccgtggatttaatatgttttaactcagcaactcttaa

SEQ ID NO: 44261 - DNA, 1037 bp, Homo sapiens
aataatttatttatcaataaatataaaaactactggtatgaccttacttttggtttggtttgcaatcattgattttctgattttgatataaacaattttagtgtgttaaccagagcagaccgtcatttggactaacattagccatctaacagttattaaacacaagtggtaactcacacatactcacatattacggagttcagcatcagaattctatttaaagcatatcgtaatataattttttttaaatgttggatactttatttgaagtggagacattttagtttgtcaggttgtcttaaaaattgtcctgtcaataaaattatttataatgaaatgaataaattgcttctttgcagtagacatttcattcattaggatcaaaaaccttgtagataatgaatgtcctgaagtctgttcgctactattttgagcaaattggtatttaatactgttactccatacaatacacttgtttagcatacttattattcacatccttgaattttgaggaatgtgctctgaagcatttgtgaaatttgaatataccatgataggatacctaaaacattcatcattactgaaggttattttgggtatctttttcgtttcctgatttgctatttttttaaccataactgagtaatcagttttatcagatacttttttctatatctattgagataattataattttttcttatagaatgttgatatagtaaatgacatttatagttcctttaattataatccccttgtagtcctaaaagttagcttagtcaaacagtagaaatgtttttatgtatcactggattttatttttatagcattttgttcgggatatttacatatacatacatgagtaagagggcatattattttttgttctattgtcattttctgttttgtcgtcaaagctatattgacttcatagagttgggaaataaatcactcctcccttccatgcccttctccctcattctctagaaaagtataagattgaaatgctttggatattgaaagtctgataaaacttg

SEQ ID NO: 44262 - DNA, 1033 bp, Homo sapiens
atggtggcattacctctgagtggcagtgtctggggtctgctgtaggtaacaacagaagtcaggtttctgttgcacttgtgacatttatagcaaacttcctttccacagtgttttttgaccaactttgaggtggggtgggaagaactgcttttgtagtactggttgctacaactgcttctaatgatctctaagtagtagtgagaccagaagctctagagaagaaaaaggcaagggaagttcctttcaatgcttgagagagaaaatggattgcatccttgtttaatagaatatggagaaattgaatataattgtcactgacttcaaattatcaatatatatgtactttggaatactacacacaattcattctgtacaacataatttttgtaaatgatgatacctttcagggtgtcattttagatggaaattggcaccttaaatattttaaggtgaagattaaagaatatagaataacatttgcttattgactcatttccattattttcccccctatttctctttgattcttatgatataattataatttttctctagagcaccctggagtattctttgattcttcatagctgctcatatatctctaataaagtagtaaaccatagtatgaaaaaattatatttcattgaatataaaatataataactactacttatggatactttctatttccataaatgagctggataacttatattgtccctattattgtgacgacagtgcaaactaggtgttattatttccattttataaatgcagaaaatgagaccaagagaaattaaataacttcccaagttcttacaaatgtacctaacaactggcacaactgggttttaaaaagccgttatcagttaaattccagagtgtatgttctttcttttatgcctgaaatatttgtcttttgttttatgtcagatatttcacagggattcatagtttcttgattgaggcattttgcccctttgagttaaagggtctcgatgaactacaaatatgccttgtggaagacttaaca

SEQ ID NO: 44263 - DNA, 1490 bp, Homo sapiens
agaaataaacaaattgtgctctctaagttgtcatcacagattcttataatgctatcagttttaaactataaacatggaggcagcacccatgggagtaagatattgaacgtttacagcatgtgtacataagttacctcaaaggataattagatgattataatgacactttctttgagatagctaattttaaaaatctattgctcccaagtctaattatttgagtaatgataacatattagcaatcatgaaacttcagtcacagccaaccccattgaagaaaaaaaagtaaatcatagcattttctataaagacccaaaggattgcaccagaccaatccttgcattttctgctgtgtattctatgcccagcctcccatccgtgtgtactctaaactacctacacatgtatcattcatgtgatttcactctatttgttttcatttgttttataactcttcctttggtaccagggagataattttctagttcttctccatcctttgtgaacctctgaaagaaggcttttataattagacttcatagctttaacaaacatttcataacctgccagtaaaaatgtcagttctctgggccagggcataattaaatgagtaagtatcagtgtggtaattcagccacaaaataaaataatttaaagggtctattaattaagggcttgctttgattttggaattctaatcaacagtaagctctgtatgttatgggtaaaaatcttcttgctttcaccgttcccttttcttggcctattacaaatagtaaataaaataattgtatcaatgaaattttcactttgttgttcttttttgaatgattatgcacctgagagaatgttgttaaaatagcaacatattggatatggtcaaaatgaacattttgctatgagcctttaaaaccaaacctgagtaatacaagcaatatataaacggtatagtagactctgtttgagtccattaggtcctgactgaagactgaaaaaacagtaaaagtggaatcctggaagctaataatagtttgtttggtagggggtcttttgaactgagagcagtaggaggaagacaaatgtgtgaaatgatgggcaatataatgatagggtacagcgaggatggattaactattggtagctcttgtaacaaagaaagaaaagctaattttgtagacaaacaaaaaggctggtagagtaaaattaatattttagaatagaaaacctctatctttgagctgggtgtggtggctcatgcctgtaatcccagcactttgggaggctgaggagggcagatcacgagatcaggagattgagactatcctggccaacatggtgaaaccttgtctctactaaaaatatgaaaattagctggacatggcggcgcgcacctgtagtcccagctactcaggaggctgaggcagtagaatcgcttgaacccggaaggctgaggttgcagtgagggattgtgccactgcactccagcctga

SEQ ID NO: 44264 - DNA, 1032 bp, Homo sapiens
ttgtttttgtaagctctagagccagaatttgcatctgtctctgtctagttccagagcatatgtattttcatctttgcgtatttcttgttgttgtacaagaataaaatttttacaaagcaaatcatactttatgttcaatacatagaagacagtggtgaatgtgtttttaaagtgaccttttttgggtaaagatctattttaacttcaaattattttatattatatattcctcaaacgagtcacatccatagtgacttggagtgtattttcagatgctttaaatatatgtaatcttattgataatattcagaagcattttaaattaatagttttttgaaagtaagatttaaacgtaaattaagcacaattgaaacataatacaatatttaccattcgaacagtaactaagttactgttatcttaaaggttttccgagaaggatacggccatgacagtgtagcatttacatgtgttctgagtgttcatttattataactgtaccacctgtagttttagatgctctgtggtttgcattttaaaagcatttggtgtttatagcacctgtctttctaagacatggcctgactaggtctgatgtctagtgtgatgttaaaaaaatcacattaagtgtgacttaagtatgggggttagagtgggaatgaaaatgaaaatgtttaatttttctgacaccagactagtatgcttcagggagaaatttagcaaaggtaattgggcagactaccaatataaattaggtcaatagcctagacctacaagtgctagcctttataacatacttgaccgcaacaaaaatctgttaaaagaaaatgggactgtccctaacatgaagtaatgggactgtcgtagatacaacacatggtacactttttccttttaattaccatatgagaacaaaatcagtttttgcagctggttcttcttcgttttatttgccttgactacatctcacaccgaaggggtttgaaacatgacagacaacaggtgtgaatatgtatctaataattgactgca

SEQ ID NO: 44265 - DNA, 1032 bp, Homo sapiens
agtaaaattaaaaaatgcttttcttcataaaaccagtattttaaatggtattaatatatattagccatcgtgtagaagatatataaatatgcatgaacaatatggatggtaattagtgattaaggccctactaccttgtgaacatattttatattttacccttgatcttcttgttttcaatcaattcacctttttttcttctcaagtatgtacattgtactctgtgatcacccacacatgaggggtgacatgttaactaatcttttaatgtattgctccaaatatcttcatcattgagatttgtggtagcaggaagcataatggaacaactcttagttatcattattttgttgatgtttcaagagtttctttattaacctttgtgttaagttgtggggtttagtaattacatatcattgtgctaggaaaacatgccttgcttaattattaaatcaaatatcctttagagaaaggtgttttaaccatgtgttctcactcataagtggagttgaacaatgaaaacacatagacacagggaggggaacatcacacaccgaggcctgttgggggctggggggctgggggagggatagtgttaggagaaatacctaatgtaaattacgagttgctgggtgcagcaaagcaactggcacatgtatacctatgtaacaaacctgcactttatgcacatgtaccctagaacttaaagtatagtaattaaaaaaaagaaaaagaaaaaggtgtttaaaagatgtataggccgtatattttgtaccagtgtaatcattcactgtgttgtttaagcaaataagctagtttaagcttataatgagtttttaatttatagagaaacgaatcagtagggcaaagaaaggtgcaaaatcttggaagaatttgccttgtataataatggaagactcacatgagtaaaatccctactgaactagcttttgttggactaaagaatgcaattatattaaaaattaatacttcagtctaatacaaatccaatgctgcctgaattattatgtg

SEQ ID NO: 44266 - DNA, 1041 bp, Homo sapiens
cgggccttgactttgctttcttcatctgaatgaggctgtgaccttgctcatgctgagcttgattcaagaaataggagagctgctgtttgtaaacattcctttaaatggaagcatgtctattgcatcataagttctttctggctaagtgattttaactatgtgtataagagggcagtggcatgacaaaaatgtggcaatttcacatgtctggcaggaaaatgccgtagtcttagctatttaactggggacttagtctaattttacagtgggtgtatgtaagttcagttaggcctcaattttatagatgagggaaatgcactttatggaagaaaagtaacttgcctaaactgatgttcttagtgccagagctggagatagaacctagatcccttttttttttttttttttgggagacatagtcttgctctgttgccaaggctggagtgcaatagtgcgatcttggctcgctgcaacctctgtctcctgggttcaagcgattctcctgtctcagccaccccagtagctgggattacaggcatatgccaccatgcctggctaattactgtatttttaatagggacagggtttcaccatgttggccaggctggtcttcaactcctgacctcaagtgatccacccacctcagcctctcaaagtgctgggattacaggtgtgagccaccgtgcctggctccctggtttcttttaatgacagtgttagatttcagtcatttttatattcattcatgtgtttatgcatttagtgaattagttattacttatgtttgtagagatacagcagtcactgttctcataaatattacattatattcaaggaagacagacaataaactaagtaagtaaaatatgctttaatatatgtttaaacatgtttaaagtatgttaggttgtggtaagtgctatttcaaaaatcaactctaaaagaggcatgcccccatgtgtgagagcaggctgctgtgattttaggatagattggttagggaaggcctcactgacttgggtaatcagtcattaacccagt

SEQ ID NO: 44267 - DNA, 1145 bp, Homo sapiens
atgagcaaaagccctgagggaggataaaatgagaagtggttgaaggccagcatagttaggtgggagagtttacacaagataatcctgaagagatatagtaagggctttatcttggaggttatgggaagccacattaaggattttagactttgtctaaaagatataagaagtcattggagaattttaatgtcatcatgtttatgttttataacagttattctgtctgcattacagaaaacagatcgggtggggaaaaagtagaaatggagtgtttgtatttatctgattaggaggctgttgctgtggtccaagcatgagatgactctggtttagattagtgtggtaatagagatgaagtagacaggttggaaacatgtgtaggaatagaatgtgaccagagagagaaagtagttaagaatgacttctaagcttgaacaacttgagcaacttgcttcatggtggtgtcatttttttctgagataggttttaggtaatgtagggcatttgtacttagggactctccaagatatccagatggtcaattggatagataagcctgatcctgagaggtggatttggagtcatggcaggcatctgtgtggatgtagttacctgggccactgattgtcaaaatgtggtcccgtgaccagcaacatcagcatcacttggatgtttggaatttagacatggacttacttaggccccaaccttgacctactctatatcagaaactctgaatgtgaggcccaacaatctgtgttaataagccttccctgtggttctgatgtacactgaagcttgagaaccactggccaaagcagtgaaatacagcatgagggcataagtgtaatttacattattttactccaaaagcagtcttaatttgtgatgaattttatgttattcagcttttgtccattcttccattgggtgtgtatattaatccattctcacagtactataaaggactgcccaagactgggtaaattataaaggaagaggtttaattgattcaccgttcagcatggctggggaggcctcaggaaacttacaatcatgatggaaagggaagcaaacacgtccttcctcatatggcaacaggaaggagaagtgccaagcaaaagggggaaaaaccccttataaaa

SEQ ID NO: 44268 - DNA, 1029 bp, Homo sapiens
acagctgacattatacttaatggggaaaagttgaaagtattaagaaataagaggcatctaaattggaaatgaggaagtcaaattatccctgtttgctgatgatatgatcttatacctagaaaacccggcagactccactgaacaactcttagaattgatcaatggattcagtaaagtttcaggatacaaaattaatatacaggaatcagcagcatttctttataccaataacaatctagctgaggaccaagtcaagaagacaatcccatttacaatagctattaaaaaatgcctaggaatatatttaatcaaggaagtgaaagatctctatatgtagaactacaaaacactgatgaaagaaatcatagataacacaaacaaacggaaaaacattccattctcacagattggaagaatcattatcattaaatctaccgattcagtgcaatccctataaaattgtatgttaaaacttaattgtgttaccttgtgaataactcatgcacacctcccacactgaataagttgtatctgatttgttagaagtgaattttgtattattacattttcagtataattactgtctttccttcaccagtcccccacaactgtttttggagtgtgaattacttgtaggaagtagcccaagtatagaaatgctagttgggggaacagtaattctggttcaaaaccattaggaattcaattcagaacataaactttctttttaacaagctaattctcctcggaaatatttgagtttgttggtagaaatgtttgtgtgagagtgctttgctgttatttgtagagaagcatttgggccaagtctcttatctcattagcgtccctccacctcttatgagtgggcaatgtggtctcattgacttacaggcactgacctgtattccttgtctctgtgagcagatcctctgggagcctccatgggattcctatgaatatgcacagtgcaattgcatttttctcaacatgaaagaattcaaatagtctggaaacttgccaactttaatt

SEQ ID NO: 44269 - DNA, 1025 bp, Homo sapiens
ccattttcatactcaataccttgagaaaaatattgccaatttaaagtatattttgtttgtttattttttttttttggtgtggattcttgattttgtggaacaaaagactgtaagttacatctgtatccatgatattagtgccatcctttgccctccatccatggtgcctttacaaatcagttatggtgtttaatacaaaagcctttatggtggctttacgtagcagttatgatgcttaataccacagtcaaaatcagggtttgcagatgttttcctgattgcttagtaaatacttctgagcaggtaaagcaggaatatgtacgtttagagattcattttgtatcgtaatggcttggcacacttaagtgagcaggatatatgctccttcttatttttcttcccatgtagagaaaagtaaggttgtttcttatgctggtatcattaatttattaccacagacaggattgaggtgggctttaaagaacattgtttctgatatctaattattggctgtaagaatggtttcatagcaccttctctaaaatcaattgcagagatcctctgatattttatggttcatagtaacaaccccatggagcaagtcatctcacttctctagggagagcacattttgcagccagtttatcttgaaacattgcctaatttgaattattctaagggtgtcttatcaaatgttttcttttacagcatggtgattgggaatgcctgccttggaaagtgtgtatccctaaatcattctgactaggctctacatctctgggacctcagtcacccactgatgggtgtgttaaagaggatccatgaccattttctgagagaaatcatggccttcctttgcttaggagtggggtactctccacatgctgctgttttgttttcatgaagtaatgcaaacctggttgttaatctgctaattctctaagttcaatatgcccttaattgacaacagagaatatttatattcctgttttttctcggagaccacaatctcaaactctatgcca

SEQ ID NO: 44270 - DNA, 1045 bp, Homo sapiens
gcatcatatttttgcaagatgtcactactatgacaatgtggctagagagtacatgggatctctatgtattatttcttacaactgcatgtgaatctacaattatctcaaaataaaaaaaatttaattaaagaaaaaccctttactcattattttggctgattagtagacaacatatgacttccagccctagtgattttgatttaactggtggggtccgtgtctgtacttttagaaagatcttcaggtgggtctgctatgcaaacagaattgaggacctcagcaaagctgcaaacaaatctctgcacttaaaagtacaggatgttatccaggagtgttttaggttgtgtgtgatacttgttacaggcatttgactctgtaagtctgtgacctgatcccagaggaccagtatcacttactcaactaagaacctcttaactgagaatgtcagagatacttatatgtctatagatgtcttaatattttttccttcaaaataagttttactgtaattccactccacttctctagggtctatccagcttttatttcagatacctgttgaaataattactttccttacttgtagttactgcaatttcgtcagcaaggatgcagcccttgttcatttgtgcttgtatattgccgttagtccttttgttctcttttctttttaaaatgggccctggctagacaataaattctatgtgtaaacagaccatatgcaagtatctttgcatggtagctgcagaatccttcctattaaaaaaaaaagacaaattcacacatgagattcctcttttgtgtgcatgttgcttatgatcagaaactacagtaaactgttatctcattaataagtttaatattttatttttcaaaagatccactttgtgtcctttttaagtagataatcacgcatttctttttttttttttttttctgcttcagctacctttaaagaattatctgggaaaaccccactaataatagttttgtatttgcttctgaaaatgacaaactcttgtttgatttttctaatggccactga

SEQ ID NO: 44271 - DNA, 1027 bp, Homo sapiens
tgaaacacagaaatagcctacacagatgtggccaacttaatttttgacaaaggagccaaatagttcaatggaggaaggttagaaatttcaacaaatgatgctggagaaactggacattcacaggtaaaataatgaaccttgacctaaacctcataccttctacaaaaattagctcaaaatggatcattggcttaaatacaaaatatgaaagtatacaacttttagaaaaaaataggttaaaatctttaggatctagggctaggcaatcagttcttagacttgacactgaaagcatgatccatagaaggaaagattgataaattgggccttatttgttctgtgtaagactcttgttaagagagaatggaaagacaaagctgcaggcttggagaaaatatttgcaaaccatatctcctgccaaaaaaaaaaacaaaacaaacaaacccccagtgtctagaatatataaataactcttaaaacctaactgcaaaaaataaacaattcaattaggaaatgaacaaaagacaagaagaaactttttaccaaagaagatatacagatgacaaataagtacaatgaaaagacgtacaacatcattaggcattagagagatgtaaattaaaatcacaataagttattactacacacctatcagaatgactaaaataagaaagtaacaacatcaagtgctggtgaggatgtgaggaaactggatcactcataatattgctgataggatacacaaaattgtacagccactctggaaaaaaaacagtgtggcagtttcctatgaacctaaacatgcaattaccatacgacccagcaattgcactcttgtgtatttatctgagagtgatgaaaacttatgttccaacaaaaacctgtacatgaatgtttgtagcaactttattggtgggcccaaactggcaacatcctgaatgttctgcaactgtcagtggtgaaattaattgtacacatatatacctagaatcctactcagcaatggaaaggtatgatacatgaaata

SEQ ID NO: 44272 - DNA, 1029 bp, Homo sapiens
gtgcagtggtgatctcgactcactgcaacctccacctcccgggttcaagcgattctcctgcctcagccccgcgagtagctgggattacaggcacacaccaccatgcccagctagtttttgtatttttagtagagttgggatttccccatgttggccaggatggtcttgaactcctaacctcaggtgatccacccgccttggcctcccaaagtgctgggattacaggtgtgagccaccgtgcccggccagaatgttattaatgcacaaaataaatgcataggattgtaaaggaaataaactaaattgaaatagtgccatcaaaatattttaaaatctctaaaatagtaatacatgaatagtaatagtaatgggatgcggcattacttctaacaggtactataattttggagttagtgatgagtgtaacaatatttcaaaatatatattatttctgtcggtcacaagtacaacaaatactactgtgatttgttgtctgcattcttaataaagggaaatttaaacttttagctaattgttagtgaaaataagcatatgatctttttttcatccaaatacatgaatcatattccctatattgtatctattgaacttttcggtggggtttaaaacctctaacatagtggaaagacaagactgagtgaatctatgtgaaaaagtatcaattctttgaccagggagataccacatagtaaatgaatacttctgatatactaaatggttccttatggacctttgggagcaaaattattttgagcacacactctgttttcttccatttcgttaactggtttgagctcatttacttataatactcatccaaactggccatataacatttaaaatttttgtttatttccaaaaaattgatttcttgcaatcatcttcactaattgcctggcatagaattcttactagtgtgtttccacgtgtactgtttgttgtacatttgtcagctcactcaaataaaactgcaaataatgaaaacaattgtattttctccagtacatc

SEQ ID NO: 44273 - DNA, 1028 bp, Homo sapiens
gacagtataggctctgttgagcaataacagagcattcccagtggcacctgtagaagtttttccaggagctcagcaattactgcaggcttgtgggctccagcctagtggggtagcaccctcactttggtttgaaaccctgtttttgttttgtgccttcaagtatttatttcttccttttttttctaaccccttcaacaactgtataatcagtttctggtattaaatttcctattctggaaatgtctatagtagtttctgctttctttagtgaacaataaccaggagtggttttaggagacagaatttcaaagatgagaatttgagattggttatctgaccatactgcaattgaacacaatagtatatcattgccagtggaaaattgccgttccatgcagggtcagctcagttacttaatgtatcacctttcttatcagaaatgaagtgtttactaaagtcaaagttttgggaaatcaaatggaagttgtaattgactgttatggattgaataatgactcctgttggctgtttttgactacactagaaggtttatagaaaggaaattatgggttcaggacttctctcagttcaaggatagtcacgtaaacagagatctatgatcccctccccactcccactgccaacacaaattgtcttgtcttttatcattgcagtaatgatgcagctgaaaataagaaccaaacttcagttctgagaattatagaatcacagtacaagttgaattcacagcctcactagctttcttatatggaagataagacatgaatggtagacatggatcatgataattgaaatgaatatatttatgtgagtgaactcacctaaatctcagagccttgaactccagtttcctctatgcttcatctgcagtttccccagtgctttattgtggaaccaacctcttcttctttctctaaggagattaaattccctcttcttgaagagtctgtaatggccatagtgacttcagtcttgcatgaaaatatcccaaagccttagggagatag

SEQ ID NO: 44274 - DNA, 1075 bp, Homo sapiens
atgtgtcacctggagaaactggagaagtctaacaatgttttcttgaggattacacctgaatcaaactcaattgctttagtgttctggatgaggaatggtggtgcctagtactgagagaatatgagtaactgagtaatttcaaattgtttggcattgttgggtaccacagtgggagtggtaagagttcagtgtgagcagcaaccagtcagattatcaagggccttgtaaacagtgttaaagagtttggacttgatctgagggtagtgggttgttcctaaaatgttttagaaagattattcagattgtgttttagaatttatgggttgtaggccagagaaagggaaaccagttaggaaactgataaaatcacctaggtcagaaattatatgggctgaagcaaatgctgaggaagtgagagagaaatgaatagttgcatgagtgaacaagaatttggactgtaagaatgggaagaggcagagtggctcctcagcttctgatttgagtaagaaggtggatggatggtggtgaagccattgactgaggtgaatggagaaacacaagaaggtgtagtttgggatttcatagaattagcttctgtcttggtaggacagtgtgaccacatgttctgtgacctaacagtgtgcagcctgggtatgatctattgttgaagcctcacttgacttatggctggggatcaatgacttttcctctctttctgtgtatatatatcttcccacgatggaggctgatgtggggatgaagattttttttaaagtggttttaatgcacagaaatatacagtaatgaatagttaacaagggaagaaagagctccagttaatagtactaagttaaaaataaaagagaaaaatagaaataatttttatataaagtcattgttacgacctcccatggaatgtggcagccgaaatattaactattagttatcccctaggaggccttgggcattacctggaaatgggccctgaaggtgtattttcagccaatgttctggtcttcctttaatctgtttgtttcctgtttcatactatatgttatgctaacattctaaaaaa

SEQ ID NO: 44275 - DNA, 1046 bp, Homo sapiens
ttgccactgttcttgccagtgtcttgccatttgtttgtgtgagagggtggaattttttatcaccttaattgtttgggtccttattttcaattttctttttatgctaggtttttgtttatctgtatgttgggatggcttaacatttctagttcaagagcaccctctcctgttattgtaagcaaagtattgtttctttactggatggcatggttttcaaatggcatatgccttccaatttttaaattttcttttgttttatgtaattcgaaatgttctcccctttttctctctctaatgtatagtttccaaagaaacctctcctgttgttttagctgtcttttctctccaaagtgacgcctttgcaaggtggcttgtcatgtcccatgtgcgttttcaagtctcctttctgttatcagtgttctgagctaactgttcacttttcagtatatatagggccaagggctgagtttctttctgtttctagcagtggttttaaatcatggttcaacctgcccttaactcctctctgctctcgtttgtgtagtttctcctgaactgctcttggtctccatgaaggctactggcaggagcacatgagagaggtaggtaggtcttgatgtttatatttatatttacaagtactttgaagtttggagtttccttgttttctagttatgttgagatagggtgtgtagttttaattcttctccttctcttttttttcctcttcctgtttctgtttcttttcaggatattttggtactttcaaatttatacctctgccacagcttcagctgcctagaatcctctctattaatgcattcttaatagcgctcaacatcctgcagcaacttaaatgtttcgtatcttggcttattatgaatttgaatactgaataacatgattgtacatgaaagcttttcaaaagatgtgacgatcttttaaattattgtaggctttatgagacacctagtctgagcaggttaggaaaaagtagattctgagatcttaccaaggtcttactaatgtaaaaatcaatggctttt

SEQ ID NO: 44276 - DNA, 1936 bp, Homo sapiens
aagttgccctgaatcgtaatctatccttttatgtgtgttttaactctccaactggattatgtgcagaggcagtcctttttatttctttgtatctctggtaaacctcatagaggccttcacatgacagatttttagtgaatgtttgttgatgctgttgctggttttgcttctgctaatgttgatggaaaagaaggaaaatctaatcctgaatgtatggtacttagtttttctgtttgccttgggtaactaagacactctaggtttaactaatttgaggtcagacttggttcaccttgctgaatggttgattcatttatttgtcagcctacctgcccattcaactgtccatacatctgcccatgtatggtacttagtttctctgtttaccttgggtaactaagacactctaggtttaactaatttgaggtcagacttggctcatcttgctgaatggttgattcttttatttgtcagcctacctgcccattcaactgtccatccatctgcccattcattggtccatttcatccatccatccatccatccatccatccatccatccatccatccatccttccatccaaataacttaattaataccttcagttagatactgcaaaatatgtgctgggagccatggaagatagaaaaaaagtaattaatggggtgattatggcataatttctattattggctattcttaaataatttttatatcttcaaataactttaaaagataggcaaatcaatatctatttgtgtttctaagttaaaataaactatttagtgtattactttttataattctctgctttttttaaaaaaagaaaacccagacatttcatttagctgacagctgtggatgttcgttgcattagatagattttttatcttaatatagaaatcttactgaaccaagaaagttttgcagaatttctgaaggccgaatattcagacttaaataataacaatgtaggcttgcttttcattaacttgattaaaatttaaagttggagttgagaaaagattggaacaattgacattaaatatatatgatgcttatgaatctgtgtttggcactattttcacttatttggtttaccttatcaagactagtttctgttaagccactttaccttattcagtataaataagactgagtaccaaaattctaaaaaaaaaaaaaagtctacttctgagaaaggcaacttgattaatcaataatgtaaacatgaattcattttgggtaaaattaatttagcagaaagatctgatcaatactataaaataagtgtgctttattatgaagataattgaagagagaactttcattgagaaagagcaagaaattatataacaaaataggcagaatgaaacatgaatgcatgaatatgaaagagaacttattagaaactgtggaattgaaaaatgtaattgaaattaaaacactactgtagacaagataaactctagaaaatttactgttagagataatttttaagctgaaagatagtattgagagatccaccccaaatcaaagatagataaaacatataaaaatatggttgagactacaagttaggttgagaagtgtcatcataactaaaagtatctaaaacattttaaacacataatatttttatttctttatcttccattcactttaaaataaggcctggtgtggtggctcacacctgtaatcccagcactttgggaggctgaggtgggtgggttgcttgagctcaggagttcaagaccagcctgggcaacatagtgggaccctgtctctacaaaaaacttaaaaaaaaaaaaaatagccggcctggcggcacacacctgtagtctcagctagttggggggctgaggcaggaggatttcttcctgggagtttgaggctgcagtgagccaacattgtgcctctgccctccagcctgga

SEQ ID NO: 44277 - DNA, 1025 bp, Homo sapiens
ctgaacatgttgaatgagtcaaatttactagcctaaaaggaatctgagtctgttaatctactttatagctgattgtattttattcaatatgaagttttctgtgtatatatatatggtgtatgtttaattttctaaatttaaatttaatgtttaaattaaataaaatagaaaattagtttaattttctaaattctgcctatgtggaaccccatgtcgcttaattattgccctttggagtttgtttttcagataatcatatactcatgaaagcaaatattttaagaatcattaagttttctaacagaattagactttgtattttcagatacatgtaattaaagacctattgggaggaaaataacttaaagagcactattaataaagcttaaacacaaacctttgaaatatgaagcaaaatcaaaatagactaattgtatgttctccttagttaaaaaaatagcttcaaatatgtttggatcattgctcagagagtagaaaataaattacatttgatatagaggtgaacatttaaaagattactcatgaacaacatttctgtacatcttatgagtgaccagaaggtttttctattctattttttccctgtttttttattgtttttctgttttgagtagaagttttcaaaattgctcttaaaactggtgggtatttatgagaataactgaagaagagaaattttgaaaaaatatctgaaattactaattaagaggatatacacagattctatacattaagtaataaagcccaatattacaatttacattgaagaagttttgaagagtaataacactttttatttatacagtatctggttaaagatttatagtgtataaattgctaattttcataattaatttatataagaaaaatatttcaccaaactgatgtcatgcattagtattattatgtacattatatttttaacttttaaaaatttattcattttgatttttaaaaaattcgatgtacattgtaaaaaataaaggaacttttaagaagaaaat

SEQ ID NO: 44278 - DNA, 1354 bp, Homo sapiens
gggaaaatccaatattagaagaaaataactatatatactatattttttattgtgcaaatatatattacatatatttattttaaaaacacctttactgaaatttaattcatataccatatgattcacccatttgaagtatacaattcaatgacttctagtatattcacagagttgtacattcatcagaataattttagaacatttgtattaccctcaaagaaaaccccacatcccttagctgtcaccaccatgccacctccattcactctgtccctagcaaccactaatatgctttatgtctctatagattttcctattctgaacatttcatataaatggaattacatgatatgtggttctttgtgaccgacttctttcacttagcatgatgtcttcaaggttcatcatgttgtatgtatcactactttttattcccttttatgtcttaataatattcactgtatggatagaccccattttatgtgtccagtcatcagttgatgaacatttagattgtttccaccttttagctattatgaataatgcttttatgaacatttgtttgcaaatttttgaataactgttttcaattctcatatatatatagctaggagtagaattgatggattatatggtaactctgtgtttaagcatttgaggaaatgccaaactgttttcggaagctgctgctccatttcacattctcaccagcagtgtatggggttcacttcctccgtatcttcatcaacactgttattatctatttctttgattgtagccatcctagtagatgtgaggtagtatctcgtggttttgatttgcatttccctgataactaatgatgtggaacatctttttatgtgtttattggccacatatgtattttaagttaatgagattatggggcttttttacttttggaatttattttttttaccaaaaaacttgtcagatttgtttagatatttgtaccattactcttcattgtttataattttgagtgtgcgttatgtaacacagtgttactctacataatttctctgttagctaactgttgtaagaaattgggactgagagaaggtaagttatttgttcaaggtcacagagctagtaaattgtgtaggatttgaatccaggtcattttaaatccagagcctgagttctttaaaaatggtactataacatgtctcaagtaatatatgtttttaggtttcttgtattactattgttattgtttttgctctggttgttactttattttacccaactacataatctcatagagacaaagacttaaatttcacatgaccctcagttcaaaaatgtcacttttggccgggcctggtggctcatg

SEQ ID NO: 44279 - DNA, 1050 bp, Homo sapiens
gggaatctgggctcatttctttaaagcacaataacttcatctaaaaggtttaaactgtggcaaagtatgataactatgactcttgccttgggaaggaactaattagggttatatagacaggagagaaaccctctttattctcttcagtctctctacttccatgtgcatagatagaaaccgtagagagatatgtgggttccctgtccccaatcactctagtctacattttcttcctccatgactaatggcaatcatttctcacaggtttattttttgtgtagtagagtatagatgactggccacagagtagattaaagatgactctcccctacctggatgaatctgtgtccttggctttcgaatatttgctataaatattaaatccttggaagtatggaaccacatttgcagctactgttagctaaaggtgcccggtaattactgtataacctgagtaatattttaatacagaacctagagttcttacctgcttctgaatttatctttgcctcttgagccaccttcactttcatttctggacgaagaggtgttctttcttctgttcaggtttgcctgtccatctgtgttctaggtcttctctcccagttcctcaggctcttgctccattagttattccatttcttgcccctttaatcagcttttctgtactgattgcttttctgagcttttgaacatgctcaggtctctctcatgtccaaaataaaaaatgacaataccccaaaccatcccttgattctgtgctcactactttattatttttttattatagttaagattttagaaacagttgtttatacttggtctttcttgcctctcctttgctctttcgccttttggagtctttggcagtcctgcttgttcttaccattgggatcgccttcatgaaggtcatcagtgatctctgacttgccaaatactttttgattttttttctggcattgtgtatacttttcaatgcttctctgaaattatgtacttttcttttgtatttgattctattgaatgttacttccttaaaaagttcttctg

SEQ ID NO: 44280 - DNA, 1027 bp, Homo sapiens
caaaattcagagcagattgtggcccttcatagagagttaaggtttttcttaatagttatatgggcatttaaggccaaacatgtctttgttttttaatcatttgacaatgatttcaagcttgtagaaacattgcaagaatagtacaaagaactgatatgattttcactcaaattttcaatattaaaattttattatagttgctttatcatattctctctctctctctcaatctgccctccctctcctcttaccattacacattattattattttgaagtttttttttggcttgagagtacattggagacatgatgccccagtactcccttagtacttcagtgactattttctaaaaataaggacatttccctacataatctcagtataaccaccaaaataggaaactagtattgatacaatattaccgtctattacacagattcaattcataattcactaactgtcccaatgatgttctttatatgtccagaatctaagccttgtatttagctgccctggctctttgctctccttcaatctggaatcttcattaatcttgccttatctttaatgattttgacatttctgaagagtacagctatgttttgtttctctacttgggtttatctgatgtttccttatgaataagttgttattttgggcattattaccacaaaagcgatgctatgttctcagttcctcatgttaaaaggtgtggttcaagcttatcttgtacttttcttgccccagccctggcgctaccaaagacttctggtttcttttagtggatgctaaggttgctctttgctactgggtctaagattgctctttactactgaggtgtctttgcttctagatcttttcagtgaacaaacctaggaaatacagatttgcacattatatgtatatatgtatgtacatatatgcatgtacatacatatattgatatggcttggctgtgtccccacccaaatctcaacttgagttgtatctcccagaattcccatgtgttgtgggagggacccag

SEQ ID NO: 44281 - DNA, 1115 bp, Homo sapiens
acttatttctttgagatgaaagaactaacttatttcggcttgaatactctgagctaagtcatttagcacaaccttacataaccccatcagagtgtttacagttttttaatatggggacaaatgaaaaatttagaaaattaggatagaaaacaaacaaacaaaaatggcactcagaaaagaaatagaataaggagaacacatcagaaccctaacttgattcatatttgtttctgagacttttgttatttgtttagaaatgatgatgatgttgatgatgttgatgtcatcaatgatggcagcaatgaaaatctgttatactacatttaatgctaaatgctttacataggttatatctgaggtaagccagaaactgttgagagaggaacttaatatatttatcaaacctaagattcatctttgtgtcatttattttatctttgtcttatgtatttatgataaagtatttcttcatgtactttatcaaaaatattgtcagttaaactatgatattatcgactgtaagatatatcttgattccagagatgataaaatattttaaaaattatattatcatcaatgaaatatgttgattggtgaaagtgagactagcagactgatgaacaactgtttcctattttgaaatcagtttttaaaaagtttatcactaataaaggaggaaattttgaaaatgtgagaatatgatgttaagaaactgttccaatcctgatctcttggctatctttgggcctctcctttgtggaaaaaaacacacgtacataaaacccacttatgtgagcagagaatcaaaagaaggatttggaggggtctgcatatcttcaagtaggagtagcttttaatgtaagtataggataaactttaatttctgctagttttatacattagatttcaaagttgtactcttgggcgtgagggatggtggtaggaaagattttaagagtaaaacagaaaaagaacattgagaaataaatacgttgttccttggggagtgttctttctagagacactgagcctgtaaaccattccctcctacgtaaaatgtcaggagcaagattaaatagctcttcctagcatgcagagtttacagactgcagata

SEQ ID NO: 44282 - DNA, 1053 bp, Homo sapiens
agactttctttctacctgttttcactgaaatagttaagtggttgagttttccgtgaactgttgtatgtagttacttatttctaaatggaaaaagagttccagaaagcatttaaaagtcttgagagttgtgctcagaggtcgcttgtgatttgtgggaagaaggtagtcaaaattggtattccttatgtgtctattacatttgaatgcatgtatattctgttatgtataatgtgttctagatgaaatccttaggaagtaaaattttttcattgtaattacagtgacagctgggaaaaccctttttgcttgaagactctcagtaatgcccctgaacactcctaatatttcagcttcttgtggtgaccatttttaattgtagcacactcaacctgaattctttgtatgctagttatctactcagatgaatttacatcctttttactccaaaatatataaaaaatggattgactagcatgaatttctgtggccatttgttttctagccaagtagataaagtactgtgagctagggctgtgttaaatgtgatgcatatgccaggccttcataaaggataaaactccctgtgtgttatgccgctgctggattagttaattagtatatgtgtttgtgggggggttgttccaagtatgcctcttacagtaatatataggttagaaaaataaacacaaacctttcaaaagacttccaagtggcatggctaattttgccccaatattattttatatttaactgatggcatctctgtatttagaattcaagctatcatgtaatcaaaggatcccaactttaacaatattacacagaaagggatcctcacttctaccctttcacaatcctctgcaggattctttacaacccaaaaaatattgggttttgtgtttgggatgtagctttcaaactatgtaatttggaatagctgcttaacttttttcctgtgattcttcatgtgtaataaataaaatagttgacttagattattttattgaccccctttaaacaaaacatatattttgaatacttactacttgaggc

SEQ ID NO: 44283 - DNA, 2071 bp, Homo sapiens
tatattaaaggtattatgtatcataccatattctgcttaactttggatgttgtttagggattaaactctcaattgtggtctaattttatactacatatgattcatgtattgcctactgagcaagtaagcaattttcttaattatggacaaatattatgctggcagacctgtgcatattaaactgaaaaaatacttttaaagtgcttcttctggttgggattttaaaaatatgattattagaaccaatcatattaaaaaaccttatatgatgggctaaaatatgtgttttcaaagcaggggttaaaactttttacatgaagtacttttatttttctcttaggaaatttaataaggcatctccaaagacagagggaaagtggattatttggttgacatgcttaatattttatgttgctgcttagtttgctaattctagtggttcaaaccagatttcaaaatctgggctaaatctctgtcatgctatgacatggcatttgacagtaattcctgaatatttaattgatagaaaaacagaaagcatgcatattgtttagtacaattgtgtgaactgctatgacatatcattacatacagttttctgaaagactgcatattttattcattgtatgcctagcacggggaagaaatttttaatgcagtgaacaggtgacctttcaagcatcgtatataaagtttcaatatgtactttaatgggatagctgatgattttctgtttatgtgctgttgattttatttgcgtagttgggtgttgacaaaaactgggaatagatgttctccgtagatctacatgtaataattataattaatatttagaatgctcagattaactttttaaaactgagatgaagttcacataatattatgaaccattttaaagtgtacaattaaggaaaattatgcaaatctcttttcagaaatttaggactcatgatatgttttatttgcaggtttcaaaattttttttctgtttttttgttgttgttgttgtttaaaacctgtatatgtttaaaaattaaaaacatttaattatcacttggtagcaatttgtaaaatcctaagtagaattttaagttgttatgtgaaatttctttgaaattgagaattttattcctaaattacttcctgatagatttgttgttgcattttattctcaggtgtgtaatttttttctataggctgtggttgtgtcatatatactagttataatttggcttttcaaaatatcaaatgccaactatatgcaaaataagtaaatttttatgactatgaaattcacttcaattgtcaaaatgtacaaaattccaaaatgtcttcttttagcctattttgttgacgttggtgatttgtcaacctgaaggtaacagactgtattagttttctattgctgtttaataagccacaaacttagtggcttgtaaaaatataaattaattatctcagactttttgtagggcaaaagtctgggcatagctgaattttgtgctcaagttcttatatactaaagtcaaggtctcccctgggctataatctcatctgggatctcataggatcctttttcatgttcatgtggttgttggcataatccagtttttggggattgtgtgactgaagtccacattttcttgctagctcttgtctggagactgctctcggtctctagaggtcccctcctgtaagtccttgctacatggctcctatacaggcccccttctttaagaccaacaggaaaagctctctcaagctttgaggcttatccttcaaggaggacccactcccttttaaggactcccagaatcatctctgttttgacaaactcgaagacaactgctttgggactttaattacgttaatacaatcttttcatgcttgtcatataatgtaacatcatactgggagtgaaaactatcatacttaaagccctacccacccccaaggggaagggaatcttcagagtgtgtgcaccagtgggcaggaatctgggatgccaccttagaattctgcccactacaggaagctatgggaaaatttgaaaatgtgtttttttaaaaat

SEQ ID NO: 44284 - DNA, 1036 bp, Homo sapiens
aaaaatggtcatcatcactggtcatcagagaaatgcaaatcaaaaccacaatgagataaccatctcatgccagttagaatggcaatcattaaaaactcagggaacaacagatgctggagaggatgtggagaaataggaatgcttttacactgttggtgggactgtaaattagttctgccattgtggaagacagtgtggtgattcctcaaggatctagaactagaattaccatttgacccagcggtcccattactgggtatatacccaaaggattataaatcatgctactataaaggcacatgcacacgtatgtttattgcagcactattcacaatagcaaagacttggaaccaacccaaatgtccatcattgatagactggattaagaaaatgtggcacttatacaccatggaatactatgtagtcataaaaaaggatgatttcatgttattggcagggatgtggctgaagctggaaaccatcattctcagtaaattatcacaaggacagaaaaccagacaccgcatgttctcactcataggtgggaattgaacaatgagatcgcctggacacagggcggggaacatcacacacgggggactatcggggggtggggggctgggggagggatagcgttaggagaaatacctaatgtaaaagatgagttgatggatgcagcaaaccaagatggcacatgcatagttatgtatcaaacctgcaaacattgtgcacatgtaccctagaacttgaagtttaaaaaaaagaaagtttcacctgtacctttattgtacagatagtttttttatttgtttcaaaacaactgtccttggtcagagaagttcggaatttcttttgtgatctctcaatttgtgtggtagtaaagtgctcacagagtcacaacttagaaaacttgatttcttttctccattttattgtgagtttgaatgaccaacttaagtatttaatttctattatttataatgaagcacttttcaattcaggctgaatctcagaaaaaatgaatataaaaatgtaa

SEQ ID NO: 44285 - DNA, 1021 bp, Homo sapiens
atgttcttttatttgatagaaagcaccatattcatccattcatatgtcctgagcacctattcatccaactacttatgtatctgtccatccacccacctcccatccacctagccatctagccttcattcgcgttttatctgatactttctatttgtcaaaactctgtgtattttatttttacacttttaaaattgaatactatactgctttgtaagtacttatggagctttgtaagtacttatggaaaatgaaagaatgattcacggcaactatggagatgttctagtagagagtatgtacatatttgtttgtggttgtataataatatagtttgaagcattaataggtttggaaaggtggtatagatagtcatttcagctttgcttatcttagactgattttatatttcagaaagtctttttgtgacctttttgtactgctctagttttaaaataaactgcattgtcagtaaagcagagttagatttctttcgtgaaagtaaaattgatagacacttgaacatttctttagaaagttactgtatcaaagaaaattttaaaaggtttttaaaagattttacccattttactgaaaaaagtttctcttcttttgaattgattcttaatttatttcacatatgaagcatcttgtaaaggttttatttagggcagtaaggaaccattttagtatttttaatcattcaatttttatatagaatttttttccagtccttattactttaaaaaattacaattgaaaccccctatttctcttgacatttttggtattcatttttctactgctttagtctttatcatctatatgtgaaacagaaaatatattttttagacaaagaagacagagtgacttatttggaaaataagattctaattactctatcattttctgtaagggtgaaatacaatataagggaacaataaagaaaatcactctcctagaatattgcaaattctaaaaaaaggaacataaagattcaaatgcactcaatctgctgacagga

SEQ ID NO: 44286 - DNA, 1031 bp, Homo sapiens
atggaggccacttgaactctaggaaattgtttcttcttttgtgatcttcaattatttctaccacatttttgtggccctaaccaccctcttttttgttttaatatgcattatggacctatccacccaaatattagacttaaaaaattatataattgaagataaagttggctggaaaaaacctgtgtgatcttgcattctgcacatgcatattttttggctgcctatgttgggcgggtgttagggtaccatgatccttgcttatagagtttatagattaataaaaggaatgtgtaaaatactttattatgtatgagaaaactgagaccaagcaaactgacttgctcatgagcgtacaacaatttctctttacactgactagtgaaatactgggaaagtccgaagttcattaatgatgggtattattgtaccacaggttgcattttctctcttaatttatctggattttgttatctaacaaaagatctataaatcctgggcatatgccacggaggtactgcaagtatgatacctattactgagatggagaccttttgtggtcaagataaaaaagggcacagtgtatttaacttttttgtgagacagagtctcactcttttgcctaggctggagtgcagtggcgtgatcttggctcactgcaatctctgtctcctaggttcaagcgattctcatgcctcagcctcccgagtagctggccctacaggcactcaccaccacgtctgactaatttttgtatttttagtagaaatggggttttgccatgttgtccaggctggtctcgaactgctgacctcaagtgatccacctcccttgggcttccaaagttatgggattacagatgtcagccaccatgcccagcctatatttaactttaatagtgtcttttgtctatttctctccctgggtaaaagagaaaacaataaaaatattcatgaactggtataggttcttattttgtgcacccagcatccaagacaatatttgagtgtactacttagatctcctaaaaaggc

SEQ ID NO: 44287 - DNA, 1001 bp, Homo sapiens
tatattaattttgtatcctgaaactttactgaattcatttatcaaatctaaggtttttttggtggaatctttagggttctctagatactagatcttatcatcagtgaagaggcatccaatttggatgcctttgaatattttctcttgcctgattgctctagtgagaacttccagtatgatattgagtaagagtggtgaaagtgggaattcttgtccttttccagttctcagaggaaatgctttcaacttttccatattaagtaaaatgttggctgtgggtttgtcatatatggcctttattatgttgaagtatgttccttctatacctagtttgttgaggatttttatcacgaagccatgctgaattttactgaaggcattttctgcatctgttgagatgatcatatgggttttgtccttaattctgtttatgcaatgtatcacatttattaatttgtgtcttttgaaccatccttgcttccctaggataaatcccacctgatcatggtgttccagctaatcttgcttcactgacaccatttgtttaaggaaaactctctctaactgtgtttttcctctactctaacaccacaacaatcatcaacacagaagactgctgtgaccatatgtgtggggttttttttcccccacactccaagcagcagacaccagctgggtgtcctctaattcagtcctgacactacctacctggagatagtgtcagatcccacaggtttagggcatagttcccaagactgcacctttccctattcctcctctaccagtctcaagtctaggtctctggaacttctgatgaactggcttcaagttgcagttcccatgaccccctctttgggttcaattaatttactggagtggtttaccaaatatgaatttctgagtactaactttttgttttccaaagaatacaattttttttttaaatctgaggaaagtttggaaaaagtataaatatcttaaaatagaaattaggaaaggtt

SEQ ID NO: 44288 - DNA, 1070 bp, Homo sapiens
ggaaacagtgggtgtgggactcctgaatataatagtaatttaaactcagaggtttttcataaaaatcttctttttttaataaaaaagagatgacagtttataaaaaaatgtagttctataattttagatgtttaagaacataaaaatggattacattaatgatatatagatttacagtattctttgagactgtcagcatgttattttaaaaataattgatatgtgtctaatagtaaacaatttagtatttttggtgaaaaatactttaaaaatttactgctattataattcattcatattggcctttaataggtaactccgttgagttggtttctgcctcagaaatattttgctgttatagatttcatggaatagcaaagagcaaataatttgtacatgcttgtgtaacataatgttaaagaatatttaggaattgaaaatgttgaggaacagcttttcctggcatgcatgcctagagagggtttgcatcaccactagggaggacacagaactgttaagatctctggcgttttattacatgtctgataattatttgttcacagccagacctaccatattcagttctgcaggttgtgcactgcataactgtaatgatattcacatgtgtaaaacctacacatttgtatgtagtgactctgggttttgaacaagataaaaaaatttcttaaggagtttacattccagtgggccagacagataatcaataaataagataggaatatatcagataaaaatagataccatacattgtaaggtgaaagcggccagatggctggtttagaagaaatagtaaaatgaaaagaactggtaatttaaaaaataaaatcttttataaatggtataattaaaattattttacatatatttctagacgttatcgtttttgcgttttgttgctaaagatagtctgacacagttatttgttttcactttgggtttttaaaaactgtgatagcagtgggatgcattaatttattttttttgagatgtagtttcgctcttgttgcccagtctgtggggcaatgggcgtgatctcggctcagtgcaac

SEQ ID NO: 44289 - DNA, 1049 bp, Homo sapiens
catgtatcactgaataatgtaatgtctccaatagatattatgctgaaggacagtaggaagggacagaccttcctactgtaattagaggggcatatctactccaatttgaagaccactgcattatgccatatagtttctgttcttgcttatcatttttgctctcttacttctttgttttaggtatattcattatcatcagggttaacagtgtcctgttgtttattttctgagtgtaggaagtatataaattttgtctgtatggctggatttgatggttaaatacttgataaagatgtagcagtagaagcgatgaggaaaatgaagagaaggagaatgaagaaaagtaaaaaataatttaaaaaaattcaacacttatttgcaggcacttaacaatgctagacgctgttataatcactataaatattaaatctttatttagtcctatttgtacccctagaggcacttactgttattatccccattttatagataagaaaattatggcactgagaggttaagaaacttgtccaagcttgtaagtggtggaagcagaatttgaaccaagcagtcttactctagaaagagccttagccactgtgccatctttcttgttatgtgcatgtgtgtgcatatacatatacatctatgtgaacatattcaccaatgcattagctgagctagaccataaatatatgtatcagcggatacatgaatatgcacaatattttaaaccctcagaaaaaggacaatgtaattaatgaagaaaaacatgaaggatatgagaatggggaaaatagaaaaaaagtaacaaccttatttctctcaagtgacaaagtgattttttaaaaatagaaacacaacatttaaagatactttcatagcaagcctatacttttaatattttgtgatatttgcagagaaataattttaaaatctatttaaacatttttcaccttttgaaattatataccctgtgaagatgcacatactgtatgctttacagttcagttttcacatataataatgccacctaaacttttccttccttc

SEQ ID NO: 44290 - DNA, 1037 bp, Homo sapiens
tcttctattggtagcatgtatctttacatgtgcttaatcagtttaaagcaagttaccgatatcaaacaatgctccaatgataccgatatgaaacaatgctccaatttacaatgaatactttaaaaatgacacttaaatttgttaaatagcttcacaaatgcgtctctcaatctgtttctaacgggcttttgtgaaggtttttgaagggccgtgctgatcagtggaaaatcagaagagggaatctgctgtcatagtggggagaaggcatcaaggaaaatgtacacagcaaataattaaggtggtaaatgtatacaagaggtattcaaggcaggaaactgcgaagacactgcctaaataagagtgaagaagcaagctatacagtgggatgccataaaaatgaggtcagctacgaacagaagtattatctgggtttcaatgaaggctgcagtgtgcacagattacttccagttgtagcaatggacacttatctatgataatgacacgaagattagaaaaatcacatgcaattagaatcggaacaacatgtagtttaggtagtgctacctcaggtggggagtttgatactggtaaagtaatagtttatttattcagtagagctcctactatgtgtcagacactgttctaggtatttgagattggccagtgaacaaaatgatgtagatccctgcccttttgaagcttactttctagcaacaagtgacataataggtatagtaaatatgtacatttttttgttaggagataagtactatagaaaagagtactgtaaagaggatcaggagtgttggaggagattatagtagattgctgtattaaatagagtaataatttgcttttgaattggagagctatagcaacctgctccttagttttatttcctctaccttgcgacttcagagaattggaagttggacctccccacagagatttagtggcagaggaacaggaagtcaacggatgtgtatttttcaagattgtaataaaatttggatagttcactcatgatcttctctttg

SEQ ID NO: 44291 - DNA, 1026 bp, Homo sapiens
aatggttttgaatttctcatttatatctttgggtcagtaaattgaatttaatccagattatatttttgggtaaagagaaacttaaaaaaaagctttaaaactaagggatctacaaacacttattgattatatactttataaaagcccatctaattaaaataaattatctcaataattcttaataatgaaactataaaaattataagaagaatcttaggaatattttttagtaattttttttgaaatgatacacaggaaatattaatgaaattagctatatttgagtgggtctttgtatttaattccttttatacttcctttagtgagttgagaatgaatagtttcccattttttaatggggttaatcgcttaaatatggagaaatggaaaattaaatgtatttgatggagagcagaatcaaagctatgatcacaaaatatatactttttcaaaattaaaataaaaaattttaactttatttttacccatgaattttgactgagaataagttgtcacttgatgagccacgtgtggtggcctgcacctgtggtcccagctattctggaggcagagatggaggattacttgagaccttcaagttgaggcttcagttagttgcgatcgcatcactgcactccagcctagctgacaaagcaagaccccatctctaataaaaaacaaaaaccaaaaaccctcaaaaagtccaaagttttttatatggtttcaattcactgttagaaagttgtctcacaatgctttgatgatgtattaaatatatgaatgcatgaagttcttactgagcatgcagatacagttatttaagtgttatgtgtatcagctgggtgaggtatatttttgagacgtaaccctttacatttgaaagtctggtatttaatttggctaaacttcccaaaccatagggaaatactcattgatccattaacttattcagcaaatatttattgagtgcttattataaggcaatcattttataaatgcattttattttagggatctttctcttgc

SEQ ID NO: 44292 - DNA, 1050 bp, Homo sapiens
aaaaggatatgttttaagggaaaagctatattttactataagaaattatcgatgatatataatagtaacagaaacttttgcctgtcatttaggttgctgtgacagagggaaaggacatgataaatggcacttgaaacttttgactagaagtatcacataccacttttgcttgtatttcattgctcaaagcagtgacatgtttactcttaaagggggagtaagtaaatatagtataatgatataataaagatataaaggaatgtttgtttatcatttgtaagtactttcatagatctgattggttgattgattagtttatttaaataaaatttattgaatgcttactgtttatcattgttgtattactagtgcctatcatatgcacaagggacaagattcctgcactcatggagctaacgttgtgataatattgttttggaaataagcttgtcagtatttatcaagaaccttaacaattcttttatcttttttccccattaatttcacttctggactgctacactaaggagatattattaaatatgaaaatatgtataatgataagataacagttttctttgtaatattgaaaaatcagaaacagatgtctagtaggaaaatagagggaactctattatatttactcatagaatattgtgaactcatcagtttgtattagaaacatttgctacattttttagtggctattttcaataacattttagcatcctgtggtgacataaagcagataacatagttcattctgggtgtaaggactagcaaatggtgaagattttagattgttaggattacataggataattatatgtccccaagtattgagtttatatacaaggagattaggaggatgtagagaaactagaagttttgaattctaatagtgtatccagtcattcaaggagacatatcctgaaggaaactggaaatacagaatcagagactggttaaaaataaaggctaaaaatgttctttggggattcatcagtatggaaatgttagttgatcttgtggaagcagatgagctgtgaa

SEQ ID NO: 44293 - DNA, 1030 bp, Homo sapiens
atgttgcttaatcaaataatcttcattcatttttatcagcactattttgcattttttttcttttttctttcttttttttcttttagtagagacttggtttcgccatgttggccaggctggtcttgaaatcctggcctcaagtgatccacccacctcagcctcccaaagtgctgggattacaggcatgagccactgcactcagcatagcactatttttggagcagtatttctacaaaggaaataactaccatgactacaacagttattagcttattaagatgtctcataaaattaagttttaaagtttcaagtgatgtttacttttcaatttcacatggaaagttagcatgaaaagactaattttttaaataattgtgtcttttcttaatgaaaagcataaatacatttatagttgttggagtatattgaagaaattacagctaaatattttggttggttacaattattggtgattctggaactgtggtttacctacaacataatggttgagtgtctttgaagattttattgggcaaagcaggattttaaatcttgccagaatttgaaatacagtatatcatcatatactatagctatattttgaatataacttttaattttgtatgaatattacattaatgagcaacatgatgccttagtaagttaccactatcaaatggcagataataatggttgagagtagtttctctgaacttttccagatatgttttcttagaacttttttttaaagagatgtgtacttgaaaggaggatattctctttaaaattcatgtggaattggttgaaataaattcagagtatatatatacatgcccaaagtaaaacacaacaaaactgaatcgtgagttgacatacgttaacaatattagttaaattacaagttgactggtgaacaaaggatactcttatggagattatgattttaagatttttttacaagtcattttattgaatgtggtacagaataagatcgtatataacagttaaattttcactgacatttcaagag

SEQ ID NO: 44294 - DNA, 1047 bp, Homo sapiens
tattgaaaattgcaaacataaatgttggcaggtagacgttttacagaaggatgagatcaaaatcctttcctatttatttaaaattactcaaaataagatagtggtagaaatctttgtttctttgttccttgtaatttattctgggagtagagtttttaatattctaatggttaattttgttctggttatctccatatctcttgtcaacttaagatgtgtttcccactggtaaacacagtgtccgctggttcttgctaaataaagataccatagtctatattctgcttcatattttaggtcttggaaaagtggaagaaatctctaaactaaacttaaacataaccttatttgatccaaggtcagtagatacctttcatttttcttttccttttagaaaaaaaaaaggcactgttttggtgagtagaggtggcaaggctgggaaatgtgtcggtagctgataagaaagggaaaggccttaaaacgacacccaccaaattttatcagtgccttggagctcaggaaagtatttctttccaagaagagaacaggaatgccttttaaaaaaattgtttatttccattaaggagaaacctcaagggcccatgaaaggttattcctttgcataatctagtgacaggtttactcatactcagaggttacattaatacttactgatggcacaagtataagtttcactttattaaaaattgtatggatgttggaactgctgttgaagaagctggcttggtttgatttagctatggatatgataattataatatggctttctgtacttttagaagtcataagttatattgcaaggatttgtgtatttggattgctagaaagttaccgtatagtattatgacagtacagtaggaaacatttcagtgtgaagaatagtatgtctcacataaattttaccatagaattaagtaagaatcattaaaatattccgggtttattaaaaattcattattctactagatgatctttaaagagcaataagaacttgaagaaataataggaaagctttggtaacaatga

SEQ ID NO: 44295 - DNA, 1048 bp, Homo sapiens
actagtgcttatgtttataaatgttttcatttttactctgaaataatctagtctctgagaatgctgtttcttatatttaaaaaaatgagtaagtacaagacggcatttgcaaaggacctcccaaatacacgttaaatattatatgtaaggagtcagatttagctatcgaggagaagcattttgaatgtaagtttacataataattacaacaaaattaattaggatattagagtagtgaacagtttaggtttcaagcaggaaatagaacacaaggcaaatcaaccgtcatataagggtgtcaacttatcttaaatacttttggaattaataagatatagaggcatacataaagataggccacagatcagtcagtggctgatttctatttctggctgtaaatggactagtttatttcaaactaaggcctacactgtgaataatgaaaaaaactggattagaaaaatatatatatctaaaggcattggagcactaccaagagctaaagatctaagaatgaaaggaaacacactgaagtgagccctgtatttggtgtcatttttcaccttgggttctgtcaatttgcaagcaacacaggccaagctgagaaaccaagcagcaatagctaagatggtgacaggatgagcagaacttttggcagtttcacagtgcctgcaagctaaaattcaggaaggaggaagaaggaccctggtaaaacactctaagcttttcattggaattcttgtggggctatatcctaggagttaggaagaactataaataggccactacttacaaaaatcaaaatgtattctttgataaacccaatcttgattttaaggtggtctgcctttacttcaactgtctgtcattgctggaagcaagagacatcatgcagagtttctataatttttttatacgcaacacttggcatttaataaaaaattataccatgcatattagaagccaggaccaagaaaaacaatataaaacaagaaaggatagaaacagtctcacagtaatctagatattggaatgattagacatggac

SEQ ID NO: 44296 - DNA, 1034 bp, Homo sapiens
ccataatcacaccactgtactccagcctgggtgacagaacaaggccctgtctcccccaacctaaataaataaaaaattaaaaaaaaacaagcaaaaaagcaggataaaaagggggggggggtatgacagtttgtttagcctacaatggagaagtaagagtacagttgttgagtgaactgcatgaatttgggcccatacttgtccgttttggattttatgataaagtgagaatcaactatgattttttattattagaggtctcatctttaacatggtctgattgtctggttgtttaaattgacttgcaacagtgattgttccaagccctcagttaaggaagtagagcagcacagtaccttatttcacctttctgtagcattctattccatagtggtttaaaattcacttattgaataaataagagtatatttgatatttgaatcagtttcaactctgttcactgaagtgctggttaaactcaagattgcagtcagtggtctttgtaaaattcttctctgaccagcattctgctgcttaaaatggttctgtggcttctagttgcccttagattaagaaaaacttacttaaattggcctaaaagacctatcctacctggctctgcttgcctcttcagctttttctctttttcactacaacattagcattctgtaccccaatgagactaatttatagacaataagttctcgttacctgggcctttgtttcatttttaaaatttggatcatatcttctcattttttcagatacaatttaaatgtttagtggcctctataaattttccttgctgtgtgctactatatcacaaaattcactggatttacttatttgtaaatataatgcagtaggctctcactaaataatttttgaatcaaggtgatcttgagtgattagggagagagcagagacatcaacttgaattgacctttgaaggaagggaagaacattcaaaataaggaatatagtttgaacaaagacatagtggaagtacttttgttcctaaatttgagaattaa

SEQ ID NO: 44297 - DNA, 1030 bp, Homo sapiens
ccaaaagcataaattatgttgccacatttttggatagtgtcagagacacattatttcctgtttgtaggaagaaaatgctagattctaaagcacttatgaccagtctctgtatgggttaagccacgagggcaaggtagaattagatggaaagattcttgggaagagaatagaaataggcttgtaaagttaaattcctgagggaggtgttgtattgaatacaattctagtttcaatcaaaatgtccctatagtttaaaatacttagagaaaaatggtaagtgacatgataatgaattaaaattataaaaaaaactatacacttctgagtttgagaatggttgatggtgattacttcgagataaaggtgtaattgtcatctcctgttagtaccattgacatgcttattatattgtaatatcaactttttgtatttatactaatttactttcttctgttaacttcaaagtgtatcatatatctaaagacagaacggtggaatatcctatgacaaaagatgtaagaatgactgttaaaccactaacccctaaagtagacatggggaatcaaaaaggaattgtcaccagcaaataagaaatagtacagacaattcctgttaggtgttacctgatttatgatattgagaatggggagaagaaaattttaaaagcattctagagaagcatgcagtcaaacaaactttattttttgaatgtatttgtttggaagaactttttttttgtagcaagcacatagaaggtcattttagaggattgaattgggtgacaagatagataatattctctccctgatagataatattctctccctgaaactggtttctcactacccaggctaaacgtggggaaattcaatggtcataacatctcatgaattctttctggacatttaatgtcatctgttgaaagcaggatgggccaggtgcagtggctcacacctgtaatcccagcactttgtgaggctgaggcaggaggatcacttgagtctgggagtttgagaccagtgtgaacaac

SEQ ID NO: 44298 - DNA, 1066 bp, Homo sapiens
cacacacctctaacagtcatacctaacatacctaacatactatttgttactaaacatattgtatgtttttggtaatacatagtacgttaggtataactttcagaatctcattgaactcttgcccagtttggtaatacatagtatgttcttgacttcttagattaagaatacccagaatataaaagtgtacaactttctttcaggcaataaatcataaaaatttaatatttgtacttttttccaagttattctgagacataggtctttgtcacacacacttttatatatctttcctttgaaaaatgtagcatttacagtcaacttttgaaaaatcatcttgcttgtcgctgggggacacattgcaaacagattatcaagttctagttacggaattgtatacagcaaagacttttttttaaagaagggaaatgtttgtaatgtcatcatgttttgtattttaggataatttcatttcatatgattttcccattatgtaaaccaataaacaaatttgtatcaactcaggattcttttctccttgttgctgcagattttctcctgcagatttatctgctgacttccctctttagcagttctttgcttccttagccccactacctgtcttctccatctcatttgtacctgactccttccctgtctttggactcagtatactgatgaccattagaggataagcaggctacagtgggcagagcagatgttatgaggagcaatgtgtgtgtaaataagagctgtgcagaaggttagcattgacagccaaggatgctttctactaaatagttaacagaggacctgtgaagtaataattgataggagaagattaagattgccgcagatattttgccttatttaaaatagacttttttttagggtcttttggttcacagtaaaattgaatggaaggtacagagatatcccatttactccctgccctcacacatgcatagcctctcctgcatgatcaacatcccccaccagaatggtacgtttgctacaattgatgaaactacatggacacatcattatcccccaaagttcattgttt

SEQ ID NO: 44299 - DNA, 1045 bp, Homo sapiens
atattttaccatcacgagcattttgatgatatattttactacatttgtgtaatgctacaaggttgaagacctaaagccaaaatgcagaaccttaaagaaatagcagttgagcatttcctgtctgatatattctaattgtttaaaattacacagatgcttattgtaattaagatttaagtgtgtagtctcagtgtcagtaatattttagtattaaaattctctaaatgtgttaagtgtttattttcatgatatgcacattaaaaatagccattttccagaaaatagtaacaactccacagagcacaatggagcaccacaaatggacttattttggagattcccattatattcgttaagaatgcagggacatatactgtgtctctgtactgtaggaagcttgacatactagtatcagtcatataatcgtgtaggaatgatcatccttacagtattataccttattttagttgagaagaaagtggtattgtttaatgacaaattgaacctaaagcctaaagactgggttccagatctgttttctctactcattcctatatgataattggtaaattaacctctctgagcctcatatgtaaaattgggttctctgttgttttgtaacatgaaaaccttagtggctgaaaacaacaatgattgtttgttatctcatggttgctgtgggtcagcaatttgagggtccttgcttggttctctggaggttgctgtcagatatcagcaggagtggaagttttataggagcatcactggagctaaaagattcacttccaaggtggcttactcacttggctggccagttggtgttggcaggttggttcctttccacaatgggcttgccgtgggactattctcatgagatggcagatgactttcccgagattcaagctgccaaagtagaaactgcagtgccctttatgacttacctgtggaagtcatacaccatcatttcagatgtattcaattggttctacagaccagccctgattcagtatgggagtggattacacaaggacatgaggcaaggatc

SEQ ID NO: 44300 - DNA, 1057 bp, Homo sapiens
aagatacaggccaagggcaaggagatccagttcctagtggaggcagatatctgagacagccttaggacagcatcacagactgtggttgagaagttgatacaaagccctctatgtatcttcaagatagaaggtagttcaaaccagtggcctctgtcaagggtaccttttccaggaggatggaaattccaagggaattcaggcttatgaaggtcttaggcacagagcttcccatctcttccttatcaccatattggtctgcagagggtaggcaggaccctgttcagagggcctttgacagagggtactggtgcttacattctaactactatagcagagctccactaattacatgtgacaaagtcgaagatcaaaacaccaaagtcatgttaaagaaatacattgtctctgggagctaggaagcccacaggtggatctggcttcaggcatgatcattttcaagaggacacgcatcagggctggttgtttcccagctctcctttgttctgtgtgttgactttaacctctgtgtactcttaggctttctccactctgtgggaaaatggcttccatcagcttcaagcctatttcttcttttcaaagtcccttttagaatgtcgctcagagccacagattgttcctgctgggtgatgtgcctatcatgaaccggtccctggggccagggatgaagctgggttttgtttgtttgtttgtttgtttgtttagagaagtccttatgtttctcagctgtacttcattttgggcttccgtgatcctcctgcctcagcctcccaagtagctgggactaccaggagtgccactgtacccagctgaagctggttatttgacaaggcccaggtgatatgcctactcttgaggctggggcagtagagtgaggactccccaaccccatcccaaccacatggaatgatggattaatatgggacaaatgacacatgtgattgcactctcccatcagaaagataaaaaaaatccctcttcctttccacccctcaagttcctaaatggctttcttgcatttactctcagacaactttaa

SEQ ID NO: 44301 - DNA, 1053 bp, Homo sapiens
tgagttgcttttctctttaacgttctcaggttaaggaagttctggtgttttagagtgcacttcagaggggtgtaaactgaagataatttattacccatttagaaaaagaagtgagaataaaagcatttttttagtcttcttcgtttctgtatgacccagagtggaggagaagacagggagcattctccgactgttttccctttctggtttttggatctcggcaccatgttaaacgtgctgcccatggttgaaggcatggtgctgcaagccatggaactggatgaactaagtggtgggactaaccacgcttacccacgcaaccttagcttgtccaccttgtatgattccccctttcacttcctaaatttgtgatttgcctggctttctaaaaaatggatcttggagagcctgtgttgcctttgggcaaggcttctttaacagaggaaacgtgctagattgcctgctattatggcccatgctaaagcacttacctttaaaaaaaaatggttctagttaacttccgaacttaaaatccccttactaattaagtaacattttaataggaaacactataggtgccttagaagaacgtagaaaccaaatggccatcttttttgctgatgggaaaatattgagactaacatttgactacagaagatatcttactcccaactgctgaaggcagaactttcctcatcacagaagtagcagtagaaaaacttaaaaaggaaaagttgcaaagctgcaatgtactgcagagaactagcaatgtgtcctgtattagtgagaaacaattaagttatgtttgttgaaaccttgagagagaggaaaggactgcatgactttggtgatgtaaagggactttcagatgggcacaggtctgagggttgtgtttggagctgtatgtctggctagataatcaaagcactttgagcacttgaactcacactgacactcaagccaaggtaaaatcagcccgcctcctgtgatagagggacactctctgatggtgtaaggtctctggggagcacccattcccaagaatgggggacc

SEQ ID NO: 44302 - DNA, 1095 bp, Homo sapiens
taaaaaatttaaaaaattaattaaaatttaagtttaagaaatagagcaaaaaaattacattatggataaaatatacattagtaattggacatctaggcctcctaacagagttgaatgtggttggagttcctaaacagcataagtgaataaatgacattgtagagtagatgttgggattgacaataatcatcataaatgcccaagggattatatgtcatgattataagttattgcaatgggcataagtcagatatgacaaaatcataaatctggattcaaacaggttgttcccctatgtatattgactgtaaaggcttaagatgaaagtctattccttattgcataatatttcttgttactactaaatttgcaaataatatgtcatttttcccacttcagcatatttcactattcacaggattgtgtgttgaagtaaatgtcttaggaaaattaatctagtagctgtaatggagacaatgtgaatatgatatggaaaaactaagagatggaaaagagatgaatggatttctactaactagatttgcatttttaagtcaaggcatagttaagagaaaggtaaaaaagtatgaaccttagttatcaactgatgaattcaagtatacttactgatattgtaattataaccaaaaacctcaggtgtattttctctatacaatcaaatagtctgagcagaaggaagatgagtcactgagtacagacttctagaaccagggatacctgggttcacatcccagtctcacaattctcaagctgtggaacctggggtaaatttctgaaccttaagagataattatcttttctttaaagtgaaattgattgtgtctacccaacaaggcccaaacaaggaatgaactcaatagcatagtcaaagtatggtaatttacacatagtgccattccataaatcatagtgttgtcatatgtcttttttattttattgaggtataattgacataaaataaatgacacctgtttgaaatgtacaattttagttttgacatatgtgtattcctatgaaacatcaccacaatcaggatagcaaatacattcatcactttcaaaagcttccttgtgc

SEQ ID NO: 44303 - DNA, 1062 bp, Homo sapiens
gtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccaggtagggtgagtctcttggaggaaattgtgcctctgaaaagccattttgtatattttgtagccattggtcagcagatgcaattaaaaacaaaacactaaaaggcattttctcaaaaccattgtttatttggatggtaaatgtatttagtagtcaaatacaaaagtatggcaattaaaactttatttctggaaagaatgaaaactaatgattacattattgttttttatgtttaatgggatttaacactccttcagagatgcttacaggtacctgataggatccttatttttctcttttgtttttaaaagtttttcatcaatttatgttctgaagctatatgaaactttgcattattgttgttttttactttaccccaagagcaagtggtcagtgactcaaattaattttgttataataactgttagtaagttccattgcctcttgttttcttctgtttttttttcccgaataaataacagagtgagtactaaccttatcttaaagcttattttaagaaattttaatcagcctcccaagtaaaaaagttcttaaaatagattccattaataattattttccctgacaggcacggtggctcacacctgtaatcccagcactttgggaggccaaggcggccagatcacttgaggtcaggagttcaagaccagcctggccaacatggtgaaaccccatctctaccaaaatacaaaaaaattacccgagtgtgttgagaggtgcctgtaatcccatctactcgggaggctgaggcgggagagttgcttgaacctggaagacagaggttgcagtgagctgagatggcgccactgcactccagcctgggcaacagagcaagactctgtctcaaaaaaaaa

SEQ ID NO: 44304 - DNA, 1096 bp, Homo sapiens
ggcttccaaatatttatctgtgtgttcatatatttattcaaaaacatcagttattcatgaaacaaatatttgttgaacacccactatatgccaagcattttactgggtactggagacacatcagtgagcacaagaaaatagccccgctcacagagctttcattccagagaggaaagacagataatagctgagaaactaagtacatagtacatcagatagcaagtgatgaagtgcagtgaagacttaaattgcagctagggagtagaaagtgatggtactgtgttgctattttacacagggcagtcaggaaagacttcgcttataaggacatgtgttggcaacaaactaaaagaagtgaaggcctgagccattgagactattctgtctggggaaagaagattccaggcagagaggacagtacaaaaggcttgaggttgaaatatgcttggccttttcaaggaatagcaaggagaccaggaaggtagcagaggtgccagatcttgtatagtcttttatttcatgatgaggactgtgcattttatttgaattgagaagaaccacgagaggatttggagtgaagatacgtctggctactgtatgggataatagattataggtaatatggttgggaacagaaagaccatttgggaagctttttttagtcttccaagtaagagatttaaagtgttctgcattacgatggtaatggttcagttcttttttacagaatattaacagattggatctgaaagaaggagaaaagtccagggtaacccaaagatgtcggcctgagaatgaagtgatcatttaattaagtggggaagacaacagggagaatctgtttggggaacaaaaatcgaacattgcattttagacatgttaaatcagagatatctgttagacactcaagatgtcaagtgggcagttgagtaatgtccagtttggaaacttgggaatgagaacatacagttcagtggttggtctactgagccagcactggggggtggggaggatccctgaactgtagcatttgctgatttccatggtgtagatactcccactatgtccaatttcaagcttccaacatgacatcact

SEQ ID NO: 44305 - DNA, 1034 bp, Homo sapiens
cataggacttactttgtaataaggaaaattataataaatatgtaagtaaaacatgtatgttcaaagatgatgaatgctcaggtgaaaaccagtgtaggtaaagggctagggaatgtcttagagggtagtgggtggagagatggagatttgtggtaggtaagaaatttaggtgagaaggcagtagagtagagacctaaaagacatgaggaagccgtgcagataagaggattccaggcatagcaacaataagggcagtggtcctgcagccatagaatcgtggcttgtttgaggaactgcaagaaggctaacttggtcaaaatacagtactggggatgggaatggagattcgaagagggaagtcatgtggaccttgtaggtcacactcagcactttgggtcttattcagaatgagaaaggaaacagctagagggtttggaacagaggtgtgacactgctttacattgccacaggatcactgtggttgctgtatagagattatacctggagggaatatgggagggcagcagagaaacagggagaccggtttggaggctgtttgaactaatccaggtaagtggtgatcatggtgttgagcaaggtgttagcagtggagatggcgagagtaagacctgtttatactttgagggggattacagtccacaggcagagacacgctgtaacccgaaaggagttggagaatgcagcatggagagcacagaggagttgtagaatcttattgaaggagtctcgttaaaatttcctgaggaggtaacacctgagcagggtcttcaatgctaatgattctaggcccacatcccccgagtctttgttctccactgcactaatagcaagtacctgctttaatagtgaaagactgtgtagtcatagccaacatggctgtacctctgatgtttcttttgtttctttgtttgtttgtgttttcttttttagagatggggtctcactctgttgtccaggttggtgtgcagtggcacagtcattgctcactgcagtctcaaactcctgggctcaag

SEQ ID NO: 44306 - DNA, 1054 bp, Homo sapiens
gggaagcaagagcacaagaaattgaagagggaaattagggtgcctaatgtttaaactgtcacaacagttagataatgttgacttccgctgttttctctctggaccacagaattgtttgttaaatggaagcagtgcagtcaaacgttttcaaaagaattgagttcactctaaaaagtactgtttttccccactttctcctgctattcctcagtcactggcactaaaaaaagagaaaaaaacgcaactttgaaattggtttcggaaacaaattctaccagctaatttccaggccctttatgcttcattgatgtcctcctagctattggagttgtaatcttgtctggttaatagataaagggattcaccaattaactgggcttttttcccctctaacctaagacttatgttgcaaaggtacattaaccactatcttagttgagtttagaaactgggagaaaattgcaagcaatccatttaactttttaagatgttttaaaaattgaattactatatcttcacagttagatatagttaggttgagtagtttgaaatctccaaagttgtgctgttttatgaattttaaatccaaaggcaatgttgtgagaatttgaaattctaaaagtattcattaatgtgagcctggtttaggtttgttgagcaaatggttattataaatttcacctctgatagacagcagttgaattataggaatgtgacattagactgagccaatatgatttactgaggcaaattaagttctacgtcttgaaacggtgtgtaaaaatcattggctatggttcagtatgtcccaagagaaacttcaaagtcttttcatattatctgtgtatttatgaaatattttctatggtttgcacatgtagcttacacctagaagaaatcatatttgctattcaggtaagtttctagagtctttgttgtatcttagatgagtgtacatggttgtattcctgccagctatactttttaactccataaggagaccacaatatatagcgagagcagtttaactctattcaggaaatatatggtgttt

SEQ ID NO: 44307 - DNA, 1049 bp, Homo sapiens
ttcatctgttattaggttgtttgaatatataattgtccaaactctgaggtcatacccaattgcctctggaatgttggtgaagttctcaatggtaggctttgatttatatctctagatagactctaacataagtgatcctgtatccttaaggcctgcgttaaaggtcaggattccagttaaaccaaaccacacatttccctctgcttacagacaggagtcatctcttagagagtatagtgtagtatttaagagctttttctctgcaagcaggatgtcctaggtttgaatcctctaagggatattgggaagattaaaagaaaaaatgtatgcaaagcacttaccacaggacatcatacatggtgtgtgtttaatgttagctattattattgtttacccactttaaagccactagctgaaatattctatccttacctcttaagttgtctgttttcattgtctcgaaatggatcctgatttaatctccttaatgaagacttttagaataacacaattggattattgatatgttggatcattgaaccgaccccttctatactttgtttccttcatctcctctccattgatttgattgctaatatctcttcctggtttcttttaacttaattgttggccttctgattaacttcaggaaggaagggaagcacattctgtttccttgggcagttcctcccatgtttagatgtgtccacatgttccatgtgctttgtcaattttactagctccttattcttactggaatcctgagtgaaaccctaccagatagtgagatccaaaccacccttttccatgagtcataccttttctgtttacagcctttgtactgaaatgaaaagctacgtgttgtagcctttgcaaagaatgaaagaaaccattgtaccataaagccttgtaaaaaggtttccccttcctctggcaggatccattcccattttgcagcctgctgtgatgctcagattcctaggcaaccaaatgtatgcactttatacctggcttctgctacaaagccctgtctgctccgctgtccttgt

SEQ ID NO: 44308 - DNA, 1054 bp, Homo sapiens
gttggctaaaaaagaaagtgatgctgattgcagtggcatgtgaagaaaaatgtgtgtgtgcttgttcagagaggaactgaaatatataccactataagtcgtatgaggtacatagtattgtactagtaacatatagtatatactacattatatagcatatatagattgcatagcataaataatgacatctttaggtttggtcagtagacaaaaacttggtgaatattgtttgttcttatccaccattcagacccacattgaagcaaaacaaagtatgcagtcatgtgctttaatcgatataaagaaacttcaaataaagtaagctgtttcttgaactgaatgtgttgttttttaagactgatttttaaaaacaccttgaatatagatatttttgttgcagtccagatcacctggcaattaggagaaccagaatttaaattcaaaccgcctttcttttttcagagccttgcacatcttgctagaccaaactgaccgcaaagagaaaaccactgtagacagagctttgtcattcagttcagtgagagccataagtacctccaactcacacatgtggcaacgcttcagactataatgagtggtgaggtcagtttcctcctccctctccttagagttggagagataacttgggttttatttgatgcagatggccctttgctttggacaaagtcctgcatctaccactaaacaaacaagacacttggagcacttactattgagggcagaatctctaaaagactcacacgagacaggagaaatgaaatacaacatggaactactatgtatgcttgtcttctcttttcccacaaaacaattacaattctcggctgggtgcggtggctcacgtctgtaatcacagcactttgggaggccaaggcgggtggatcacaaggtcaggagattgagaccatcctggcaaacatggtgaaacacccgtctctactaaaaatacaaaaaattagctgggcctggtggcgcgtgcctgtaatcccagctactccggagtctgaggcaggagaatcgcttaaaccaggga

SEQ ID NO: 44309 - DNA, 1025 bp, Homo sapiens
atggggaagaaaaaaaagtcgattctcagctgtggccactctttgtgtggagtttgcacattccccacatctgcatgggttttctccaggtattcccctttctttccatatctcagtgatgtgcatgataggttcattggcgtatctacagggtctccatctgagtgagtgtgggggtatgcgagtgcaccctgtgatgggatgactgtcctggccaagggtttccctgtggaataagtggataaataatgatcttccttgtttttattaatctaccttaaatgtatgtatagctcacatttatttcagtgttgaatattagaagtattttaggtcattatttagaagtttggtgatgtttttgtgaccagaaaatatgctgcaggaacttaacctttgtttatgtcaattagtctttggtaaaattggtttcattatatattgtttgactgactgaaagtcgcagtttctaagaccttattgatgatggtaaggactgactgtatgtagaaatacatggactgtacaaatactgtttgtagaaattgaataaatttagaatacaaggcctacttttggcttcaccttgctttcttacctttatttactttgcttcctgtttcttcaatttatagtttctttttaaatgaaacaagtttattttaactttctatattaagtgtgtcttaaattactttaatccttcttggaataagtacaaagggctttgaaaataccgcctattgtattgttgctcataaacgaaccttaagatttttggaataaaacttctaaataaatgtaaaataagttaattccaaattaagtgaacaactttcacttaattaaaaggatttgggagcataggtgaataaatccaacattgcatgaaacatctttttttctccctacaagaactgaaaaatacattgttgtatttcattattttgtagttttgtttttttttgtcagtaattcctagttcagagcttggtttagaaaagaagaacattagggctttctaa

SEQ ID NO: 44310 - DNA, 1093 bp, Homo sapiens
ccatttgaggaagccttaatgtgagataactcacagtttgagaaacactggttcacttaataaccacctacctgtatacagcactcttccaaagaagcagtctttgtcctttataaccgtacatccaaagagccattttattttttaatttttaaaattttctatttacgtattttttttgagacagggtctcactttggcacccagactagagtttagtggtgccatctcggctcactgtaaccttgacctcccaggttcaagcaatcttcctgcctcagccctcaagtagcgaggactacaggtgcacgccaccatgcccggctattttaggagagacgggtgtcaccatgtcccccaggctagtctcaaactccttagttcaagtgatacacccgcctcggcctgccaaagtgctgggattacaggcatgagctgccatacctgggccaagcagcctttttatagcatactttttttcattcaggcaaagaggtgtaaaatcaaagagcctaaataaaagattaagcaggaaagtgtgctcatttatatgaaaaagctcataataagaacatttgtggagtggaacagtaaattctctctcgatcagccctggactctattttggtttctctctggctaggaagaactatccctgcaaaatgtttctgcatttgaaggtctcagaagctcccgcaggcacccacatggcctccatcagtatagcctgtcacctctcctcaaaacactagagagatgcggtatgacctgtatccctattctgggatttgggttggaatgaagacctagaagtctcagaaggacttcaatattagagaagtagaaaattcttgtggaatttagaggcagttggtcatcctggaatttgagattctaaattttaagagccctgaataccagtctctggattcatccatttcacttctgtccattgtcagttgaaattcaggagtgacacttagaattcctgacaaagagtaaagactggcctgtaggagcttccttgcttaatgaatcctgcagcgaaagtgggtctgtcaagctgtgggccaggtgcccaagtagaagttta

SEQ ID NO: 44311 - DNA, 1029 bp, Homo sapiens
tacattatgtatatatattatgtatatatatacataatattatgtattattatacataagtataatacaaaatgcttgttttagaagcttacatcctggctacagagggaaggtatatgcagttaccccaaattgtgactattttgtggaaatgtgggaagacagaattgttattgggatagggaaagcgtctggggtaggagggtcatataagtgctagatcccaacagatggataagacttggacggaacgtgacacatccttgtcagggagacaactgttagagcaaaagaaatacggaagtacgaactgtgttttgacaggaggaagtagggccgtttgtctgtagttgaggagtgtgtttagagaagtaggaaaaacataggttagaaactcaggatggaatcaaataatggaggacttatgccagaccaggttgggctatgaatgcatttgagaatgggagtggtggtgataaaggtggtggacacgcaccagggagcgatgaggatgagaagggttgagggactgctgcagagactacgtgataggggcctgaacagggatgttgagggcgggaggaagaagagatgcagatgtgagaaagattgggaagggaagaaaggcagcgccagtcaagtaatgagatggtggtagggttttgtagagtggtagagacttgaaaagatgctagaacatcattttatgagacaataacatatttctaggagggcgtatttgcagtgatgtactggtagggaggatactgaaggcatttggttacattcacaagtataaattgtgaccaactgtttggcttctgttacatccttcatagcaaccaacacagagcaggccacttggtaaatattgctggcttcagtaatgggattcatttagttggcttgtagtaacttagatgaagctgggctgaactttacctgccgtgtaaaccttaaactgtgctagtagtaaaagagaatgggcaaggaatatttaaaatacttatggaaacaaatgatttttaa

SEQ ID NO: 44312 - DNA, 1028 bp, Homo sapiens
ggggcctcgagtcctgcttaatagagctcagagtcgatgttagcccgtgaaaatatttgctcagccttcattctcaggaaaaactgatgaaatgtaaactgatgaatgccgcgataggatctttaatagaggctatagccaagtacaagtaagttgtttcgaaagataagtgtatagaaagctaaagtttgacaaattaattgttgttccctgctgaaggaacattctgttttctttcctgcagtggccactgacctctggctggggcagtgggggtgcctgcttaaggagataacccagggctgttcagatttctgtgtaacctctgactgccatgttcagagtcttgctgatttactaaatagattaagatactttccagagattgggccagcttgataggtttcctttgtcttagttgctcctccctcagagcttgcatcaaatcattctcttcagggaaaatttgccccaagaatcccatggaacctgatgtggtttgtactgtctttggattcctgtggcattttaatactgttaagatctagatatcatactgttctctggcattgtgtgagtgtacatttgccttctcaattaaattatcccaccaattcaatttgcagagtgttttcaaaagaaacatcttatcatctcatttgatattcacaaaagccctctgagagaggtaaagcaggagcctctgtttacagatgagctgagtcacagagtcggatatacttggagcccttgctctgactgcagtgcactgagatagacagaggagaatacaggttgagtagtctttatctgaaatgcttgggaccagaagcgtttcatatttcacatttttgttttgatttttaaatatttgcattatatttactggttgagcatcccaaatctataagcctgaaatgctcattggagtgtcatgttggtactccagaaattttggatttgggagcattttggattttgggttttgggatttgggattcgggtatttgggattattatgtattata

SEQ ID NO: 44313 - DNA, 1587 bp, Homo sapiens
tcagaaaggtctcagggaatgagagagtgatactgatgttagtaagcattttgggattcttccacatctggatgctgggtacttaatacaatttgtttattggattgattatggtcccacagccatggtactgtcatcaagaaagtcccaggggataggtataggtgtgtagcctgtgctaggcagatgagagctcgtggccagtcatgcccatgggatttcccatggtgtccatagagcataaagaagaacagcctttctgcaaagcaggtgtcctttcctttaagcaaacctaatgctgagttgataaagatacagatttcctgtaaaaggtgactctttttttttaccttataaaagggcttatttcaaatttctgttaaaaaaaaatcagtagtctcctatagcatttgacatatcaactatgaatttacagaaattcgtagttgtgcaaaaccagtcatttccatgtgattagctatcagaaaccaaaaaatgtgcttatcacagttgaggcagtttctctgtcggattggaactcaggctatgttggtgtgtgactggttttgaggaatgatgtgaggaaaccatgtattttcagttcagctcttttcctagcactgttatttcatggtgggttgcaaatttacattggtttgcaaatccataaagatattttaacaacagctaccattaaacgaacagttctgtttgccaggtatcaggctaagtgcttttaaatgcattattagcttcttcactcatcacaaaagccttggtaaataggtgctatcattatcatctatgtatttcggaagagctatctaagatttagaaaggttacttgcctaagatcacacaggtatagtaaggggtgacagcagactttgagcccagggctgtctgattcctgcaatttaactcttaacaaatacctcagcctaggctgctgtctgtaacagtagggacaggcaccactctgcgaggatcatatagatttctaatgtctctccccaactacttgttctagctatgattttgtgctctggagcttgatttttggaagtgatgactagaattagaagttggttggcaggagaattattttcttccttccctcattctacctcattatccttgtaacctagggaacttatgtcactaaaggacaccatggccaagatcttgaaaatggtaggtaaggcttctcacatgtcgatgatcaacatctgtgcaatgatgtcattaaaaacaagcacaaacaacaccaccaccaaacttgtttttatattatgtgcaatttcagttttatattatgtgcaatttcaacgcggaacacagtactttcagagcaaatgcagttggttgaaagaaacaggcactcaagagacagcttactgtaatgagtcagtttccatattgttactgagtaggacttggtgttagaagactctggggagtaaaaattaatgtaattaaaatatagtaattggcagatttgtgcaaactataggtttttctgttttgatcctgaagaagccaaataagggcattgtgcttgtagtttttttccaatacatttttctg

SEQ ID NO: 44314 - DNA, 2055 bp, Homo sapiens
tacataaaatctgaaacatacattgtggttctgtttgtcctgtgactatgtaaaattgccattgaaaaaacccagaaagccgggtgtggtgactcatgcccgtaatcccagcactttgagaggctgaagcgggtggattgcttgcgcccaggagtttgagaccagtctgggcaatatagagaccctatctcaaaaaaaaaaaaaaaaaaaaacaaaacccagacagagaataaaaacaagaaggctaggctgctatgtcatgaagaaacctaccaccaaccgctgaatttcagtgaagataggactgtattatttttattgtatcctctgctcttagtataacatttgctacataataaattgtaacatatagtgaaaatgtacatgttatttgagtcagtgtgtgtaggtataaatttttaatagggtatttacacctgaagtctttacaacaccatgtgactgctagactccgtttaaatgccagaagatactcagatacatctgcttgtcatatcctctggccaccatgtaatggtcagttgtagaaaatcttcggtcagtactggatcttaggcatttttactgcttcctgcaagtttggggtgcttttccaaccttttagtgattgcattttgtaacaaaaatttcccaccacagttttttttttttccagaataagagtatcttgagatagcaaggcaagctgttatcaaaagacagaaacaaaactcctaccaaatatgcaattagccattggtgagaaacagcattttcactccacagcataaccaacacaaaatatagaaatatatggcatgctgaagaaatagactacaattgttatttatagcttcccattccaaatttttgttttcattagaataggcttattcactagaacattgtgttggcagtgatctgtcacacacttgtatggtatgctctgcatatggtggctggattttgggatgtctcagctgggaagaaggataccctctttctcatttgcagtggtgtgacatgggctaccaggaaccctcgtcattgttcttactgacttgatactgagaaaatataaattcagaaagataaaataagtttagtaggataaaatgctgcttttatatgatgagggtgtatatgagcatttatttgaacaacaacaacaccctttactgtgaaaaccaaggtttgaaaaccactgacttaaaatgaggctggagtattgcatgtaaattctgttacaacaaggtttgaagttactacctagattttcctaatgagctgacatgcttctactttaagtggtggtagggaaatcttctgggttggggggtatgaattgtcatggaattattgcgtgttccagacacgtatgccatgcagcacagtttgcaccactgatgtaataaagctcttcatatctgaaaaacatttgtttgatatcatcattctaaagtacctagttgaaagggttaactccagtttatcttatgaaagaggccaggattctaattttggttctttcacaactgtatgaactcaggcaaagcatttatcttcttagggcctcagctgtgaaaggatagtttgatgaggtgatttccaagttaccttgaaattatagaattcattgtaagttcgagagtctcttgggcactctgactagatgtcattggaactgtctgaagtattctgtatctgaaatgttttggtttgtgttcaagtaactgaaggtgaagtgtatgagatatttactgtttgtgctggtctcttctaccagacagtatactatgtttgcagcattatgtgttatcttgaagcccttgggcaattccctatagtacttggttctgttaattttggtaagtatttgataaatattgtataaaaccactctacttccctaagtctttctgtccttaacagggaattgccagagctattaagttatttaaataaattaactaaaccctatattcaatttttgagtcacatggtaccaattcaaagaaaacattggttaaaggggtcatatttggaaataactta

SEQ ID NO: 44315 - DNA, 1034 bp, Homo sapiens
attgtctttgatagtcagatatgtgggtttattttaacaaagaatttaattatccttttttccttcagtctaagtcaaagtctgtcttctgtagtatttcttattaaagatggaacaaatatttaaagccatcacatgcattgcgtaagttttctcttttagtacttgtatgtcttcctaccaggacctttttgacaaggattacataatgaccaatattagactcttctgtatcatgtcctttgacaacactctctggtcactataacagaagagtaaagataatggtttactgaggtactttgccagttgtaggtttaccactcactattcttttgtacctttttttatgttgctgatcattattagaaagacaaggcaacttgtataacttgttttattaaaaaagtgaactatatgcttatttggctagagtatataagacaaaaaaataaggaattaaagttccccaagcctagcttcatttaagcaacttaaacttacttcaggaacaactcttggactctctggcatttaaaaaaaattgtgccaagatgacattgggtaactactaagtaaataaaaatcatcaaaaaagtggaatgcctttggtaacgtaactgcagtaaaactgatatgcagtaccctgaggaatgtatggtaatcatgatccttttggaaacttttatataacttttattggaaactgcaatataaaatagcatttgtggagcacttgctacatgtcaagcacagttctaagagcttgtcttatattgtcatttaatcttcatgatacctcatgaaggaggattcagttatcactcatatttcacaggaaattgagtcatacagggattaagtaacttatttaaggtcatactgtaaatggtggagctaggattggaacctaaattgtcttgcatagaaactgttctcttagccattacgccatgttacctagtatgacagtggttagcagaagtttgaatcagtaatcccaccccttaaagtttatgtgacaaaataaatca

SEQ ID NO: 44316 - DNA, 1026 bp, Homo sapiens
aagtagcatatgtccttcagtgttctattcaaaggactcaaactctcgaacttgcccagatcttcctgaagtatgaataccattggcttcttttaaattgggagactatgtaaatgaaaataaaataaattatgaaaaagcatctgtaatacctaaaaacctattattacaaagatcgataatgtggttttagaaaaaaaggaactctgaagtaaatcgacacaggtgaggatgtggtcaacataatgcagtcagcaacaaactaactcttctttcaaaatatctcaaatcataatagaactgcagatgcaatagcaaacaatttcacagaactgctaagagcacataggaaaacccaaaccagccatctcagacagatggagatgaatgcatacagctatacagtaaaactttctctaaagagagttgctaggggaagaaaaatttcaagtctctgaagagaaggtaattaatccaattatttcaatgaacttgagtttctccttgctacaatgtttctggagtatttatgtggttgtaaccttgacagtgtggtcatctatttataatatagcagcaagggtctgatacaaaattctaatatcataaaagtacatcattaaaatgctttatatggagtaagaatttgaaattctgattactcactaaagggatatatcttaaagttaataagggaaagtggttacagtggagagagaaaacagaaagaaaactgaaggaggtcaactgtagaaagaggactggatgaagtgggcactgaatggattgacttatcaagggagacctatgttcttcataacccctatgctcacctctccaacatgtaaatcacattgtgtggccatggcctttttatttgactgtctcactgctgtactataagcttaaggataagatgatgactgttgtgttctccattgtgtctccagcaattacacaaggtctaacatacagtaggtacttactggtagatgttaactggatggatggatgggtgggtggaag

SEQ ID NO: 44317 - DNA, 1059 bp, Homo sapiens
ctgcttttttatatgtattcaaatttatagcttagtctcttttaaagtaatattctacattactttcccacaagtgatgatagttaatataatgtatgccagaagaaaatgatttaattttaagaatgtgattagatatatttgacagtaagtgctcaaaggagttagatctgtcagtactttcgaatgtctcctgtattggaaactattagactgtcacctctttttaggcagaggcttacacatgttggtatttctggtacacagttaccgagaagagtgccttgtccgtaatgagaagcatttaataaatattttggactgagtgaataaatctagaatcctaaggagaaattggaataacttgattgtaaattactacattttctttagttttacttaaatggatattatttcaagatcttcattaagcaagtaatttagtaaaaaacttacagaatccataaaaagaaagcaaatctcaaatttgtagttaagagtaataagtgttaagattagggaaggaaaaactgtttcagaactggtttgaatgaaaacatagctgatgttgccaaaaaatggctttttgtgagttgagtccatttccatcatgactctaatatcattaagattgaatcattcatttcctcactattatatctagacagattggaaatttaccagaaatggaaattattaaaagtctgactgatgaacaaagaaggaatttgactatgcatatcagtgacaactaaattggaaggtcagtaaaataggcctataagcataagcaggttaaggacaagctagggaaactataagtatctccttttttatattgtcttacctattcactaattataacacatagaaacaatataaaacgatgaagtttaagcagtaattgttttgagaaaccattctgttgataatttacatttatgtttattaggaaatattgttattattacttagaccaaagttgactgaaaattgaaaactgtgggctacccgtaaggttttttgctttgaaatattcaatacctaaaagccattttg

SEQ ID NO: 44318 - DNA, 1492 bp, Homo sapiens
atcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagt

SEQ ID NO: 44319 - DNA, 1053 bp, Homo sapiens
tgccatacatatgtatttctaatctacagaataagctcatgacataaattatctctgtatatattccagaaatcaagactcaaaaggttaattaacttattcgtgtacacatagcaagtggctgagctgggattgaacaaaagtctaactccgaagcttgggtcctttccactatgccctacttcttccacgtaaagaagtcatttgactttaaaattatacagtagccttcataatgttcttaaatttcctgaaacaagcaaagttttgaaagtcgcctgtggtttcttaaagctggatttctcacagtctctccatttatatattgccgcatttacgtatactgtttcttagttgggctttactttctttagacttctatgtatgttttccaaatctggtttgcataaggtgactcatacaagaatgcttctaaacaaacaagccgtatatgtttatgtaaatgttacattttaaaaatgacattgcataaagaaattttgttcctgttatctgaaaaattttaggatatgaaacattgaatactttgaccatgacttgaaagcccagctgaatagagatctaataactagtaacaacttttattcaaagggcattacttacaggttgtttattggtcttcttttgtgctcagtttatatctgctctgaaatatgagccatgtcttaaaatttgataatgagctgaggataatttggagaagcaaaggagaataagtacttgtaggcttgaatcaattgatcttatttgttacttggaattaaggtgtaaggagtactccaaagtcacaaatgacttctagattgaagctatagaataaaggtttgcaggccaataaaattgaagctctctgaaagtggcaagcagacaaaacatcctaaatttattttggcttcccctggacatacttgccatctgttcagttaagattacgaatttttgtattgccaaaatactaacttgtgtgtgatcataatagaatatttaatactgtttttctaagcttgctttttcaaaataacctaatagaag

SEQ ID NO: 44320 - DNA, 1099 bp, Homo sapiens
taatcttgaagttcttaatatgccttgttttctgtttctgcagagtgtctataaatgtgatttcctgaacttacagcttcagcaaccactccagcttgcacaggatgctatagatgcttttttgaagcagctgaaaaaccctattgattctcttcctggagagcttttccatgtggttgttttctctctccttctttcttattttccatctccttaccagcgatggatttgctgcaagaaagcccatgaactgttagtgttaaatggtttattactaatcatcacacctgattcctcccatcagaaccgtcatgctatgatgatgaaaagctggaagattgctatagagtccctgggctttaaacgcttcaagtactcaaaattttcacatatgcatctgatggcatttaggaaaatctctctaaaaaccacaagtgacttggttagtaggaactacccaggaatgttatatattcctcaagatttcaacagtatagaagatgaggaatattctaacccttcctgctatgttcgatcagatatagaagatgaacaactagcatatggtttcacagaactccctgatgcgccatatgactcagattctggagaaagtcaagccagctctattcctttctatgagctagaagaccccatattacttttaagttaatatagaagcaaaaagcccctttcagtccaggctcctaaactaattgcttacaccaattggaaatactaacatgaactcagtactgaaaacctggtttgcataaaagaaatgcagaggtttacagagtttgctatttttttctacttctcaattttaaaatttattcttatatagaaagcttaaagtttcatgcagagtgactcatgtcatagcagaaactactgttactttagcatttagcactatcatagaaaggtacctttttctctttagtgctattgtgaaaacaagcataatttgctatatgttttccttttcaacttttcagtgttgactataaaccattgaatggaaaactttaagatgtagaaagctgtagattgcactttgatgactcacaagttaaatgtgatacagaaaaataga

SEQ ID NO: 44321 - DNA, 1075 bp, Homo sapiens
cccacttacaggttagaacatgtatttggctttctgagtcattatacttaaggtcatggcctccagttccattcatactgctgcaaaagacgtaatttcattttttatggctgcgtagaattccatgatgtgtatgtacatatatacaccacattttctgtatttagccatttattgatggatacaagttgattccatgactttgctattgtagatagtgctgtgatcaacatacaagggcaggtgtctttatatataatttcttttcctttgggtagatacctagtagtgggattgctagattgaatggtagttacatttttagttcaccattttccatagaggtggcactaatttacattcctaccaattgtgtggtgggaatccttgccaacatctgttgttatttgactttttaataatggcctttctaactggtgttagatgatatctcattgtgatttcacatgattagagttgttgaacattttttcatatatttgttggaaacttgtatgtcttctttggaagaatgtctgttcatgtcctttgcccactttttaaatgggattgttatttttcttgttaggttgtttgaattccctttaaattctgcatattagccctatgtaggatgcacagtttgcaaatattttctcccattccgtaggttgtgtgtttactctgttgattacttcttttgctgtgcagaagcttttaagtcccatttgtctgtttgtttttgttctcgtgcttttgaattcatgcctagaccaatctccagaagagttttccctggatttttatagtttcaggtcttacatttaaatctttaatcaatcttcagttaatttttgtatatggcaagagatatgagttcaatgtcattcttttgtatatggctatccagttttcccagcattattgactgagtaggcttttttccccattgtatatttttgttgactttgtcaaacatcagttggttgtaggtatgtagctttatttctgggttctgctttgttccgctgatctatatatctatttcatactaataccacactgtttttgttat

SEQ ID NO: 44322 - DNA, 1033 bp, Homo sapiens
gaatttgtacgtatttccaggactcctttgccaaaatatttatcttgcatgttgttgaaaatatgagcctggacctaagaaacacgttcaaaaatcagaaaatagttacagaagtctcaactgcagtccaggtgcagtggtgcatgcctgtaattctagcactttggaaggttgagacaggcagatcgcttgaggccgggagtttgagaccagctaggacagcatgcaaaacctcacctttaaaaaagatacaaaaaatagccaagcatggtggcatgtgcctgtagtcccagttacttgggacgctgaggtgggaggatcacttgagctcaggaggcggaggctgtggtgagctaagattgcaccactgcactccagcctgagtgacagagcgagaccctgtttcaaaaaaaagtctctactacatttggcattattttgattggtggaaccacatgtcatctggaacataacctgaatcagtctggagaaagatgataaaatagaaagagagaaacttcaactgtggaactttagagaaggcttacgtataacaatgatgaagccacagtgaacgtaacagttcagaaagtcagtcatcagtgggatacagattaagaggatgttcttggatttaatgattaagtcatcattgaccttgagagggatttgtgcaatgttaagggtgacatctaaatttcaatgatttgaagttcaagtgggatgtttatagagtaatgatactcttaagaggagtgtgatagggaaaggttaaggggtaatgccttgagggaaattcagatcagttctacctaacttgactatagcacatattattctgtacctgtaaatctatagtgaaaaatattaatcttttgaatatctaaggtaaattcatttttaatgctaatacacagtattaacaaaattaggggatggagagagcttagaagaagagaaaaggtagagactattggaattgaaaagttattcagtctgaaaagctataattgaaaagcagaaaaattttctg

SEQ ID NO: 44323 - DNA, 1075 bp, Homo sapiens
accgctgccatcaataatatacacatacaaaattgtaagtatttcagtgatggtttttaatagttttgcttctagtttgaaatccgttgtatattaatcaaatatatatacaaatatattgaaacctgaaagttaaatcctacatgtattttgctgaaatcttaattggataagtttataattacaaataccagatgtctctggaggcttagtatttaatattaagatattaagtcctctgtaaaaaatgcataatctagtttttaaagctatttatgcagaaagaatgcttattatcaatttcaaaattaagtttccctccttagattttctagacttaaaaaattatattgaagtttattaataaatggagtgcaaatgatctgtgcttatcagttgcttctttacagttacttacctaatttttagcactggctcagggaataactttggggaaatatctaacattctgagtctctttttcttctataaaagaaatactgtatgatcgtctagctggttttttggggggaattactatgtttaaaaaccctaaagctctacattttctgatcatgacccaaagctctaggcattgagaatgaaaatagtgatgattataaggttcaaatcatttgagtaacagctcaattggcaaattttttagaagaatgtcatgatccaggtttctataatgtgactgtataaatgaaaatgatgattgcggaatattttctactgaaagaaattgtctggaggaattcataaagtaaatgtgtttccttagtcagaggtacagcattcaaaaaatttattctgttaacctgtttataagattcttaatgtagttctgtatattatgtccctaactagtaaagatttacttattattttagtaactagaattgaatctaatttaatttaaaaggttaactagacttatatgtaaaattatagaaagataatttagagaattgagtcttcactgtttagttttaactaacaaatgactattttcaaatgagttttaagctaaaacccttaccagagcaaatatctgtgaatattactcatt

SEQ ID NO: 44324 - DNA, 1035 bp, Homo sapiens
ttcaagtaaaagtgagttctataaagtcttaaaacatcttaaaattttttaaatcttgaatttttgatgtacggttcagggtattccagcatttatattgactttggataatgtttattttctcatgatattgattctaatgctaaaaatatcagaaaatgaaataatgcttatactagttctcttaatgtggtaaaattataagaaaggataagtatattgactaaacttaaacatgaattccctgaaaaactcccgattgggtactatgcttattgccccggtggtgaaataatctatataccaaacccctgtgacgtgcaatttacctatataacaaacctgcaaaagtaaccctggaccaaaaaaaaaaaaaaaaaactagaggctaaataaataaacatgaattcccaaaaataaagcattgtctttctcatggacagtaagtttatgataacttctggtttacattttctttccatttttattcaaaaatttttacatctcattttaaaactgtaataatgcatatttcattcattcaacaaataattcagagaaaaatatgtatttaacttagttcttttatttaataaataatatttagtgattgtctactttgtaccagtcatattataggcactaggagtacaataaaactcacaaaatccttgctctcatagagcttacgtgctagttggggtgagtggccggaaacaatatgttggttaaatttacactagtgcagacagtggtgagcaccatgagaaaaataaagcaaggaaaactaaaacaattttaagtaaggtaggggaagagggtttcactgttgtgatgtgtgccaatgatataaaggaaatgagacagtaagccagccctaccaagtctgaagaccttgaagaagaggcatgctggcatgtttcagaaacagccaggagaccagtgtggccagagcaaaatgacagagggagagaggtagaaaataaggcaatgaacagctagattttgtagggtcttgtgggccattttaagaca

SEQ ID NO: 44325 - DNA, 1059 bp, Homo sapiens
ctctggtctttttgataatagccatcctaacagatgggaggtagtatcttattgtggttttaatttgcattttcctgatgattagttttgttgagcacccttctatatacccattggccattttttgtgttgtctttggaaaaatatctattcaggtcattgcccattttttagtcagattatttgtttttttgctattcagtttgaggttttttttatatatcttttggatattaaccccttatcaggtatatggtttgtaaatatatttttatcttaaaatggcatcacatatatacttgctaacttattttctgtgctttgtatgttttaaaaaggagaattaggatagagttattgagaaaaaatattatttttatacacatcaagtatataaaaatcaagtggtcctggcatgtaaaaatgcatgaaccttagcaccacctattcatttttttcacatataagtaattctttatctatttggtggtgttactgttcatttctccttgagctaataaatttttcgaaaagatctgtgtactgctattaaagaacttaatggatatgactggactgtcagctgcaaggttttcttttgacaataacacaaaatgaaaaagcctttttaataagcttaaaacaatggtctctagaaaaatgacattgaaattattgcttttctgaccttggaactcttactttgaaaacagtaactattgtgaaaaatttaaattctgcttttgagtgactgctatttattgaaagccatcctctgtagtttgaattttatcttagcaactaatttaatttgtttatacttttcatgtttattttttgagcatgatgaaaatttaaatattttgtcctccactgactgagcaccctaattaacttctctaatttatacaaattgtaaatcaaaagtagtctttgcttttccatttatactttctattgggaaaatcacacctggttttaatagacagtatgtataaatgaatgacaaagtaccgtaaggatggcagatgagggaagtgtaagatgataaagtgggag

SEQ ID NO: 44326 - DNA, 1086 bp, Homo sapiens
aatttcttttttggccatcagtcaaaacagtcaaataagttaaaggcatatttgaattggagcaacgtagagagaagtttttgttgttgttgttgttgttttgataactgtttttgccttatgctgcaatgtaacaggctctaaataatatattaaaaccaaaaaagctttaactgtatgaaaagattatataaacaagtcctggtttttaaaatggggcaggagttttacatcatccctttttgccaaagggatgatgtccattagctgctcaatccctttgggttaaaaggcttttaaagccagttttcctctcaccataacaggcagttattacaaggactggctccctgaaaggtccccagaggaaatcaaggagactgtgtttccctctgagtaattgaaaaaaaaaaaaaaaaaaaggcctcaaagccacaggtggtttggggttttgaattattcacacctgacattcatagctgcctccttggctccttctggggacgtaggacaacatcgtgctcagaaagacctaggttccaagttcagcttggaggcagaaagcaattcctttttcttctctctgtgtttggaaaataatagattattgacacaaatattaaaactgatactgtaatgcatttcctggtttgtgtggttttgacagacaataaagtaacatttaacttataagggtattcaagattatgggataaggaaacaagtcattcattatcccacaatataaggaagatgactataatcctacaatataaggaaaagtgattataatttttaaagctgaattgacacttgagcttgaactagctaaagttaattgttccttttcatagctttcagggggaaaaatctgactaaatagatgaaaaaagagtttgttctttttcatccaaaaatttaaaagttaaaagatcattttcttctgtgaaaaagggaatttttgaacatttttcttaagcatttttacttagacacaattcagtacaacaatcatttattgcgcatctactgcatgtgtgattttgggcaagttatttaacctttctattcctcatcagtaaaaag

SEQ ID NO: 44327 - DNA, 1050 bp, Homo sapiens
gaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaaaaaatttaatgttaaaaaaaaactatagacattgacatggaaaagagatttaatgttttgaaaaaaaactttatattaactgagtaacatcctcctgatgagaagtactatattaaatataaacccattatgttataagttaatgtttcgtgtccatttcttatttggggctgtttgtatccattgtggatttttatatgagctaagtggagaagggcaggatgccttgtgttaactgattgcggtagcttgaagagacataatgagaactgggcagcattaaggtcagagaagcccctgatagaaaatctagaaatatagaaggaaaatgaaatggcttaaactgatttgtacgccagccaaacgaaatatcctctctggcctagctacttaaagtgtcttcaagccagcaacatcacctggggcttgttagaaatgcagaatctcaggccccacccagaccaattggatcaggaacagcattcgtttccaaagcccaagttaatttgtatgcacattacaaatttaagaagactgccaacttgcttgagcccaagaatcattccaggcacttgataagactttttgattccctggtctttctcctggttgtatagctgtgagatggggcctggaactccatgtctaacaagggtcctcagtgattcatttgattctcaagttgtagccagcataaagtagtctaaggaaatcaaactttagggtcacactggaggtaagtagtgaaattttttcctaaaatgcattttccaatctgtagctctccagatgacat

SEQ ID NO: 44328 - DNA, 1068 bp, Homo sapiens
tgttaaatttacatgataatattctgaattgcttctccattttgtcttgaatttcactgaatttcttcaaaacatctagtttgaattctttgcctgaaaggtcatatatctctgtttctctgagatttgttcctggtgacttgtttagtttatttggtgaggtcatattttcctgtaaggtttttatgcttgtggatgtttgttggtgtctgggcagtgaagagttaggtattcattttattcttttcagtccgggctggtttgtacccatccgtcttgggaaggcattccaggtatttaaagggacttggatgttgtaatctaagttcttggtcactgcagtggtatctgcattaggaggcagctaaagattagtagtgctgtggctcttgcagactcatacatgtaccaccttggcggtcttagataagatccagaagaattctctgtgttgtctggcacggactcttgttcttttcccttaccttctctcaatcaaatggagtctttctctgtgtgctgagctacctggatcttggggaggggtgacacaagcacccctctggccacctccaatgggactatgctgtgtcagaactgaagccagcacagcactgggttttgcccaaggcccgtggtaaccattgcttgattactgtttatgtttctctcaagggcctaatgccctacaatcagcaggtagtaaagtcagccagacttgtgtcctcaccctcagggtgatgagatccccctccccatgctagtccagagataccagctgggagccagggcctgtatttaaaaaccttaggaatctacctggttctcttttctactgcagctgagctggcacccaatccacaagacaaagtccttcccactctttcttttccttttcacaagctacggactctcccaaagctattactgccccaggcctgtggtgagtactatctggttggttactcccaatgttcactcaagacccaaggtctcttcagtcagcttttggtgaatgctgccagctccaggactctccctttagtgcagtgggcttccctctggcca

SEQ ID NO: 44329 - DNA, 1025 bp, Homo sapiens
ttcttggctatttgtgtatctactgataatagacagtatctctaggcttctcagtccataaaaggacaatagtgatttaaactaatttaaactcttgttttaaactttcttccttgtttccatttcctaatttacatcacttatactttcacgtatacacgtcaagtttaaaagcatttgcattctgttctacacccataattaacacctttctgatgtatacgtaggttgactttcaagagttgaaaacgaacacattctgggctgtgactttttttctggataacttcactagttatcccacctcattctactttttgcctcctgtaacttcatttaaaactcttatttgctgatagtccatctccagttctttcttttttgtgattctatgttttctctatatctttacttttgaaaagatctagagaagaaaagaggataaacaaatgtgctcagtccaccatcttgcaccactccttttgaatttgattttcttcccggtacatgtgcaacagaagaaatgtgttgtaccagtaattatctagttaggctttcatgttttcagtaatgtactactgaaactatgttatatacatatgcatatacatatacatacacatatacatatacataatcatttcatttctgcagtttaacattttattactgctttaaatttaggaaggaaagtggttctaattcaaaactctctgagatagcaaatagagaaggcaaacacatggtttgggaaatttgaagaagcatgtaagaactgaccattgattttaattcagtcttttcactctgttaaccttaaaaatattgaaaacaaaagcactttcttttaaagcattggcatgatatcttgattccttattttgtctccttttccaatcacagtttacaatacacctggcaggcaataccccattttgatatcttcatctgcactgcaggataagatagcaacatgctttccttttgcctctgccttctgtaaagtctggtttacagttttaata

SEQ ID NO: 44330 - DNA, 1052 bp, Homo sapiens
ctggtgagggactatatacacatatatgtaagtaatgttttcttccagaattcatgtttaaaaattgatccagctttctcctttgtctgcgtgcccctctattttgtgttaagttcatgtaatcagctacagatctatataatgcagtccatctgacactgcacacgtaacaaactcaacatgtcctgtccccaaacctaactccgggcttcccccgccgacttccttttttgttatcagtcatccagacttagaacttctcagcctgttcttcccgtcagtcagtcatagcattttccaaatcctcactttgtggcacaccaagctccagtactaaggttgaaaggacctatagccatggcaactgatcatcaaaacacagtgtgataagtgcatcagaacagtgttagctggttattctgtaaacattggcccctggcctggggactgtgagacaagaccgggttcctctcaccctcagagagctagtgttctcatggaaagacaggccttcaaaaagaaactgtctatctgtgtaggatttgggaccttggaggacagtttttattcaggaggcattattcaagtgctattttaaaaaaacgtgttcagtgtgttagagttgtacatccaaatgcccggctttccctcaggcttttaagttaattgtataagctttatctttctgtgtataaatctagcaaaatttaacaatcacctttgaagggactcatagcttaattacatttctttaaatagtttggtctttaaaacttcaatatattttatttctctttttaagaacttctgctgtctgacaaatcttcccaagtacttaactaactcttgtaaaaccagaaaattaaatttataaattgtggctcaaatgatctcttaatagccttgtaccatgtacataaacttaataaaattctcttaccccttcttaagaccacaaccctaaactcagttaccattttaaactggacatgaagctattctaatatatgaaattcctgtaaacatttcaagtatttaaaaatacccaatat

SEQ ID NO: 44331 - DNA, 1067 bp, Homo sapiens
gcaccctttctccctgctccactcttccctgggatgttgtttgtgttgcttggtcaaaggtagtcaccactcccactctcacttcctagctggaaagagagaacctggagggcaggcctttcctttcaggggaattgcacacgtcattcctgcccacatcccattcaacagaacttaagacacctatcggtgcctagctgggaagtggagccttttgctgggcaattgtgcacccacctaaaaccaggtggtctgttactaaaaggaagaagaagaatatgatcattaaaagaaagtagcaaattataaatgtaaaatggataaatgtaatgctttgcattcattaaatacttactacatgccaggcaatatgccaagtgctgttatgacttattttatttattcttcaaaacatccctatgagataatttcatccattttacagatggggaaactgaacagagagaggtaaaatgctcaaagtcatgcatctagcaagtgatgaagccaggattgtgcaagtctctgatgtgtatgagatcaatctgaaactaatactactggtataaaacattaaacataattttgcttgctgccttaatttcgatgacctttttaaataaatgagttggaactatgacccttgacaaaagttgtttccatagactgtgaattgatgcctttgttttcacgccttatgaaaagaagtattcaaaaccattccattgatcatctagccaggctcacagttaggattagcttttgtaccagcagccacagtagcagagaaacattcaaagcctcacagtgtagaaaaggtggattctcctgaatctgatactttgacttctttgctttactctttgtcccccttcctaaaagcatgaaagtatgcctgtgatgggaaggagatgtatatcattacttggcttaagtgaaggttgaagggtgtgatcaactggttttcaggaatgttagcctcagtctctcagtagaatcagctggtagaaccactcccttctctccccttcccccttgtcagcttctccgtacaaggcaaggttctg

SEQ ID NO: 44332 - DNA, 1041 bp, Homo sapiens
tcacaggaatggaagcatggataactttgcaaacaggaaggaccctggagaaatctggggatggatttttttctttctttcttttagacggagtcttgctctgtcgccaggctggagtatagtggtgcaatctcagctcactgcaacctccgcctcctgggtctaagcgatacccctgcctcggcctcccgagtagctgggactacaggtgtacgccaccacacccagataattttttgtattttagtagagacgggtttcaccgtgttggccagaatggtctggatctcctgacttcgtcatctgtccccctcagcctcccaaagtgctgggattacatgtgtgagccaccgtgccaggctggatttgttaatttaaatgtgtctgatacacatgtatatcaacatgtcacttaatttaaaaaaaatgtataaatcagatactgcaagggaaaattaggaaaaacattcattggagtgaaaataaaagatgaagtggattgcttcttactttgattatgatttagccctcttttctaagtttattctcaactaattttacaacttaagctctacatgtttagctagtaaataagtgtcacaaagtcttgactttacctcatttctttcctccttgattctcaggacagtgagtttctgcttagctatcttttcctcatcaactagcctgacttcaggagacaggacaacctctgctgtcttttctccccaaggcaacccttttctcagcctttctgctgccttttatagagaaggcacatggtgccctgctgtctatgctatttataattattttctcaagtgaaaatctcagaatgactcagcagccttttttcagtgttcaaactatttcgaaccaaaataatatatatttatcaagtacagttaaaccgttcatcccagtaagttaaattctaaggactctactttcacaagttggttatagggaagtgtcataaagcaggtattagcacttttcaaaatttcctgggagaaattaaattttatgattagaatatat

SEQ ID NO: 44333 - DNA, 1029 bp, Homo sapiens
ttaaacttgcatgataaattttcaaactacctctccctccttggagaactactggcccatgatctttccaactctagaatcctgtgtttccatgtaagcttttatctataaaaattatgactaagttagagccccaaggaaaattggaatgacagaagttagccttttaatgaattgtagtataaattacccaaactctatttggcaacctttatagccaaatgttaaattttttaataacattcttaattctaaatgaactagaatttcttgttcctcctgaacttgccaaatagacacatttcaaatgttagatgaacagaagcctaaaccagaaatcactccaggcaactgagtttccatacccttggaaattgttttttctgttttttctttttttatttgatacatttgatttaatttggtttacaccttttccctattgaaacatatcttttaaaaattatcctccatgtatgattggcttaaaggctaaatcagaaaacaagaatgatctgggctatgacattaaccttctccaccctctgaagctgatgccagaagctgttctcactccttccctctgccattgcatgtccagtcattcccttcctcctggcatgttgtgcaggatgctcaccttactaatgtttgcgtatgacactgcaaaactgattgaccttttgctaacatcattagagtagctgtatgaataccggtctgttctgtcttaaccactatttaacctcttaactaagtattaccatttttatgattgtcgggaatttcagatgaacagtatagtctcatgatgaagtcctatttttcccatatttaggcaggatttattaaaataagcttgtctatgctagacaacattggaaatgttagtgaagatataaaacatatttacagttttaaaatacttggtatttataaagcatttttcttttgtaaagattttaaaaatatattgcagacctctaaaaaaataaggcaactgatatatcttctgtagttctgtgtaag

SEQ ID NO: 44334 - DNA, 1028 bp, Homo sapiens
gatccctgtgctgtgatttaaagcatctggttattgttctctttttctgtagttaacttcaatagactttaaaaattctctattgttgtaatttagatgtctttataaagccatttacgtctattttctcattttaatgtgtctttaaaatatttcttatcacaacactttttgaaaatgtggcgtttttgctaacccgagttatgtaattgttagaaaattaataaaaatctcacaaaaagcatttccttggtgaaaagaaaattctgtatattaatcagggttttcctgtgaatttctttcagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaagaaaaagacgaatgaattagaagaggaactctccgctgagaaacgaagaagcacagaaatggaagctcagatggaaaaacaactctctgagtttgacactgagcgggaacagcttcgtgccaagctgaaccgggaagaagcacacaccactgacctcaaagaggagatagacaagatgaggaaaatgattgagcaactgaaaaggggaagtgacagcaaaccaagcctctctcttccacggaagacaaaagataggcgtttggtttccatatctgtgggaacagaaggaactgtgacaaggtctgttgcatgccagacagacctagtgacagaaaatgctgaccacatgaaaaagttgcctttaaccatgcctgtaaaaccttccacagggagtcccctagtttctgcaaatgcaaaagggagcgtgtgcaccagtgccaccatggccagaccaggtattgacaggcaggcttcctatggtgacttgattggcgcttctgtacccgctttcccacctccaagtgcaaac

SEQ ID NO: 44335 - DNA, 1044 bp, Homo sapiens
ctccatctgcatccatgttgctgcaaaggacatgatttcattcttttagttggcgtatatgtgtatacgtatggcgtatatggtgtatatgtaccgcattttctttatccagttcactgttgatgggcacctaggttgattccatgtctttgctgattgtgaatagtgctgagataaacataggcatgcatgtgtctttttggtagaacaatgtattttcctttgggtgtatacccagttatgggtttgctgggttggatggtatttctgagttctttgagaaatctccaaactgctttccactgtggctgaactaatttacatttctaccgacagtgtataagtgtcctcttttctccacagcctcttcagcatctattatttttttgactttttattaatagccattctgactggtgtgaagtggtatctcattgtggttttgatttgcatttctctgatattagtgatatagagcattgtttcatgtttgttgactactcgtatatcttcttttgagaaatgtctgttcatgtcctttgcccacctttttaattgggttatttgctttttgcttgttgatttaagttatttatagattctggatgttagacctttgtcagatgcatagtttatgaatattttctcttatcttttagagtgtttactcattgagtgtttctttggtcatgcagaagctttttagtttaattaggtcccatttaacaatttgtatttttgttgtgattgctttcgaggtcttagccataactttttttttgtttttttgtttgtttgtttttgttttttttttttttttttttgccaatgctgaagtctagaatggtatttcctagattttcttctaggatttttatagtttgagatgttatgtttaaatatttgatccatcttgagttattttttgtatatgttgaaaggtgtgggtccagttttgctcttctgcataggactattttgaagcttttaaaagaaatccttcctcatattcaagtgattactatatctgtttcttatataatt

SEQ ID NO: 44336 - DNA, 1032 bp, Homo sapiens
ggcagaaagtgggataggtaggagttgctgattgaaatcccttctgtgactgtgaaggagacgtaccagaaagcagcattgcaacagtgcatgactcagacagaagcaacaaccagagagctggtcattcccttatactctgcaaggacagacgatgagagacttttccttgtacctagtaaggagacacagccaaagagactgcatatccttaacacagatgggggataaaacctgtctaggagcccatttgtcttgaagggcctgccattggcctttactctctctcactcaaatgaaaggagcaatgaaatgtacatttgtaccagtctacccaccgactcctggtattaagcattttaatggcaaccagctgggcagtaaatatattcagaaagattctacctgcatgccctgcttatggataaacaccagatctgagttaactcctactggtccaaggatggagtaaacaagaaaaaagaaaacataaggcccatgagagatcttgcaggatagaacaaggaagataacgtaacatttaaaatgcaaaggaacaacttacatttgacaaaattattacaagaaacaaattttagagtgtcatttttagataccatctgtcttgtgtcttacaatttgaagaaacctaggcgttgaagtgaaggaagccagattgtgaagggtggactagctgtgaagctagggaagagaaagcattgaatgggacatagatcttggaggcagattgctgggagtgagtccaggctccaaatttctagccatgcagctgtgggcaagtcccttgccctttcttggtgctacagttttcttatttttaaaatgagcatcacagtacctacatagtgtgattgttatgagaacttaaagtatatcagcagaattaaagcatgtattggaaatagcagaaaaaatcaacactgttaaaaaattgaatcagtaacaaacttaagaagatctcccggaacccagtggaaaggattaaagtgataaagtagaaatgaagattcg

SEQ ID NO: 44337 - DNA, 1030 bp, Homo sapiens
caggaggtataccttctctcaaggactggggaacatttatttaatggtggtaaaattactggcagggtttgaataaagactgctttcaaactgttgacattccttttcccttgattgcttttgatatggagtgagtcatcttcagctggtagatggtgagaatgttaagatctttctgtttattttttccagatgctcagtggttcatgcagttggcgagttactcctcagtggccaaggctggttctttagggagtttggggctgggcatagtgggagtacaggagaacaactgcccccaccattcgctcttaatgtcctggggaatttaatttttagccaagtcaacttgtgtttcttggagctataaaagggactgtatttaaaatttttaatcacaacttctgcctacagaaattatctgttgtattatccctagtagacaagaaactacctttatttctgtgtttttcactttttaaattttgtgtgtgggaatgcttctgttaactcttgtttccacagccactactgtttccccatttcttttctcaagtcacatataagtaagcatttctggaattatcatactgcaaactacattctccccgaaatattgaaacacctcagggaaacttcctgcattctcttaaaggttttcacttgcttgcttgtttgtttgtatacgtgctcatgtgtctattttttgtaagaagcttaatattgggaattttttttctgttatgagttgaaatgtcctagacgattaaacacaaacacacatgatcaaagccaaataagaaaatgcttctgtgcagtcataatgatgagaacaacatacaagtgggggaaactcctgtttgaaaatttccaaaacaggaatttggtctagcaaacatgaaagcagtacctgctaaatcctgcaccagcccccactcccagtatgcttgctacagtgatattcatctcccacaacatgatgattgcttctttggacaatatcaaacccttcttcagaagccttattttg

SEQ ID NO: 44338 - DNA, 1034 bp, Homo sapiens
agtgcttctacaataaaatgagggttgatgtcaaataattttggcttatgacactgtcagaatgtatgatgactgctcataacacaaattatgttatgaatttatgaatatactttatagtttaagtactggtagttgacagtgaacaatatttttctatagccctgaaataatttggctagttattttctctaatcaacttatttcagtttagaacattctttttctttggagtcttgctctgttgcccaggctggagtgcagtggcatgatcttagctcactgcaacatctgcctcctgatttaagcaattctcctgcctcagcctcccaggtagctgggattataggcatgtacctccacgcccagctaagttttctatttttagtagagacagggtttcaccatattgcccaggctggtcttgaactcctggcctcaagtgatctgccagcctcagcttcttaaagtgctgggattacaggcgtgagctaccacacccggcctagttttctgcatttctgcttttgaactttccaactctctttattgtcctacttttcattgctttgaaaaccagcttgtgcatttttttttttctggatgcccctgaaatgatttaaaatgttagaagcattttggtaaccctgtaatctaaaattttgttatttagctcctcttcctgttggtgagttgaatattgacttttgcagggcatcattgctctttctgtggtgtctcttaacagtctcaaattgtctctaagtcaatttgtctttacgttgtaactaaccaagtgtaactcctggtaaacattcactaccattttttcttcataacaagttaagctgcccctttaatatgagagtatatatatatttttttagttacaagaaaacattaaattatataaatatttgcttaaggaaaaaagtcacaatgtttaagaagccagtttttaaatcttgatacatttaactaaggaatgaagatggttagatcgtaataataatggagcaacttttaacattttt

SEQ ID NO: 44339 - DNA, 1021 bp, Homo sapiens
cagaaaggatctatggagagcaacaaacctggaatgcttattaagtaattgcctctgatgttctttgtctatgtgtgtctcgttttcaataacacttttttgaaatataagtttttctctgaataaagacatttggaaagtgtagcttttttatcctagcgaaggactgtatagtcaaaaggggatagaaaaaataacaaatattttaaacattttaaaaatattttacaataaacatatttaaaacatgtaaaatatgaaaaaagatggcggggcgtggtggctcaggcctgtaatcccagcactttgggtggccaaggcaggcgggtcacaaagtcaagagatcgaaaccatcctggccgacatagggaaacccccgtctctactaaaaatacaaaaattagccgggcgtggcggcatatacctgtaatctcagctacttggaaggctgaggcaggagaatcccttgaacctgggaggcggaggttgtagtgagctgggattgcacccctgcattccagcctggcgacagagtgagactctatctcaaaaaaaaaaaaaaaaaacaaaaaaaaaaaaccgaaaaaagacatggacactgtatgatgtgaggtgaaaatactgtagaaaaagcaagtattgcttgcatggtaaaagaaatggcatagttagaggagaaaggaattaaaagattccaacactgatcatacttcctctttgtttatttctctaaccaatttatagagaaaatttaaaaaaaaattattcattttattacatctatgtgcaggagaaatctaaagaagaagaaactaagagaaaaaaagagacttctccaactgaaggatgcaataagaaaagtcaatgaaatgtgcataagatgacttgtgagaaaaaatgttgctatgcatgatgatctgaatgttgggtatggaaggctaagatgaaaaagataagggacagatgttgagcccagtgactggaagaataattataacaaacaggaagtagaaggaaaatg

SEQ ID NO: 44340 - DNA, 1036 bp, Homo sapiens
tttctgaaacgtaaaatctaaaatttataccattttttttacatacccaataaaaagtgaaatctttattctctgggtctgcaaaagcaacttttgaagtcgaatatatttatcaacatactcactaggggcatttttttccctacagttttggagagagtctgaaaaccaataccagtatggtttagatattcataattgtttacacatgtttcagtaacgaaatatatttcggggggttggcactttattttaggatttgggatagctggaaattattattgttatggttaaaagtgttctaactggataatggcattaaaaagaatataacattctggaatccttcctcttaacatgaaaaacattattttattacatggagttatttaaatatggattggctgttgtctggctagttacacatggaagtgtctaaagaaataagttcttggaagaagcatcaaatagaaaatgactatcgtttcttattattaatagtattattgttatgcagagaaaccttagtactctttttaagggctagatggttaatattccatatcctgcagtgacagattctaattaaatatttaagaagtgggacatcttttccaatcatgatacacagtatctattaccttggagaaatataaaaatttttttaatatttgttcctccagaaaaaaaaaaaaagatgattaataagggactctgtgtctcccagaacctgaaatgtttcttctaaggagctagactatgttaagagccaagaggaagcaaggttcaaaggaaattcatctaatatttgtgctctggttatgaaagggggtgagaagctgttcatcagcggcatgtgtccagttggcagggagggctgaatgccagactggggttatcgtgatcacagatggacttagcatgggaaagaggatgtcaaagactcccagtcagtgcagctattttgggggctttacacaaatcattattttttcattctgtaccactattgcctcagtcaaatgtatttgtttaa

SEQ ID NO: 44341 - DNA, 1166 bp, Homo sapiens
tgttttaaggctccactgacttcgctaatttcaacaggtcaaaaccaaaatggatgtagcattagacactactgattcccagtgagtccctctgccttgccccaggtgttccttttaattggaaatgtgtatatgacagaatagtttaacagctgaggctactaattggggaaaaatactatctaggaagataaactgttcaataggttggtcattattttttatctttccctatggtattacataaagtttcaaaagcctattttaattgtactctaaaaagtttatggaaataagaatgacataataattcttagaaaggtcatacgtttcccaaattatgttccatgaaatacagtttttttggaagttagcaaagtataaaaataatggtgtagatcaactaaactaactttttctttattatgtgttttaattttttttatttttatgggtatatagtaggatactaatatacaatacttgtaggatacatgagattttgatatagccatacaatgtgtaataatcacatcagggtaaatagggtttccatcactttgagtactcatcatttctttgtgttagaaacatttcaattgtactccctcagttattttcaaatgtataatagattattgttgactgtagtcactctcgtgctatcaaatactagatcttattcattctaagtacatttttgtatacatcaaccatccccatttcccactctccaagccccatccttcccagcctctggtaaccattattctactctctatctccatgagttcaattgttttaatttttagctcctgcaaatgagtgataacatgtgaagtttgtctttctgtgcttggtttatctcattttgcataatgtcttccatttccattcatgttgttgtaaacaacaggatttaattcttttttatggctgaatagtgctccattgtgtatgtgtattatactttatccatttatctgttgatgaacacttaggttgatttcaaatcctggctaaagtgaatagtgctgcaataaacacgggagtgcagctatctcttctatatgctaatttcctttcttttgggtatatactcagcagtgagattgctggatcacatggtagttctacttttagttttttgaagaacctccatactg

SEQ ID NO: 44342 - DNA, 1027 bp, Homo sapiens
catctcagaatccataaataattcacagaaggtatcaatttatttataggataggtggccaagagagacttccggctgtttaccaatagcatggctctggaaactccatcctattgaaataattcctgttcttggcaggagtaacttgagctaagggtgtatccacacccttttaaaaacatgccagtgattttgcataactaatatgaacattgaaatgggtattctatagaggcaagtgtgaacagagatcaggttttcccctgtgggtatgcacatgtagtggaaactgatggacccaaatttgtgccatttgatgactaaactcattctgggctgcaaaggcattgtttcagttttctctcataatatttttaattcagaccaaattttatcttataagtagaagaagtagttgcaaataattccatgccctgccaatgacataggcactgatttttaacaaaaggctcataaactctttttatgatactgtaaaactggagagcctgtgcccattaaaacataagcttcatgttacatgtaattaaggcaagaaggagaacataaaaatgtaagctttaaaatgtatcttgtattacatattaaatgcacacagaaaaatactgcataagttccatttcaaaggcaaaggtaaggacaagcaggaatgatcacagtagatgagtaagcccttcggtgaaaaaatcaatttagtaaaaaatgggtttctatttcaagttcttgaggatatactatattgatgattagagcacattttctatttttcctgatttttaactcagaaaatatcattagagtcacattcacttgctatttggttaatctaggttataatttttggtccactaaagacttaaaattattatttcctttttctttggaaattggaccctccaatgtgattcatactaagaagaggttgaagagatgtccaagagctgtcaaaggtagctagaaggtgctcttatgtatccatccccaaacccagtggagaagagcttcc

SEQ ID NO: 44343 - DNA, 1085 bp, Homo sapiens
gtattttgacatttaaaatacttccctcaattctgtaaattaaaagaatagttattttacagttccagggattgtgaaataaatgttgcagttttttaaaataatgaaaataaatactcttggttttgctttgtgaatttttttttttttttgtattatctggcaaagtaatatacctacagaacttcacaaaaactcacacaaggtttttcaagcatttattatactgcctaacttggaaaaaaaattgttgctgtggttaaaaatagtaatatcctagatgtgtcttaacatgtaagaagctaagtatctagatggcggaaaaagcccttttattaagactgtaaaaggatagcttttccagatatataaaatgttaaaagaagacaaagattggttatgttaactggtgtggtttccttttgtctcagttcaatcttgtatagattgtgccaacttaactttgaaagcaataactttatactacattttcagatacctctttaaaatcggttttagacatgaaacagtgctcatttaatattaagaatgttctttattaaaatcaaattaacattgacatagtatttgaaatggtgcttatgggcttatcgatgcatattttttatttgtaatccgatgctgtcccagaataagtgtattgtaatgtgaatgttaaaattgaacaagagaaagcaggaaaataagtggtatttgggaaattaaaggaagattgaaccagagtctttatattcctgaatttaattggattaatgggaaatttatcattgttctttctatattggacttgtttttaagtgaatcagctatgttataattttatgacagatcaaagctgagttcatttagcctgttgcactttatactttaaaaatttacataaattttaaataacttgaccaaaaaagttataatttcattcagtttggtcaacaaactctcccttaattgaatgcaaaatgtgccatgttcagttagtagagcaattaaaagtggaaattcatttagaatactttgtttcaaaggaatatgagagagataaattacttgtgttgattagggag

SEQ ID NO: 44344 - DNA, 1064 bp, Homo sapiens
ggaagaaattgtgtttgaacctccctctttaagaatgtattgctcctttttctgaacatttgttctgattgcatagtacttatatttcaatttggcactgattttaatctgccttgcattatataattttttttctttttttcctctttttcctgtgtctgtcccccttcacccaagagtgagtcttaaaggcgctattttggtgcttcacccagcatctagcactgggtgctgcaatcagtaaatgctgattgagtgaaaacaaatgtaggtaacagagaattaggatttctacatggaaaggaagagtatttccaaagtgggattcacataaagctgtattagttggaatatcactggtagtcagctatgaacaaacgttgagttactttattctcctactttttatttcttgatttttcctgatgttaagaacctgcaaagtgtttttgtgtgcattttagctatttgatttagacattatgagggcagatggttattttgatgtcaaaactgaagtgtagtactttgtaaccttactggttgccaatctgttgaattggccaaaatttaattgtgtggttttattttaattctcatttcagactatcttaacgaagatggatatatggttatcttcgtcatttgtttaacatcttagtatatgaaaggttaacatatttaatccagtaggaggattcttgctataatcactatcttaaggacccataagattaaatagttcttttggtgattcgttttccattttttaaacttacttgacaatttctataaattatgtagctttatatttattatatggtattattttagaaaaataaaacacatttctagaaaggaagaatgaaaattttgcctacaattagtagttgaaattaccaatgtcgattatgaatttttaaaaacaattttttataaaactttattttgagataattgtattgttttttacaaatccatttgaatatacagagagatggtgcatactgtttactcagtttctcccattggtaatatcttgcaaaactataatacactatcac

SEQ ID NO: 44345 - DNA, 1132 bp, Homo sapiens
tccacatgcaaaataatgaaattggactcctacctcatattgcatataaaaattaactcaaagttgacctaagatctaaatgtaagagctaatattgtaagtatcttcaaagaaaacatggcgtaaatctttctgactttgaattaggcaatgatttcttaaataaatgacactaaaaacacaagcaacaaaagaagaaaataggtaaattaaaattaaaaccatttgtgtttccaaggacaatatcaagaaagcaaaaatacaacccacagaatgagataattttttttaaaatcatgtattagttaagggaggaatttgtatttagaatatgtaaagaactgttacaataataattaaaaggcatataattcaatttttaaaaatcaacaagagatctgaattaacagttctccaaagaagatacacaaaaggccaataagcacatgaaaaggttctcaacatcactagccatcagggaaatgcaaatgagatctacaatgagatatcacttaacactcactggaatagatatataatcaaagtgataatatcaagtgttggtgaggatgcagagaaattggaaccctcatgcactgttggtggatacccacgtgatataaaaacaaatgtctacacaaaaacttgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtggtatgtagattttatctcaagttgttataaa

SEQ ID NO: 44346 - DNA, 1591 bp, Homo sapiens
taatatggatacaaacaccaagaggccttctttgcagtgtcatttatctcttacaaatctcattttcctttcagatattatcagacgcgacacagcctcttgaaagtcagaatttttctcctgtggtgagagatgtaagttatgagcagaatattttttcataaatgtatttttttactaccatttttgctctcttctctctgtttctctctctctccatctttgtcattctgtcttttctctatcagtcatgacaccttgtttgtaggactaaaatgtggatactaaagaaatgtcttgtgtcatatacatttaggcagtgattacatccaacggtacattacctgataaatataaatatatccagacactccgggagagcaggtaagtattgttcaaatcctcttgttttatacatttattcttatcttggaattcatgagtattttttaatgcttcaatgggagttcttaatattaggtttgtacactatataaattttgataatgtttgaaaatgtaggaaatccaaactaagtggctggctgaaaccactgtgactgtttcccacttaacagtagtatagcgtcattttggctttctaatagcctgtgtagacgtatgggtaagcaagcaaaaatccaaaaggattgtccttcaggtagcttcttgtttttctctagcttttgatacatgatcatgcctcggttattttctcaaaggaaaatgagcacactagcctttctgtggtgctttcagtttgggttttagttgaggatttggactctcttttgtttagtataatgttcagggaagtgaattcgtggttacaaattaagagagttgtgaataaacaattgatgaaagtaagaggtagttttctccagggattcttattagggggaaggtgccaaaaagtaatgtagcaaatctactcaagagaatagttactttagaaaggtctttagctaaggcccttgtttccttaattgattttactacttaaagtttgaaaacattgattttatttttttggaatattctggtctcctccagccaattgcccttgatctgtgtttatatctactctgctggtcttttcacattaaaaaaggaacccatgtactgaagtatcaggagaaaccagagttggaaaaaaaaataacacaactgttttatcttctttttcagtggttctactacaagcagtaaacaaagagatctgcccagatcaagcgtactatagttaggcttttccatatgtgctggtttgattatagttactttttaatgtgtcagtgaaatatactggcataagacactaagtatttactttttttctttgtgaataagagaagctagctctataaccctgtaggagagtttcttacaagtaaaacttcacatctgtttgtttttcatagctctatgttttggttctcatcatccgatggtcttttacactactgaaactagtgacatgtctaacatgactggtcaagatgatatcttctctcttatgtgtcatatttcatgaagcagcaggtttacttggctccgattgctagaacttgctgccctctttcctgatg

SEQ ID NO: 44347 - DNA, 2026 bp, Homo sapiens
gagaactgttaattcactgtgactgttgaaggcaaagccatatggatctgatttctttctgaaacaagagttggctggagttaacagcatgtgttggatctatatggtgtgaatctgtaggctttggcaaagaagagaaaattccaggtgttaaacattaaactaggaatcctgcttctgcttaaaagcaacagatcctatatgattccagttcagtttcttcatctataaaatggggatatgtatctacttaataagatttttgcaaggaggaaataagatgatatccataaagtgctcagcatagagcttggcatgtgatgcttaatcaatggtaactactgttacatttgtttaaataatgaaagttacagaaattattatttaagccttccatgcaaaaagtgaaagtgaaagtagcttcccaaataaactgaagctcagtcccaggcacttctgtctttttccctagtcttccaagatagttggcctttgcaagtatatgtgtgtatgttacaagtgactgtctgtatttgtgtctgtgtgtgtgtctactgctttcccgccctatcccagacaaagaaggtggtgggagaaggagcagggattattactgagtgagggatgagtgaggttaacattcaagcttgggctagaggggagggattaaattatctccacatgttcctcctgatggagtcaagaatttcaactcataataaaagttacaggggtatgtagtcacctgtgaattcatgaaacacagcccctgctgggaagatgggatggtttctggacatttgtgtatgttcaaaggaatcactatctttggaattggttttattagaaactgagggattcaggttctagtttttcttttggcttcgagaagactgaatgttatgggtttgggattgagtttaatgcaatctattttaaaaaacagaagatatgaataaacaaaaaatagatgcagtatataacagtcgtttactgaaatgttgataatctattttgcatgcatattttgccctgaataaaagcctaaactcctaatcatcagcagtttctcttgctgtgtgcagctttttttcttcttggccatcttcctaaagccttcttagctggactcttcgctgtttggtctgttgtctgattctgttgtaaagtgtcctataaatttactgtctaggtagcaagtagttgtttgcccccaggaaatgtacttgtatgcttaattgtttggtcaagccttccccatccatcaagctggtgctcttccaagattgcagtctgatgtaaaataaatgtgtttcatgcaagcttttctatatgttgttagcggtgatgggtagaaaatttctggaaggtataaaaatcattgaatccttatattttgctgccaagtttacatggaaaactaagttttatcattcaaatgatccagcaaatcatcatctgaaatgacatttggctacaaaattgaagttggatagaatccaattgaagttgggtagaatactgttaagcctggatatttatgctttaaaaatttacataagatttattctgcataggaataaatgaacctgtatataaaaattaggagcatctgggtgaaaataaaatgtttactagtgtcactttaatttctttaatttggtttaaagtattatttccaccgtattctacgcttcctccagctgagggaaaaaataactacttttagtagatgatatctttcaatcattctctccttcatatgcagccctggttctgggactagggggacaagacacttcttgtaccaagagaatgctgctttgagtagagtttattcatgagaatataccttgcctgccacattgagagaagcccgttacattcatcatagtaagcctttagtaactatttcttgattgactgaatgagtggaattacacaatcttctcacttgaatagcagttggaaaactggttgaggcaggtcggggtttaatacaacagcagacggccatgtatggaga

SEQ ID NO: 44348 - DNA, 1046 bp, Homo sapiens
ttatgttctacatttctaatgtttttgtaattctcagtgtccagttactactatgcttaatagaatcagaatatcagagcctgaaagggactttagtattatatttttgtctgggtaaggaaactgaagtcaagaggaggaaccctacatctagttatgtgtcccagctcccatgtctaagttttcccactatactgtactatatttcacgacatttgttgatctatgagatcttggaagagaatcaagtttttttttttttttttttttttttttgcagggttagggggatgtgagtctcttattaatgtgtctattttatctgtttgtttgtttgtttgttttcttgctgcataggtctttataatgtttattgaatttgctttttcatttattcattctttcttaaaacacttgctgttttcccatgtgccagtcattgggaatacagagatgagtaaaacacaactcatacacatttgcagtttagcaaagagacagacaagtaagcagataagcattttggactagactccgatttagaactaactttgtattccatttcaatgaagctaaaattataagctagagaccaggagaaatatgtgtcatgtttatggatgactttgagtaggtgatgggctggagaaaatatgaaaattctcagaccagattagttaacactaatagacctcctcccccaaagtctaccactttcttcttaatccagtaaagtattttatagagggtttaacatggaagcattaaaagaatgtacccacgcacaggaagtcaaagtatgaccagtgttaatgcaagcccaagcctagttctagcaagccttgaaattgggagggatttggattagttctaggccatcatctggtgctgtgttaattctggaactcttttgaacctctccaaaaaatattatggtttggatacttagtgtaggccaagactcatagccatagagctgccatacttatttacagacaccagtgcttcttgggaaaccatggattttaatatatacttgtattttt

SEQ ID NO: 44349 - DNA, 1070 bp, Homo sapiens
caattaaaaaaactaataatttcttattaaaaacttacacaggtacatattttatttttgctacaggttgttcaaaaggtaaattgtgtgcaattagtaatgttctgaggggaaagtgaatttgtcatctgatagtaacaacattttgatgtagtcatagtaattgtagtttgaagcaatagccagagtctgtcattccatttactccccagaaatacaccaagaagatgattggcatggacagccacatgaacctatcagtggattccccaagatcatttttgaaatgccaactgagtatatatctatgtacacgcatataatctaagtgagctaagcaaattttatcttctttcttcagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggt

SEQ ID NO: 44350 - DNA, 1041 bp, Homo sapiens
catcgctactttaaaatgtaattttaggtattgactacatgacttatagcataacacatcttctttttgatttttatgtaacatgcaggctaatagaaaattttcctttgaaaataatttacctcttttttcctgctgcttggctgtccattcagtcctataacatgtatttaggatcctttgttatttacaaattacaaagcaggccactaggctgcaaagtgcaaaaacactgtttccgtgaatatgttacagctgaaagactgtaacgttaattcatttaaagaacagcctaggtcaacttaacagattttctagcaaagcatacaattctgttaacaggaaattatagcattattgacttcaagtgctgatctgtggtcatttcagagtgttttattaccccctcattatcgaatctgttaaatgaatactgcagaggttgttttctttttttgttctcctcccctgtgccccaattctcccttctagcaatggtacagcagttccatgaaagtcatttgcgtgtggttgactgatagattagacctccaactccatatttaccagctgaagacgctcatcaagattgtgaaggtaaacaaaatgtgtttagatatgaattgcccactaagctataaggaataatggcaagatactgacatacaagaaaactgtatttgatgtaactaaaaagtatcacttattagcaatgatgtgctactgtttacttccacgtttagttagattaataaatgaatataaatttatcttttttgcactaataaaaaaaatttgctagcaaatactcacagtttgagattaaatacataaagccccagcacagttacctgaaggaagtaggttcacaataattttacattaattttcttaagcatatgaatgttttatcataatacaattacttcatatttattaggatcatatatcattgtgagggcttttgtactatatttgccagaagaataaggagagtctcagttattttattatatgctggtacgaaagtaatacattgtc

SEQ ID NO: 44351 - DNA, 1119 bp, Homo sapiens
aggcctaaggtgttctgtttaatcatttattttggcatatatgtcaattttcaaagaattagaattagagcacaatgaaaaataaattaagatttaagactagatggaatataaattctctctttgtatttgaagaacattatatctctacattgccattagaaatggtagcagttttgagtgctggcaagctttatgtatcagttgtagatagctcttatttttaggatgcaccaccacattttgtctctggctttattgctgctgtagttataaatgagtattttaaatgagaaggccctggacttttctacctttgcatggggtttctttggaactggactttttattttacaaatgtttcccaaagaagtcttcataccctcctcgtcctgtacctagaatcaaggaatcagtgctggaccataagtagaaaaaaatcacatatgtagagccccacaaagcagcagcatgaaagggagaattaaggggagattttatgtttgatatcttaaaaaggaaggcacaaataatcttgtatatatcacattggactttgtaacacacatagtttttgtttgattttgaattacaaatggactgtgacaccaaaattattcatgttcttagagattttgaggtttttaattggccctatactagtttattctctccatagaatttcagagttgaaggagacagaaaatggttcatttacttcccttctcagtgcaagtaacccctctctaacatcccttacaaagattcacttgggtgctgtttaattatttcagtggttacaggatgaccatatggcagcctactgttaagtattatgagttgaaattctgtatctttgtgaattttacccattaatcctcgttctaatctctcttctgcatgatagctctttgcatatttaatgacaattttcatgcctcctcttcccaggaggtgtggtggctattcacaggcatatgttgtctgaggaacgcttattttctagattaaacattctcaatttattcactaaacccactacttaaatatttatttagcacatactaagtgctagatcctggacatacatgatgagacgtacatttcttgccctcaaat

SEQ ID NO: 44352 - DNA, 1086 bp, Homo sapiens
cggccaatgtcaagaaactttttccctatgttttattctagaagttttatggtttgaggtcttaagttatttaatccatttttacttgatggtgtttagttgatggttttgttgatccatttgtttatgttgtaagataagggtcaacttttattcttttattcttttgtatgtgtacatccacttttcccagcactatttattgaagaaaccatccttttctcttgacactcttgtcaaagatcagttgaccgtatgtgtgtgggtttatttctgagctctctgttttgttctattggcctatacatctgcttttatgccagtaacgttgtttacattaaaaagtttacttaaaaaagttaacattgtttacttttttgattattttagctttgtaatagattttgaaattaggaagtgtggtgcctccaatttattcttttgctcggaattgttttggttatttgaagctttttgtggttccagatgaattttaggattggattgctttttctgttactttaaaaaaaatgccattaggattttgatagagattgcattaaatatgtagatcactttaagtagtatggacattttgactataataattattgtaattcatgaacatgggatttttttatttatttgttgtctgctttaatgtcttcagtgttttatacttttcagtgtacacattttttgccttcttggttaagtatatttctaagtactgcattatttttgatgctattgtagatgagattgttttctgaacttcctttccaaatagtgcattgttagtatacagatatatgaatgactttttaaaattatactttaagttctgggatacatgtgcagaatgtgcacttttgctacataggtatacacctgccatagtggttgttgcacccatcagctcgtcacctacattaggtatctctcctaatgttagccctcccctatccccacagcccccgacaggccccagtatatgatgttctcctccctgtgtccatgttttctcgttcaactcccatttacaagtgagaacatgcggtgtttggttttctgatcttgtgatag

SEQ ID NO: 44353 - DNA, 1029 bp, Homo sapiens
atgatctgctcatgtgacagctgtgtgaaatgagtcagcagtctcaggccagtccctcagggacagatgtcgagatcacaaagccacctcagtgtttagaatcctcattatccgtaactgcacaaaagcagatgactacctgggctgtaggcattcatcagccctcagaaccacttcattccatggtcccattagttgaggatgaaggtgaaaacacattaatatggcaattcgggggagcaaggggccctacttgggccaaatttgttctcagttaaattaaaatgcatccatttctggaactaacaatccagtacctttaaaatattatataccccaagacaaggtccaaaatcttttaagaaagctggaattcactggcatctgattagccatttcatgagtgtctttgtgtaacagcagtcaggtgaagtggtgctgttcacctgattgtagagaggccaggattttggactgtgtctgacctgtgatttccctgggcttcatgaagtaaggattcctgaatggttatcttaatgtaagttcagaatcacctgcgggaaagcaggcacagtttgcctttgagggcagatgtggagaaacttaacttaagaatgaattgaaatctaacaaagccctagaatctaagattatcaatccaacttgaagtattcgaagaattttattttcttcttttaaatttcaacttttgttgtcgatatgggggtacatgtgtagttttgttacacctgggtattgagcatagtactcaataggtcgtttttccatccacatctccctccctccctctcccctctactagtccacagtgtctgttgttcccatgtttatgtccgtgtgttctcagtgtttaattctcacttataagtgagaacatgcagtatctgattttctgttcctgtgttaatttacttaggattatagcctccagctgcatccatgtggctgcaaaggatatgattttgtacttttttatggctgtctagtattccatggtgtatatgtacc

SEQ ID NO: 44354 - DNA, 1033 bp, Homo sapiens
ggttcaaatttaaagttatattagcctctgaccaacaaatgtccctcatcttggaagaggatgaccatcaagtagcttgcatacagctcaggtgtagaagtagaattcccatttcagcagtgactgtcaaaaccaattgcatgagcatgaatgctctaccaaaaatgtttgttcattatttactgatttataatatatatgaatgaggataatactttacattctcatgttttggagcattttcagctcatcatctcacttggttattgctatatctatgtttatgaacctgattatcagtgaatcacggaagttgtaaaaaacttatgattagttagacaataggtgtcacctgttcattcgtctgtccctcaagagaacttaaatatttttagaatatggccctcagaatcatgtcgctgtgtatgtgagtatgtgtgtatgtgtgtggcaggggcaggggatactatagacactggattgtctccagaacctttaggattatcaacaaagtacagaattgcaaactaatcttgtcttggggaataaataggcacaaaatgtatttcaaagtcagactcactgtttttgctcgtttaggcagccatcctccttttttgttttaagttataaatttttattatattttgagggcaaaagtaataaggccaggtgcggtggctcacacctgtaatcccagcactttgggaggctgaggcgggtggattacctgaagtcaggagttcaaggtcagcctggcgaacatggcgaaaccccatctctactaaaaatacaaaattagctgggcatggtggtgggcacctgtaatcccagatacttgggaggctgaggcattagaatcacttgaacctgggaggcagaggttgcagtgagccgagattgtgccgctgcactccagcctgggcgacagagcaagagtccacctcaaaaaaaaaaaaaaagtaatcaaaggcctcaggttttaataaaaagtagaaaagatataaagaaatcaagccataaatcaaaagat

SEQ ID NO: 44355 - DNA, 1029 bp, Homo sapiens
aaagtagaatcttgaagcagagtagcagtttgtcaggcaaagattcagatagcctaactctgcatgtttgtagattttacaatgcacaattttttttagtttagaatatttaacttattttaaatcacacttatgtggcaatgtagttagtgctaaaatatatgggatggtccattgaagacccattacctaactttatcaaccatacatcatcattctctgagccatgaggtctccaaacctcagagtcatactcctctctggcctgcaaattctagccactcaacaatggctcacaaattctgcctttggagtgtctgtgcatctttcccttcttttctattcctactatcatctttccatagttcactgttctactaaaccagaccctcaggatccatatcagacactttcaccaatccttgttggaggcaaccaccaaaatacattttcctaaaattaatttattctgaggccctgctaagaaacatttgccccaagttattcataggatatagtcatctagtctacttattatcttacttaaagtctcccataatcacccatcattcttagcacattcttactccagccaggcaagtacaagagcccacgtgttcaagtctcaccttcactgctttttagctgttgcatttatctttttgagcatgtttccttatctgtgagttacatgaataaaaaacaaagctgttaggaaaatgtgtgtgctaacacgtgggaagcgccctggcttgtgcctgacacataattggctctcaagaaaatgtaacttttttttttttttttgagatggagtctccctctgtcacccaggctggagcgcaatggtgtgatattggctcactgcaacctctgcctcccaggttcaagcgattctcctgcctcagcctcctgagtagctgagattacacgtgcccaccaccgggcccagctaatttttgtatttttagtagagatggggtttcgccatgttggccaggctggtttcgaactcctgacctcaggtga

SEQ ID NO: 44356 - DNA, 1052 bp, Homo sapiens
aaatgcagtcttgaaataacaaggcttcttcctttcgcaagcaattttatagaatttgtcaatctccagagactgaatttgaaagcaactaactggtgacctctcatttacttactaacaggtgccaacaggtacaccaagagacatagcagcatggctttcatggcaccttgttaatctgagtaggttacatgtatgaaaaagtcttttccaattgtacaaaactagagtgatgaaaactgacaggtttctacctctgtatttatcaacagggtttataagtacccaaagactgcacagatgaaatagtttggcaaattaagaagggttcattacttgtaggccctagctaagtgaccatatagtttcaagcaataaattaaaaggcctaattgaagctttttaaaagacacacatttatattttaatttcaaagaggagccctttaaaatatccatgaggcatcaatgcatgcacacacattcacagtgattggcaaatttgtgatgttagagctgtagaaatattcaaagtggcactaagcccaaccctactctgtaaacctggtcttttacacttgccaattgggagactttctctaaatcttagcatgccctagaagaccttgattatgtatcaaaggaaacaaagacatacatgcagacattgagatcttttgactcatttctcatcacccaaggctgcaaatcttttcaaatgttatatttcatattgtggttactgtctccaaatatcttctctttccttctccttcaattgccttgcagctggcaagtctctggagtccctgtcccctgccattgcccactgaacagaccatcttcatctttgtgccttgctgtgctctgccttgcctgtatccccattgttcacaggcaaacattctccttgagtatggaaaaaagagttaaagcaagggtcaggcaggaaatgagagtggaggcgtgttggtcctccttttatgaataaaacaaatgacatggaaagaatgtattaggtaagtacacttaaaaaacaggaaggaataggca

SEQ ID NO: 44357 - DNA, 1134 bp, Homo sapiens
gttttaataagccctcctaaagattttaagacacaccaaagttggagaatccctgatctacatgaactgacttctgtctccaaattcatcttctgttataacctccttgcctactgtcattctttccttacaccgtgctttctttcttttcctcaaacattgtacactcatacctgctttagactttaggttgttacatgtgttttaatctgaacacacatgtgcacacacacaattggaaaaaattggtgttcgtctctggatggtagagctactggttttatatatgtgtgtgtgggtatatatatatgtgcacacattaccaataatgtatattgttggtatacataatgtatgtgtgtatatatacacatattaagtatatacaaaagtatatacataaatatatatacttttgtgtatatatatgtgtatatatatacacatatatatatctacttttctaattagaacaaataacttctattaagttaaaagaaaaaaccttacatgatctgacatctgtagataaagttttatgaatagtatatctggggagcttggtttcaacatgaagtttttttaattaaaaattcgggtagcatttaaatttgaaaatgaacaacagagcacttaaaataggtttataccacagcaagataccactgtacacctactaaaatggcgaaaatgcagaaaaactgacagtgcttgtgagaatgcagaacagaaactcttactcattgctggtggcagtgcaaaattgtagtcactttggaagacaacttaccagttttttgtataaagttaaacatagacttactatacaatccaaaaattgtactcctagatatttaccaaagggtttatgaaggttgtgtcaacacaaaaatctgtgtgtgaatgtttaaacagctttattcttaatcactaaaacttggaagcaaccaagatgttctttagtcagcaagtgaataaaaccgtggcacatccatacaatggaatactattcaataatagaaacaagctattaattaatgcagtggcatagacgaatgtaaatgcaaatggaagaagtcaaacccaaaagatgacatattttattattccattcattctagaaaattatagggg

SEQ ID NO: 44358 - DNA, 1051 bp, Homo sapiens
cagaaaatccaacatgcaaatgcaaagctaatcattaggcaataaaacatttataagtcatttctaaggaaagcaaattttatcaccatgtgttatttgaaaggtaatacataatcctatttcagttctgagaattgtataatagcctttccatttttgtctgttatagtttttggtgatgtaacagtagataccatgattctgcacaatgacttggaatacttagtgagcgggctagagaagcagttaatgtacgactaccgcacgatattcagagcataaagctgctttttgccaacagtttgatgtttcaggttctggcaatgagttaattaaattagtaagtgttcgctttaattcattcaaacttggggaaccatcatggtctctagtagaaacaaccaggttggcctgaggaattcagattcaatttgcttggccttcatttgtgcattacctttagaaaacattttttttcttctatttaatctttattctaaatatcttataggatttaggattttgccttattataataccaatatgtgacctgttcattcaggaaacctctgttgagatcccaaataggcactgaagatatatgagaaatgttcattttctttagagcaggcaggatagggagatacagagggttatgtgtaacagaaaagaggtgcacagagtattagggggttgaaaagaaacaagttgaagcttctcatcctaacctacaaatccctacaggcctgcccttgaccaatctctcatgacctctgggatctcaccttctccctctgttcccccgatcttctgcagttcatccaccctggacttcatgcagtccctcatacacttatccacccattctcagtgtcgcacttgctttcccgtctgcttgtagtcatcttccctcttatctttgtatagctgctttcttggcattgagaatctcaacttaaccatcactgagaataatccttccctttaacccagtgggaggtgtacattttctggctgaccactttttaattttgggactgtgttaattacc

SEQ ID NO: 44359 - DNA, 1032 bp, Homo sapiens
ttaaggatacaaatttgctgttttggaatgttgcttcaaactgtagagaaattttaaaaggatatttaagaaccttctttgggaaagttaatttttaatgtagatatttaatctgtctgtgacattatgcaattttaattttgattatatgtaaattattttaaaaagaaatatgtgaatgttatattggaggagaagaaaagcaggtggcctgagactctgggactgatctgtgaagtggtgccagatgttccttccaatcccatgaatgaactggtgcaagtgagtcagagactagatgcaggttgacaagagcatgctggatgctttcaaattgtactacacatgcagatttcttaggttagattttgaatgatgtcaagggagacaacagtaaaggcagtgcttttctggagcattcagcagccatttgaaagatggctgctttaggctttcatcctccagccggttctgtgcactggtggtcattttaaactaggcttaatgttgtaaaactatataccctctgtctttaagagagaaaacctaagtgccaggttggcaaacattaaagaaagagccaagaatgtgagggaacaaagtgctctcatttgctgttctggggaatataaatttattataatcttctctaagaatgattcggcaccatctaaatatcaatatttggaacatccttttaattgagcagaagaaacaaatctgattgcagagttaaaattattgaatggcaatgctgatataatttagcaagaaaatagaatcttccaaattgatattgttaatttttcccttaatagtttttatcataaatttccttttgctttaaacttaactttttctaagcctttagtaaaaaactgaatttatagccagaagagatcttggcacattaatgtaatgtgaaaatttactaattttagaaatatgaccatatcactcttcaataatgtgagtttttaatgcctatttatgaaaaagcatactcttccaacaacgcatatctgtggtaag

SEQ ID NO: 44360 - DNA, 1066 bp, Homo sapiens
aaaaagaaaagataaggcaaagcaatagaaatcacagaaactagcctgttctttatagaaaggaatagcctgagaagagaaatagaagagcaggccttggggaggcaggtaggatctaaagccaatggagctgctggaacctggctcaggtgtatgtctgtgagatttaccccaccttctccatgtttcaggaaaagctttgagacttctcctaactgtaacagtgtcacttctgtatgtgtttacccttgtgtggccccttgtttttggcagcacaaatctagaaaatctcaaagatgttgcttgcttaagagtcagaagctcaggatcgagggctgttctggtgaaatgtgcaggatggcagcagccaggcaatctctggcaactcaagaaggaaaggacacgaatgggaagggagccttgccagggctgccacatgacatcgatggccatcgtttggtaatatcctttgttccagagcttcaggattagcatcaggagtggaaaaacaggaaactctcttctgaaaaaggctatttacattactttgagtcagagccagtaacatattaattatcaacattaaggcatgaaggaaacttttaaaacactaagatagaagatagcacataccatagttaagatatgaaattagggataatagaaagacaaattgttattgttatcaagaaaacataaaaaagaataaaaacaatgtaagtagcacctagattagctattgtgctaataaaatttcatactttggattctttgatttgagaacaatgtatctgcagtggtgcgcattcatagaacaaaatattaagaaaaaagtaaagatcaacatgtacagtctaaaatgagtggcataacagtacaagaatctgaaattgttagctgtgatttaattgaatcaggatattataaaaaggaacaggagtgaaggaagaataatctgtcagtggaaagtttaattttggaatattttaaggaaatgcagttaatttcaaatatatatattcttttagagaaacaatgttatataatattaaaactgtatatttga

SEQ ID NO: 44361 - DNA, 1078 bp, Homo sapiens
ataaagcaagaataaaagcagtcttatatggcttatggaggattcttaggaatattgacagcataacagaagtttaatgaatcttaactgatacttagatacataacttagcagaacagagagatttaaggccaaatctctggtgtctcttcccaaatatgaccttattactgtacttatttttacccaacccttgctacctgtctcatgaacatcttactctatggttgtctctattgttgtttttattttattttattttccagtagtaatggacaattagaagtcccttagaggtattgctttccaagcctccattctttctagttatgataagtgtgtgagaagttgcagaggtggtaaaatcagggatggggacaggtatattctagccccccagctgttgggcaattttgagtaaaaattacatatgatgaatattgacttggatattagacttaccctactgttgatcttcaagtccacactcaaataatacatgattctttccctgctgaaaaaccagctagaactctcagacacaggtatggatgttgggttcatatctccagttgttttcctaatcatctttttttttttttttttttttgcttataaacaatggtcatttatttcttacagttctggaggcttgggaagtccaaaatcagggtgttagccaatttggtgtctgtgaggacctgcttcctgattcacagacagctgtcctttcactctgaacacatgtggtggaaggcatgagagagttctggagtctgtgtataagagcacgaatcacattcataaggacatcactctaaaggatttcgttgtagaggtgggagacatacaggtcaaagtaaaccatcttactggtattttttactgtatactgtgtctcctacacattttaaaattttagagagatttggggccaacattatgacattagttaccatgtattataaaacattttgaatcattgtggagtatttggctgaaatatttgtagaaactctggctggattgctgaaagcaagtggtgttagcatctacacctaattgtaattgttttttg

SEQ ID NO: 44362 - DNA, 1047 bp, Homo sapiens
cctgaaatacttcacttaagagttaaattaactaactctggaattctcttacttttgtactttttgagatacctgataataatccctcccccacccccttattgtttaacagggcgttttgagttgaggattctattactttcagtgaaaagcattctaactacattaaaggtgtaagatagaccttaatgtttatcatattgagagtctgccactccttatcctagaaggatggtgcacaaagatgatgagctgaaagtcccttgccttctgctgctacttttcttcttttgcagatagccacttctcatccatgtaatacctggtcaagaaagaaagcaaaaacttcagacatttctgaggaaagtaattttatgtcatattttcttcttctgaaagcaactctgttaaaccacttactgcctgctggaaaaggccattgtgtggcatgagttggtcagcatctttaagcttttacactggctcacagttgtctgctcctgaggctgtcggaatactttgtgataaacataaagtcactgtttcttgcaaatatggcttcagcatatggatctgtgccatgaaatgccagatggtactgaggcacaaagttcttcctgcgtgagagtgatatcatctgcaaaacagagctacccatgctgcatctcaacaaagaaatcctttgctcttcttttggcctcattgagtctgtccatgaacttattatttggacaacatacagctatcttagaattcttttcttaggctttgtctgctccctcctcttcactcacttgcttcagtgctggagtctttgctcaatggttatgacaagatatattcttcaaaaagtaatagtgaatggtgaattttcttctactgtagatgatttacaccagcaaacactgtacttaaggtgggatatattgaaggttggcatctgcgttgaagaaatctgcatcctagtaaggaaaaggccacataagcaagtgacagatgtatgtatgaggtacagaagtggcacaaagaggataagatgacataatt

SEQ ID NO: 44363 - DNA, 1062 bp, Homo sapiens
attgcttttgccagtggatttttctgttaccttaaacaattattcttactatacaggaaagctgttgattttttgcaaatttaactgtatctgttgaatttaccagactcccttattggcaaataattagttactcaggtcattctggttttctgatggaatgtagtatctaaaagtaaagtggcattttaaaattttggtctagctttcagtgggactgtcattaatttttcacctgttaggaatgctgtttatttggcatgtattaacatcagtttatggtttcaaaatgtttggactattgaagtgatatgttaatcacatttttactatgaaccgttcttgaagaaatatgacaatcttagtggatacttattttaatataattgattcacttttaatctttcaaatatttagtgtaatcaccaaatgtggatgtttttataggctactcaaaccctacctctgttcttcagttctcatctaagcagtattacattaacattcccactgaattctaaactttgttttctttcactcctccatgtcaagtgtattagctcaaaaccagttctaacactgaatatatgaaatctcttcctctgtccatctcctccactgttcctcactgttcctcacctggtctattggaactgtctcctaagttgtccccctacctgatttttctctccctaacacaaatctgatcatgccagttcaattgttaaagttaaatgatggtgtcaccttacctcactgttcagttgacactctttttctgtgttatttccagcttggactgttgtcaggtacccacagtttctcttttttagccttactgcattgcttaactttacagaaacaggatatggagtcctcacagcctagaatgatccactgccttgttttcttcgtgaccacaccttccctctttggcttgggatccccctcaccttgggagtgttttacaacactgtggctattcacactgattttaggtgtctttcctttctactcccattgtatcctttacatttatattctacttattgcacattattt

SEQ ID NO: 44364 - DNA, 1021 bp, Homo sapiens
ccataattggtagaacatttataacctatgcttttattaaacaaactgatcccaaaataaatgaaggaagaattcaggcctagaaaactgtcttaactaactttttcttggaaatggttctggttctcatggctaaatataagcctgtgttaacacgttgttccatttatagaaaagaaaaaaatacagctctttacattttaaagaaagtaaattggtttgagatgacttttttgtcagttcttttgtttccagagtgtgtgtgtgtgtgtgtgtgtgtgtgtgtgtgtgtgtgtgtatatctatctatgtctatatatatatatttgttgttgaagagacttgaataaattttagcaaattaatttttaacttcaaaatcaactttcaataatttagacttttagagattaatatatatggcaatagtgattgaaattgaaaatgtaattgaaaagttattctttctcttttttattttaaaatctaaaatgcttgcaagactttagtgtctctgaactacactgatttttctagctatttttcatttttttgtagcctattaataaaaactttgacctataatatataaagtttatgcaagacagaaagctaagcagacataaatttataattcgtctattgtcagaacaaacaaggtgaaggaaaatgtgaatgccaaacatcagggaacaaaactagtaagagctagctgtcttcatttctttaaaatgtgaaaggtaatttaaggaaagctttgcaagaaaactgggatgataatttgaagtacagttatggaaaagtagtttgctacaagtagaaaagaaggttttaaaaaggtactttttatgccaacccttttctgtgattaaagcaatgcctgaaaaagcaatacttgttcactgcacaacataaaggatgtgtgtaaacaaataaaaatagtttgtatgaatcctacagctcttttaggaagccttttttgaacttctggtctgggttatattccttcttttgtgccaag

SEQ ID NO: 44365 - DNA, 1034 bp, Homo sapiens
ctggaggttgaggctgcactctagatagaggaagaccctgtctccaaacaaacaaacaaacccagaatgggctaaatcggattattgatgggacagggtggtggtggtggttcctggaggtattaatattagatgtatagtctaacaaaggcagggtaatttcccacctttttaaaaacagtagctgtgattaaaaattattttattgtaatttatatagttggatgcatatttatatctctagaattatgagtatggagcaaaatattcaaagttgtatcatcagttgttagcagttgcagagagggggatgttgctctgggttagttagaagactcagtatacagaagttcagtaaaggaccttcaatggaatcaagcagaaaagaaaacaagtgcacatggtaaagaatcatgattgtgattatatttatatttttatgtaaaattatatgtgtacagaaataagattttaaaaaatatagtctctcttttggacctctgatttcaggataagttgagactacatacctcttttctcctaaaattatggaaagaaccaaaaattacataaaaattagaaaatggcaacatggaaggatgccaccaagtagcctgagactttgaggaattttttagcatttctgcaacagagagaataagagaaatgcccatcagagctgactggtctttgattcaacacaggcaaggaatggctacctaggaagtcaatggatgggactcatccagaagtaaatagtccataggtatatagtagcaagatattggagcatgatagggagagggggaggacagagcataggacaacaaaatgaagtcccttggaagactcatcaatggattctacctgtgagaatcgtgatttcctgcagtgggctttgcttgctgtgacattcaactttcgaagatgttgaagtactattagaaaggggggaaacaaagtttgtgaaccaagaagtctatactcagttctatattatggatgagtattgtagtttagattattgttcagca

SEQ ID NO: 44366 - DNA, 1094 bp, Homo sapiens
agtagcaaggtttaagaagtgtgtgtgtgtatctttcaaaagagcttcatctcataccatccgtggtttccttagtatttctttctgtagtttaaaatctgaacattaaacaatattatttcatacctaggagggagaataatttattatataagactgtgatgtctaaatgagaacttcagcatgtgaatctcatgcattacaaatagttttattgtacttttcctcgcgccgttgatacaatcttatacaactttattttgttctggtagtcagcatggcccacaacgtttaagaacagacattcagacagctaggggaattgatgtgcctgtgcatactctatgggcacactgcatattgaaatctgagataaaaatgatttgtccctttgctttcgtattttgggtgctaccatttctttatgtacctgatcatagttaatattcctacatccattagtgttgagacgtggtggctataggaaaaattataatgatgggctcttgggagagcttggctgtacagcagcttggattttatgactgtgaattttcaagtggtagatcaattaggcagaactagtcatgcattgcagtatctttaagagctatcttaaaacaaatttcagacctggatggtattcatgagctataatttgaagaatgactgaggctatgagtactagatttaggcactttgaagaaaaaaacatttcatatggattaagttggatgttttattcataagagctggtttgatctttatatgccttgatatttttaagtcctgtagttcctgttttaaatttattactatacagtctttatttgcaacaattaaattggccaggggtaggtggtgattagaaacattttcttggattataggaacattaataaaatcccatttgaagtaaattcactcagaaacttaattcttttctttttttttttttttttttagaaacgctgtctggctgtccccttggctgtcatgcagtgacgcaatcatacctcactgcagctgtgaatgtctgggcccaagggatcctcctgctttagcctcttgagtagctaggaatacaagcgcac

SEQ ID NO: 44367 - DNA, 1050 bp, Homo sapiens
tttttagaaaataaacagtggatttggtgctaagaggcaatagattgatagttgtcacatgtattctcccctgtcccatagattaacacagtctttaaggctgtttggaaatcatgaaacaaaaacaaattttgcaacaacttattttagttttaatataatctgtccttagataataagctaacagatttctatatttgaatattattaagtaatcatagaagaaaagattacctaagtggtaggtctgggggaaattcttagcactaacttcatcactcatggtttagataatctgtattatttgttgcaattactatgttagaatatttcctggactgcattaatgttaagctgtgagagaaagataaaatcattcgggttgttgttaatagatggcaggactctgattgtcaatttgttttttagacatcttaaaatatttaagtcagtgttaaagcagcattggtgttgtaaacccattaattgtccatgccaatatagtgaagtaactaaagagataattaattgggcaataaattgtagattctggcccttatttcccaatcacatttcgttagatttgtttttagttctgtgggtacagtagtagaaaaaaatgacatagatcaaattatgattattaccagttctaaacacttttatttcattgtagaactgagatcatcacaatactgatttattcattctaaagtgaacactaatcttccacatcctcagagatataaggaaacatttagatagtcaactttcctaacttgaatttataattttgtaaattgcttatgaatagcttctaacaatgtgagtctcatctattgtgactgccacattaagaaaatccaaaagcctcaagaaatcagggctagtacttcttatttatattttcagaaatgatcataaaacaaaggtttgcacattcagtgctctaatataaatattaatacatataaaaatccatacctcctacttaacagagaaagggctattttgttggcaagtttaaaaatatttaaaacatccatgaag

SEQ ID NO: 44368 - DNA, 1025 bp, Homo sapiens
ggtattatattgaaacattatttgcaccatgctttttcatttagttgttttccttgagatcactctgtatgagagatctagagcttttcctcattgccttgaatggatgaatcacagtttatttgcttttacaattgatggcatgatatcctcatgcttgggttattttctattttacaaagtgtattttgggaaatactacagatgggatttctgaatcaacagtaaacatatttgtaactttgccacaatttttaattgtggagactttataacatttaatatctgttagggctagacaacctccctcctcatccagttactgcactttttctagctatttttgctatttatttttcaaccttgaactctttattcaacctttgaaagacatgtggattgtttttagtttttggctattggataatgtctctgttacttttttcgtttccttggccaaaaatttagtatatgaaaatgatagcatctcagtcagatcagtgagaaaaagatggactttttaataaatagtgttggaacaaccagatagccatatggagaaagataaaactagatgtgttcctcacatgatatactagaacaaattccaaattccgggtaacttctaaatataaaaaataaaatcatgcaagcacttaggagtggaggaaactctcctgtatatgattcaaaactgagaaacaattaaaaaatcttaatacactgacatggcagaaaacctcataagcaggattaaaatactctgacaaattttggaaaaaacatgcagcctatcatagctaaaggactaaaagtatttatttgtaaagaacttcaaaaaattaggaagatgtaataactaaataaagagcaaaggatatgaacagacagttaaaagaaaactaaatacaaatggccctttatcatatgaaaatatacttaattctcaaaaaaattaaactgtaatgagatatcagattgtcaagaatccagaagtttaatatttgttgctggcagagcttcaa

SEQ ID NO: 44369 - DNA, 1022 bp, Homo sapiens
tatatagtacacctcattttatacataaataggtatctcatctctcttgctcttcttactggacatcacaatgtttggaaaagtggctgcccatttgctattttgaattagcttggcttaaataaattatttgattggtgacttttgagatacaacaccatctttaaggcaccatagaaggatattgtaattaatgaagacttctaaaaataaatattataacatagaggttttatttttacttctgaatgttttcttaaaagacacctttcaaattatatttttacagtggttctaaaacacacttaatacatgaaatgatggaagctgatggctggaagttaaaagtgaagtagactgtgtaactgttgaactatgtcacaagctttttgtatgcatttttcacgatatattttaaaagatagtttaaatttagtttaacatttacctttttttccataggataaataaaagttgatttgagtgtggcttttgcacacaagagtaggaatctgaggagttggtcttataattacctatatataagactcatttctccttgtaaaacacatttgtgaactaaattgatccagcgatgtttccttcaaagtgtgaaggggagagcatttctaatccttttggattctctgcttcatcctaatgttgaaggaaaaatatggcatgtttgaatttattagtgccagtagtataaattttatatattactttaaaatgtggtgagtagaaggttggtgagagtggaggacagtgctttttgatgatgaagataatacctaggttctattattactgacctcaggctgagcacaccctgacaataatggacctgttccttcttaaggaaaaacagaataacatcatcatatttttggtatctgattttgtattttagaatgttcatttagagatgaaacttttaaatatataatgcttttaaaatgatttaaaacattcgcacacatgaggtccagaaaagatggtataagagataaccaaaggag

SEQ ID NO: 44370 - DNA, 1047 bp, Homo sapiens
caggctttggtatcaggatgatgctggcctcataaaatgagttagggaggattccctctttttctgttgattggaatagtttcagaaggaatggtaccagctcctccttgtacctctgttagaattcagctgtgaatccctgtggtgctggacttttattggttggtaggctattaattattgcctcaatttcagagcctgttattggtctattcagggattcaacttcttcctggtttattgttgggagagtgtatgtgtccaggaatttatccatttcttgtagattttctagtttatttgcatagaggtgtttatagtattctctgatggtagtttgtatttctgtgggatcggtggtgatatcctctttatcattttttattgcgtctatttgattcttctctcttttcttctttattagtcttgctagtggtctatcaattttgttgatctcttcaaaaaaccagttcctggattcactgatttttggaagggttttttgtgtctctgtcgccttcagttgtgctctgatcttagttatttcttgccttctgctagcttttgaatgtgtttgctcttgcttctctagttcttttaattgtgatgttagggtttcaattttagatctttcctgctttctcttgtgggcatttagtgctataaatttccctctacccactgctttaaatgtgtcccagagattctggtgtgttgtgtctttgttttcattggtttcaaagaacatctatatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttatgttcttttacatttgctgaggagtgctttacttccaactgtgtggtcaattttggaataagcaagatatggtgctgagaagaatgtatattctgttgatttggggtggagcgttctgtagatgtctattaggtccgcttggtgca

SEQ ID NO: 44371 - DNA, 1044 bp, Homo sapiens
caaagatgggtgggggcaatttgctgagccaccacttactggacatgagagaaaagtatttattacttcagatcttttatgtttattatcctgcttctgactgatgacagtatcccctcttctccctcatttctgggatttgtgatagagaatgtaggttatttatttggcttatcagcagggaatagtgactaggaagccttatttgaagttttaagtctctcaaaagcatcttgatcttgcctgtactataagcttataggatgattaaaaactagggggaaaaatgcaaaaaaggagccttagaataaaatgattttttttttttaccttttttcattttgatgttgttttaagccacatgtctatctttacatccaaggtttgctcaatctcttcagccttatgtgaatcctccccactcactttgtctctgaaacttaaatatttgcctgacctttttaatcacatcagacttcctggatttcctgtcctttatctgatgtgactttggataaactcttgattgtatacattatacctgagcccctgagcataaactatgtaacttaggatacattactatagatgtatttttaaaaagacttttctatttagttaagcaatattgttttctgtgctaatatttgagtgccagtcttctaaaatatttcctgtgcattaatgtgataaaacaggatatcccatgatatttttaattcctctcacagtttgaatattatagatgttctttgagaaggaaactcttataaaaagtgattgaaaagatatgtcgtttaggtgattcatctcctggaaatgagagttgtagtagtgaacaaagaatcctgatttttaacataacattgagtatctcatttggagtcaagggcaagcgggatgtttttttaactttaaaactatgaaagggcgtgattaccactaattttaaaggataaagtttcatacaaatgtgaaatccaacttagttacatctggattgtgttcctgttcccctagttctttgcctcttgccttgtaaca

SEQ ID NO: 44372 - DNA, 1042 bp, Homo sapiens
agataggagaattgcttgaacccaggaggcggaggttgcagtgagctgagattgcgccactgcactccagcctggacaacacagcaagactccatttcaaaaaagaaaaaaaaaggtatgaatgtgaagaataatggagaagggagacaattgaggtgattagagcagtggctttcaaactctaacatgtgtaaagtcaccagtggagtcctttaaaatgcatgttcctggatctgctgccgggcatactgggtcagtaggtttggtatgaggcctaggaatctgcattttaataagcactccagctttggctactggccatactaagaaacttttggtagagatttgctgcagggtcatgcacagcatggcatacttctataagggagtggtgccagcttgaagatcatctcaggaagtgaaagagagctgttattgtccttaccacttaatcagctttagtacttttgtgttttgtttcctgggacctcatttttgtgtgctcagcctattcactcttccttgctccttatcgagatgtaaataactgggcagcctcttccttaaaattattggctcctatatttaaagagttgccacaacatagtcttctgctttataactaatattgcaattcctttatctgtatattaattttaatgctgaatctgaatataaatatatagttcaattaaataatctgaggtggcatttcaaatacctcattcttggctttagtttgcctgtgtaacaccacttttgtagctaaccaaattcagcctaaagtttacttttgaaatgtacaaagcacactcataaaaacttgcaaaatttgtaaagtatttacagtgattttcttgttatatcagagatttataccttttgctttagtttgcaatttagtgtacaatctttacagctatttttcttgcactgggttgttaaatcagttttatatctttttattccttggagtagagatgaataaaccttgcttactagattttgtaatacctttatcacttaatatttgaacatcctt

SEQ ID NO: 44373 - DNA, 1024 bp, Homo sapiens
gttgtccctttgctctttcttcctcttccgccatgattgtgtggcctccccagccacatggaactgtgagttcatcaaacctcttcttactgataaattacccagtcttgggtatgtctttattagcagcatgagagcagactaatacaggttcattaagtcttagctattatttttagtactggtttacatgctgcaacaaggaagaatgcacccctcaggcttcctgctgtgggaagcataattgatagctgaactgctgctcctctgagtccaccttcactctgaggccatggtttctgtggactttcctgagccagtgattgggcacagaagggacagctagacccattcctgtcctctattgagtgactttaagctcaaggactcctcagtggcccagttgaacatccctggggactgcactgtagtccaattctcatatcttccctctttccttctgtagacatcacacctgcaccttgttctgagagtgctccctgccttctcctgttccctactgcaagatgtcttttgcatgtttaattttgtgtagtgtttgcttcttggcaacccaaatgaatgcacatgatattgaaatattagtaattataactcattacagtgataagtgacatatgtgagttgggagacacaactatctcattgtaggcatacaacttagctggtcttagtgggagtagagagatacttggccagtgcttaccagctgccatatgctgggcagggtaagaatattgctagggtgaacagagaacatctactaaactgggttgcaaagcaggagggccagccccttaaatgctggtgttagccacagggacaatgccagtgccatagaggagctggtaactggggcattattttgatcaaggtgtaatgaatccatgatggaagacacttgataataaggctttgtggactaaaaggccttagctccagcctgctcttctctctaggagagtactagaagctggaggatggggatgggggacccccagag

SEQ ID NO: 44374 - DNA, 1057 bp, Homo sapiens
aatactgtgagtagaaggcagtgaacgcaagaccttcatttcttttttttctgagacaggacttcactgtgtcacccaggctggagcgcagcggcatgatcatggctcactacagcctcaacctccagggctcaagtgattcttccatcttgcttcccaagtagctgggaagctgggactacaggcacgagtcacccaccactcttggccaatttttgtattttttgtggagaccaggtttcgccacgttacctaggctggtgtcaaactcctggcctcaagttatccacccgcctcagcctcccaaaatgctgagaatgtaggcatgagccaccacgcccagctaagaccttcatttctggcagctccgaggacatcgctccagcagttactatggcctggagtctgttggtgttaacgaattgctgtaggctctttgaaggaaggacagggctggcgttttctatcagggactcctccccacagtagaaggagcttctgggactttgccttgggcgccaagtaagagaatgcttgcaaagcgctgaagctttggcatgtactacatgcccctctaccttttctcctgctcccttccccacatccgcttttcgctcctgcttcccctctcttcttccatctctcctgtcactcctccagcctaattcccctgggaaggatttgatatgaatattatggatcatacagaacaatgtatgcatatcttcaagatttaaacagttacatacatgtacattcatttgtgactcttgatgtaagggtatattagtcaggatctagtcagaaaaacaaaacatcaccaagtggttcaatagggggatttggtatagggagctaattacaaaggtattgaaaaagctaaaagaacaaatagggatctgttatatattccagaggttaccaactgcaggtagccattaccaccctttgggctaaagcaacaaagggaggagttgttatcagagccaacaagggagctgcctggtgcgaactcagctacagcacaggagctgcttggtgagagcagaacccggga

SEQ ID NO: 44375 - DNA, 2950 bp, Homo sapiens
agcctacacttttgaagctcttcttttctgactcagaaggattgcatatattctcaagcagtagtaagtagggagattgagataaagcccattcttgttccctcgtccttgctttaggtccactgtgttttgacgtgttttatattataagcttttgtataaagctttctttgacaaaacaaaggttcctataatgaatctcattgtttttaactggaacacctgaaatgacagagagggaggccaaaatgttcaagtaattatgaaaatttaaagttacatgattaaattgtgcaacactgtaagaatccctataaagtttgatcaccatatcttagagtcctaggctttgaactttatcctttttctttcctttaaatcaccttaaaactatgtaagagataagcaatgtggggctatacagattaatccaccacagatcttggtataagaagctgaaatctaataggtaagatgttaactttgtgatccttcaaataaagagagatttttacaagtcagttgtttggagctcaggggagagatttgggcacaagagttaaatttgagtgttgtcatatgtatggtgattggaaccatgggtttggataaggaagcccaagaaaagagagtctagcaaggagaagattttaaggactggtcttaaagaactactggatttaagactggaaagaaggctgagctggagaaggaaatggagaagaagtagccagatgtattagaagaaaactaggatggtccatgtcacagaaactaatgaaagagctacttaacaggatgagtagaaaacaatgtcaggtgctactgaatgatcaagtaagatggagattgaaaatgttaattggattttgcaatatggagattacccttaacattggtgacccagggaactcattttaggttctatttcacacaagccacgttttcagacattgacattcctaaaccgtattttgtatgctgaatctagcctttctttctttagcagaggaacagcttgagttattacttggtggctttgctgctcaacagttaagcttcaacagtgttgtgtttttatatcctgttttttttttgtgggggggaatactgtataaatataaatgtacatatgcatgtatttgttgtgcttttgttttataataattaaaaattgtcagtgataagcatatattttgaatgtggtacaactgagatcaagatcatgaagtatcctgcaaatagaaaatccttgatattgagtacttaagattggttgtttttcatttcatttgagaatgaaaagagaaaactcaacatgtgaaaatgctggaatacataagtcaaaaagtgggatgaaaccagggtgtaatttttttttttttcccagcactgtggcaatctctcccctcctccgttgtcccctgtcttcctttgtttgacttttccattttcagttttctatcttaggaccctatctgcagtaaagatctactcttctttgtcctttctaaattgctgtatcttcatcaataaagtgattaatatttgcttcagtgagatggtgggaagatacataaaataatttctgaaaagcacttagttcagtgtctgacctggactatatcttcaaaaagtttcctgttaacattttgtaataatttacattcagggaaaaatgttccctgctataaagcatattgcatttatcaacaaatattgaggcaatatttgaacagatttcatgtggtaggaactatttcagacactggaatatagacatggacaagatagcgcttttaatctctttttgggtgacaaataattgtgtatgtctggtacaatgtgatgctttaatctatgtatacattgtataatgattcaatctaattaacatatccatcacctcaccaacttatcttctttttgtggtgaggttgttaaaaatctatttgtgtaccaattttgaaatatacaatacataattattaactgtggtcagtcaccatgcaatgcagtagatcactaaaatttattcttccagttcaactgaaatgttgtaccctttgatcaacatctctcctttctccatccctcccactccctccagcctctggtggctatctttctactctgtttctatgcacatatatttacaattattataactttttgatgaattgacccctttattattatataatgaccttctttgtctctttttacagtttttgatttaaagtctattttgcctgatatgtatagctacccctgcactcttagttttcatttgtgtggaatatcttttttcttcccttcactttgaatctgaatgtgtccttagagatgaaactagtctctttttggaagcatatagttgggtagttgcatcttctttttttaatccactaagctgtttgatgtcttttgatcagaaaagttaacccatttattttcaaagtcattattgataggtaaggatttactattaaattttgttaattattttctggttaatatgtagatcctttgttcctctcttcttttgctgtgttcctttgtggtttgaggatttctctatggtatgctttgaatgctttctttttgtgtatctactaagggtttttgccttgtggttaccatgaggctaccataaaacattttatactaataacaggctgtttaaagctgataataactttgatcgcttgcacaaactctatacttttactcttttcccattcacaatttattattcatgacatattttgtatcttttactgtttgtgtcagttagcaaattattaaagctctagcttttaatagtttggcttttaatcttcatactagagatatatttggtattcacaactccattacagtataagtgtgttctgtgttttattacataactacttttaccggtgagtttgatatttttgtgttgctc

SEQ ID NO: 44376 - DNA, 1049 bp, Homo sapiens
tttggactcataataacctttagcttaaaacacaaacacattgtacagctgtacaaaaatattttcttcatgtctttgttttatgagtttttttctattttaagtatttttgttttttactttaaaattttttttagttaaaaactgagaaacaaacacacacattagcctaggcctacacagggttgagaatttcagtatcagtcttccacttccacatcttgtctggcaatctgtctatctatctatctatctatcatctatctctctgtctatatatatcatcatctatcatctgtctctatctctaatctaggtatctatctatacacacacatacacacacagactaatacaatttttggtaccaggagtagggtgctgtttctcacctatatctaatttagatgagacttacactttagaattgatgctgggatgagttaagacctttgggactgtcataatggaatgaatgttctttgcatacaataaagacatgaattttgaggggccaggggtggaatgctatggactgatttgtgcccatacctactaatttgttatgtgaatctctaacccctaatatgactatatttggaggtaaggcctataaggaggtagttaaggttaaatgaggtcataatcctggagccctaatataatagtgctgatgcccttacaataagaggaagagacacaagagctttttctcttcaccatgtaaaaacacagggagaaggtggctgtctaaaagctgggaagataaccctcaccaggaattaattagctggcatcttgatcttaaagttctcagtctctggaactgtgagctgtgagaaaataaatttctgttatttgagccacctaatctatggtatttttttacagtaaccctagcactatatatatgtgtgtgtgtgtatatttgtgtgtgtgtgtgtgtatgtctgtatatatgtgtatacatacatacacatatgaatgcttatatatatacataatatactataacatattacatatatatatcaagtactaaactgagt

SEQ ID NO: 44377 - DNA, 1029 bp, Homo sapiens
ttgtgaaatattattaagataaaaaacctcaccagctaaacttttaaacactatagcctatttcaatcaaatagaagataacaaaagatatcctttcttactcctgattatgtagatgtgagaattaaggtaatttaattacttaatattcaacatttgatggtggaatagattatgagatattaaatgaaagtagtaactaatagttaaatttcagttgttctgataaatatctgttgaagagtaaaatccaatgatcttttaaaaaatttgtattaacaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgtt

SEQ ID NO: 44378 - DNA, 1026 bp, Homo sapiens
tttttaccaaattgctttttacagaatgacattaaatcctatggtttccaaccattttttatactagcctttttcctcaaattgaaatgtctttcccaatccctacacctgtgagacttttttttcccagactggtgactttattgtttaaaaattctgatagtgtcggccgggtgcagtggctcacgcctgtactcccagcactttgggaggccgaggtgggcagatcacgaggtcaggagatgaagaccatcctggctaacacggtgaaaccccatctctactttaaaaaaaaaaaaaaattagcgaggcatggtggtgggtgcctgtagtcccagctactcaggaggctgaggcaggaggatggcttgaacccgggaggcggagcttgcagtgaaccgagattgcaccactgcactccagcctgggcgacagagcgagactccatctcaaaaaaaaaaaaaaaaaattctggtagtgtcacattcttggcgaagctttccttgatccagagtctgctgtaggtcagggatctatgataaaatgtggttcacaggctgaagccatccaacacctatttttgtacagcctgtgaactaagaaaatttttactcttctggaagtgttgctttccttaaaattcccactgctctgaggtagaagacactttctaattcagcttggtctcccaagcctggaggagagtgccctgtccatagaagccacttgatatataaatgcagaatgcatgaaggagtagtgtaagcttcctccttacactagaatgtaagttacatgaggacaggggttctattgcctttgctcactgtttacctccagtgtttggaagatatctggaacacagcaggcagtcagaaaatatttgtgatgttaagtgcaccaatattggtgccatatttctgagttttgtaagttttagatcaacttgtagtcttttatatcatacatttggcaatttatggaaataaaagtccaccttaagagcttcagagaaacaaggaagag

SEQ ID NO: 44379 - DNA, 1046 bp, Homo sapiens
ataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaatagaataaaataatgtgtttcatgtgtttattgttaagagagtaaaataggtttaaaatttttaaactgtatagtgaagggtacagagcgatcaatgataatggttgatgttttcagcagactgcatgccctgagagttagagtgtgccattaaataaacatggtgagcagaagaatgttgcaccctgttctgttgggaaacatgacagctgctcagcagctcccctagaagccactgctgtcgttcacagagcattgacattgcaaggtcaaactgtttggaactcttccacataccag

SEQ ID NO: 44380 - DNA, 1055 bp, Homo sapiens
ggatggagcaggaaaagaagattggggaaggaaataaaagttagaagttttgagtttgagaatccatatgaagagtacaagaaggtagttggatttgtgacagaaaggtcaacccagatgattttatacattaacaggttgaaatttgtcacatagatattaaggaactagaaccattgtcttctaagccctgttttaatctttagtttactatcatactctatagatatatttctttagattcactttaaactgttttagtaactagattcttctgggagtcacattatctgtgtttcaggagttaaataattggagaaaccacccaagaattatgtaatgtcattttatttatgcatatgttttaattgtcttgattttcttgtagatgaagatgaagatgaagatgatgaagaagattttgaggatgatgatgagtgggaagactgatctatatattatatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctct

SEQ ID NO: 44381 - DNA, 1051 bp, Homo sapiens
gttgatcatctaagtctgtgtgtgctggaataaacagaagtaacccagcaagtattattcaggagagggtttgttatctgaatgtaaacatagatttggaaatgtatttttggcttatacattaagatggaaaggaaatatttttgaataatatctttaaggcagcagtttatttcttgttaatttgattaatcttgtcctgcgcttgccagtttgatatcttttttgtcttttacaataagaagtgattctaagaaagtaggactttctggagacaaagattcttggctaaagatttattactgagttttgctaactttcttttccaaggtggctgatggccaagagtctacaccaccaacacctgcacccacttcaggaattgtgggtgcattaatggaagtgatgcagaaaaggagcaaagccattcattcttcaggtagagagagagagagagagagagagagagagagacagagagagtgtgcgtgtgtgtttaataaatttgaatgtttgacgttctgttatttttatgactgtctttgctagctttctctctgctaattgagtaactactgatgtgggctctaggatgtattttaaaaagttgttgcctgtgtgactagtctctctgagacttaacaaatgcaacaccaccacagccatagccataaattgaaagaacagctttgggaatattgacagttttgtttcctatatcaggaaatgctaatagacttcctagcaaacaacctctaaacaaagcttgagatttttagatctcattcctgtgacattactgtgacatgaaaaattcagggctgggtgcggtgactcacacctgtaatcccagcactttgggaggccgaggcgggtggatcacctgaggtcgggagttcgagaccagcctggcctacatggagaaactccatctctactaaaaatacaaaaaagttagccggcgtggtggcgcatgcctgtaattccagctactcgggaggctgaggcaggagaattgcttgaacccaggaggcagaggttgtggtgagcc

SEQ ID NO: 44382 - DNA, 1076 bp, Homo sapiens
ttaactgctttatacaagtcagccattactaatgctactacttcattgcttaagtgttcactttattgggaaacagtgtaatagggggagtaagaatgctagatttgaagtcacaaattgcctggatttggaatttcagctctgccatttagctgtgtggtattgggcaaattaacccctttagtgtcgggtttctcaagtaaaaaatgaagttatcatagtaataacaaatgaggctatatttaaaagtgattaacacatttcctaacacattttaagcatcaataaatgttttcagtaattattgttatgtgattattgtattagttatttattactacataagaaattacttcagaaactagtggcttaaaataacaatacatgtttattatttccttgtttctgtgaatcaggaatttaggagcagcttagctgggtggttgcggtcaagctgtcagcaggggctatgatcatctacatattattttgaacctaatggttataaattttatattttgcagactatgtcttcagcagtggtgcagttatatgcagcagatcggaactgtatgtggtcaaagaagtgcagtggtgttgcttgtcttgttaaggacaatccacagagatcttattttttaagaatatttgacattaaggtgagttttgttttgctttcactttaaactaggtgattaggttttctatatcaattataatttagtttagatttgtttatcctatatgtgatatttaaatttatacataaactaatattagaagagtgaagcttggtttttagatattgcatacggaaatcatgaccaaatgggaacatgtctgaagccagaatgtgaatagtttcctattttatctttctcctgctaccacgcattaaggctttttttttttttaaattatgcctgttggttcttgggctttctttacactctgtatttttttaatgaaactcttttattccacctggttcattatagaatagcgtagatagtctgttcaggtaacaacaaaataatattttagctcagtatgtactgttatttagcccaggttta

SEQ ID NO: 44383 - DNA, 1099 bp, Homo sapiens
ggttgttctgaaaatgtgaaaggaatttaaacagtagaagtgctgaatgtttgtggtttaagtcttatgcaggatagaacttttaagaaagttggtacacatatagagggaataggaggaagtgggagttttcttagttttgggccattgcagcagtggctaacatatatagaggtagtaatggctctggggagaggaccaccttctcaagattgctgtggttgtgaaagagagctaagggtcatacattttaatgaatcattcgtgcttgttaaagttagaaataatttcatacttaaagatacagtacaaagaacttctatatatccttcatccagatttgccaaatgtttattacatttaccatgtttttttctctatatatatgtatacatgcatgttatttttttctgaataacatgagaataagttgcagacataatgcctctttataatatttcaggctatatatcctaaaatcagagtcattctgttattattgtagtatcattatcaaaatcagaacatgtagtttttaacaaatacttgttcacttggggacaaagtataggtggagtgaaagtacaagcttgcagaactactttaagtgcttatgggaattgcagtctttttagtggttaggaaatcaatacagaaaattattctgatttagagtaagaccagtggaataacagagtaacacaaggtacacaaacaagcacttcagaaatgtgaaaaaaaaaccaaacaaaccaaaaaactccaataaaagtcatttcaacctaaggaatcagagaaatacttctcaactggtgcagagtcaacctcaaagaggtggaagtcccaggcagaaggacagtgggagggaattcacttcctagaatacatcccccatattcttcctgcccttgatcatcatagttctgagaatgaatatgtcattacagttactcagtactgaagtatcaggaatacacaagatatgacaggttctgtttctaccaaagttgatacagtactttttttccttttaattaccagattttaaccttaacattattagggtaataagaaatagatttcccttcctaagcacttg

SEQ ID NO: 44384 - DNA, 1034 bp, Homo sapiens
acccaggctggagtgcagtggcgatcttggctcactgcaacctctgcctcccaggttcaagcaattctcatacctctgggattgcagtcacacaccaccacgcctggctgatttttgtatttttaatagaggcgtggggtttcgccatgttggccacgctggtgttgaactcctggcctcaagtgatctacctgcctcagcctcccaatgtgctaggattacaggcgtgagccaccatggccagcctacaattatttttctaaacatatctcctttttaggttattaacatcttggagacagagaccttcttttaatcatctaagatgattaagataataaataattgttaattgaattaataccctgttcagatttagtctctaggttagccagacattttgtgaataaatacgattctttaaattatttttattaggaacattcctttgtgtagttatcccaactttgaccttctgttgaccttataaattccatatcttgttctaataaattatttgcatgagattatccctaggactttccagagcattattgtccaatagaactttttatgatgctgtccaatatggtagacatctgtgattattgcgcacttgaaatgtagcaggtgtgactttgagagacaacatttttaacatatttgaatagccattgtggctagtggtgaccttattaaacagtacagctccagagagcaaaagcaagatgagtccagaaactaacagtaccctcccgcctgcccctgcccccacccccaaagccacccagctttggagcttacctagagaggacagtaacagtgtaaaagatctgtgtggactcaaagtgaaatcattcccaattaatttatacattctaaaaaatagagaacatttattaaatctcaatcgcagctcactgcagcctctgtctcctgggttcaagcatttctcttgcctcagcctcctgagtagctgggactgggactacaggcgcccgccaccacgcctgaccaaattttgtgtttttagt

SEQ ID NO: 44385 - DNA, 1119 bp, Homo sapiens
aataacatgaatctagtatgtattttgaagagagaataatgttaaatttggaagggacgtttacttacttttcaagccaaaataaatgttaatttttctagctcagtggtaagcttaggtacctatttcagagttatttattttgttttaatggttaaatcgctttttttgtttttgtttttgtagatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtg

SEQ ID NO: 44386 - DNA, 1038 bp, Homo sapiens
ttagcttgtatttaaccagacaattatgtgctgaattatataattgaacaaattatataattttaagtagttttcttatacttatgatacatttctttttaaccattttccccactattttatagcatagatatagctatagcttccttatagcaataggaagatgcccattcccatttttacagatagtctacttgtagccgagtgaaactggaaagaaggtgttaataatttattggtatagtttaatatgatgtttatgttctacttatgtttttgaacctttagtttcaaatggacagaattcaggaactgtttctggttgacaatgactgtaggacacagttactaaattctgagtattagtataattaatatttttgggggaactgttaccaataaaagaactgatgtactttttgaaaaatgtgagttagctctggtattagtatttcccaaaattgttataaattgtttaatttaaaatatttgatatatctgcgaacctgtaaataaggcgggaataaatgaaaaagcctctgaactttgcaaaaatattttttcacaaagcctaggtattgtaagttaaatcaagcatagatctatttgactttattttcctgactcatcaaaagatgcttgtttttacatttctacatttttaaactgagcatggatcttgcagttgatatcaagaaaacggagttactgtttttgagtttcttgttttcctgaaaaagtgtatttttttgagaatatagtattaaaagtgtagtctatgaggaccagggtgtttttagaatttagaaaatagagtatttgtttttcagtggtagaaagtttgcttttcaagtgactcagggtaatcatttgatcttgtattgtcttcaggatttaaaagctttactagcccacttatgtgatctgaaggcccaatataaactatcccctatatttttattcaacctaatcttgtcattacctttgaccagtacactccagccatccaaacctcctggattttcaaatatactgaat

SEQ ID NO: 44387 - DNA, 1048 bp, Homo sapiens
aatgcatctgataatagagagaaatctacatttcagttttgcttgtctatattcttcgtatagacgtttgttacacattttactcacctatttatttctttttaagttttatttctatttattttcctggaattttctttcttattaaataaggttttatgaattacagctggtcttttctacttaattgcatttaaatgattatcagatgcttgttagcattctcaacttattttacatttggtcagttagtgtgatatttcttgtatacttgtatttattaataaagtgctatgatttgatttctttttgacatatcattaatactgattatttccaagctgcatctagttttgacatacttttattgttttgtgtgcttgatatagaaatgttaaatactatgacagtttgctaagttcttattttatttttgttcttacttatattagtgaaatatttttttaagtttcaacattttcttatttgtttgcttaagagatggatcttgctctgtcacccaggctagagtgctggggtatgattgtagctcattgtaacctcaaactcctgggctcaaggaatccttctgcctcagcctcccaagtagctgggattataggcacatgccaccacgcccagctaattaaaaaaattttttttttatagtggcaggatctttctgtgttgcccaggctggtctcaaactcccagcctcaagcaatcctcccaccttgacctctcaaagtgctgggattacaggcatgagcattgcccctgtccaattttaacatttttattaatgaattcttttagctataagtgaacacattagtatctactagggttaaaactaggaaatagcttttatgtatttttcatggttaacagattgttatgtagaatgctcacttttttaaaaaaaaagattgaagtatttgtgttcttttacatatctgaataatttttcagctctctattgtgtacttacccttttctaacctgcagatatctatgttttttgaattttattaaatggattttagtg

SEQ ID NO: 44388 - DNA, 1058 bp, Homo sapiens
ataagaatttcacagtgaaatggacacatgaatatgccagagggtggaggttgccctgtgttgctgagactgtgggaggtgttcatttgaaaacctgggggttatgcataattttatgggtgtctatatagctatgcctatgcagatatgattgagtgtggcttgcaaaattcctttttctttcttagctttctgaaatcaaactaaatctaagaagcacactgaaagacacattataaaatatgttaatggattcattttgtatttataatatagttgaatgtgaaaaaggctaaagaaatcaattaagaaatgctaactctaggaattttgagaatattttagagcccacaaattatttagtcatggaaatgttgaatttaagttagctctacatcaagggctatcatattataaatagctaagattttggtactgaggtacttcacattataaaattttgtattatcctaaatctacatctgaaaatttgctacctgctattctctgtccaagtttcttttattattcaagacaatacataaaatgacaagcctgggaaacataacaagaccctatctctacaataataaaaataaaaaaattagccgggcatggtgtcgtgcacctatagtccaagctgttcaggaggctgagacagcagggattgtttgagcccaggagttcaaggttatagtgagctaggatcatgccactgccctacaggctgggaagcagagtgagacctggtctctaccaaaaaaaataaataaatgcttgagaatgtttaagttttcacattgcttaaattattgacatgaatattaaaaatgaacaaaacttgtatatctctataagaaggctttaaatgttgtattgaccttggaggaccaaagagctggtcagtcctccattttcttttgtactgttcagacaatcagccccatgttatcaacttgaattgtttactacagctagctagcacacacatccattaacccagcagctccttattgagcattgtgtccggcattgaactaattattgagcccatgtca

SEQ ID NO: 44389 - DNA, 1046 bp, Homo sapiens
tatgtaaatgttgttaggttttgaagggaaactaacaaatgtaaactcctggaggccaggagtgcatcatatgcataggtgctgcctttactaaaattaacagtttctgattttttccttcttgttatttctgatcacttgtgttttttaccttgacctaaaattcttcaacattcttacttttcacccactgcccagagtggccgaacttaagtagatgttaggagacatagagtttgcttagatgattcacacaaagatgtagctaattgtaaaattctcttggagtttcaaagttctctacagatcattgttttcagtataactacactttcatttgcccacacctatgagtgcaaagcttcccaaagtattgctgttaacaagaacactgattcccttgatatctttggcagtgggtgtcctgttgcctaaagtgaaactttttttttttttggttcgcctctgagcattaataattacaaattcttgagccattgttctgattctgtcatgttctgaattctagcatccatgggggtctttaattcttggcttattcattctttattccagatcagtttgcgggcctctatttcctccacccaggcctgttccgttggccgcaggtctacatctgtagtaacttctcaaatgaagccaacagctaacagcaaatggggattcttaattgacataatttctaaatataggtgaaataaagaaatgtaagaggtctcatgaaggaggcataattgtgaagaagatatttcttatacctcttcacatcatgttttttaatgccacccgcagttagatctgctttcatctagatgaagaggcagagaaaggggcgttattacagcccttcaatttctacctcttcctgaggaaataaggtgatctgttctttattaataaagggaaaagcaccctccaaagaaaacctgcaaatgcacagccttgtctgatttgatttatatatataatttatatatatgtaaattatatatataaattatatataatatatgtaaattatatat

SEQ ID NO: 44390 - DNA, 1083 bp, Homo sapiens
atattccatggcttacgccctgcacaatatgcacaaagatctctgccctggatacattggcctttgtccacgaatgagtaccattgatgggaaagagctacttggttatattcgggctgtaaattttaatggtaagttacaacgtgtgtgtgtctaaatacattaaaagcgacagggtgtgtttttcctcctatatatagaagatacccaggcagagtggaaaacacaggattagaagcagttctcttctttgattagaagtgtgagtttttccacctgcttttgaatctcaaacatattttttatgctaccattaatctatgcgtgaaggaggcaaaagtttaaaataagcctctgtcaatcaaaatgttttacttaaatatcactattgaagagatcacttagaaggcttatttgaaaccattgacattagatttctttgaaaatgttttgttcatgtcattattagagaagagattgtagacattttgttttgaaactgattttaagcttttgaaacagtaggttgacttgaagaaaatggatgacttggagttgctgtatatttatactcaacgagtgttaagtttctgtgttttctgtttccttatatttttctcaatgactcagtccttcggaagcaaagggatgcacacaatgtaggcaggatttttatactgtaaaagcagaaatgttgtttctgtgactgccacgagaaactgatacagaatatactggattcacagtatttgattgaaaatagcccaactgcctgtctgaagtgatggaattattgaatgctgctgttctttcatgagagttgcaatggttgttgcccatgactttgatcattattttcaaatgaaatgatagaatgctctgagctgtctaatacttttggtttggctttaatccatacaatggacatgccttgagacacgcacagcactgcaccgtctatcataacacactccagtgacctcagttgccagcgtttctcagaaaagcacgaggtcatcttcaatttagaattcaagtggaaacttcttctttattttttttttttttgcatttttcctttaa

SEQ ID NO: 44391 - DNA, 1062 bp, Homo sapiens
ggcattgtgactctataggttaaaaggctactattattctaaggagacttgtgattgctttcaagtcctagttctgtttgttttgttaactttgagtctagtaaatcctcgcagagaaactaggaaatcaggtttatataactctttacagttttcacaatgacttcacatgcatttttaaaatttggtcctctcaggagttgtgtggggtctgcagggcaggagtaatcatgaatcccacttttcaaatcaggggactccagctttgaattttaagtggcctgtgctgataagtctggaagtgctggaatttttccttaaatgtggaccttctgaccgcagtgccctttccactctatcataaccttctcttattacagcaaaccgaactaagcaaaacaataaaatgcaattggtagatattggttcacacggcaatgattacttaatttttttaaagtattgatcagaaaggaggtagaaaaagaggagactttatcacaagtagaaaaagaagacacataatgaagtaaagatttgtaaacaagctgataggaaaactcatgaaaaatcttcaagcagcatgatcatgttcaacacattcttccaactcttttctgtttctggcagggaaaagaaggtacaggggcttagcacaaacataaaagagtgttctgcagtttaagttgtattgcagggaagaatctgatgtacaatctttacagtggacttcagtagagaaggagaaaatgaaagaatgttgaaggaacatgtatcttttgtagccgaggggcagtgcagaaggagccaaagaagaaatgggatcctgctgtggccagtcaccatactgatggtttgcaagtgttcaaaactgttagaaagtgcagctacttctgtttcccatagtcacagaaacagcttcgacaaagtgaatacactattcatgcctgggatggaaaaaaagcaccccgtaacctacacagaggcctttttctctttcattggaaaaacaatggctttattttctggaactgtagatgtgttgcagattgaaactgcttg

SEQ ID NO: 44392 - DNA, 1040 bp, Homo sapiens
ctcagtctcagtatctactctctctggcatggcaatacagcactcgagcaacaaatacgtactgagtactctttatacagctgtgaaaaaaccaaaagtcctgtccctatgggggttaggagagaaacaattcactaaaatggtaaatatatagtatattagctagagagtaatgtaagtgctaaggggaaaaataaagcagggtaatctggaggggaaatgtcaggcgtgggaggttaccattttagacagaaaggctggggaggaacaccctgagatgacattggagtaaaaccctgggggaatggaggaaggaatacatggagatagctggggaagaaattttctgggcagagaagaccattgcaaaggccctgaacagtcatctgggcagagaagaccattgcaaatagatgattttctaggtgttcaaaggacaacaaggaggtgtagctaaaacagtgtgggttaggatggggataacaggagatgaggtcagatagaagatccagaccaagcacatcatagaaaggctcttggctctcttactttgagatgggaacttattcgagggttttccacagatgggtggcatgatctgacttattttctaacaggattattctggctgctgagttgagaatcgacttaagtggagaaaaggtagaatcagggtgggggcagttaggagttattccagtagtccaggaggggcatgatggtgacttggaacagagggatagccctggagaggtgacaagttctcaaattctgggtacatttcgtaagtgcagccatcaggatttgccaaatatcagatgtatgatagataaagtatatacgagtcaagaaaggtttggggtctgaataactggaaaggatggagttatctaaacaaagatggggaagtgtaccccaataagcagattgggaggggaccatcaggacactagattcagatatgttcagtatgaaaagccttgtaggtgaagactttttggctgtcatggccattcatggctataagaactagggatata

SEQ ID NO: 44393 - DNA, 1068 bp, Homo sapiens
cagcctattgtgggaccttgtgatcatgtgagttaatactacttaataaactccctagatagataaatagatagatatagatatagatatagatatagatgtatttatcctattagttttgtcactctagagaaccccgactaataagatgcagtatttatttgtcttccctctgtcaaaccttgagccaaccacttttctcagattgcctgagaaaggtatagggaaaagaacatacaagatagatgagacatggaggaaagaactattaatggtggggacagcttctttacatggtgaagaggatgagaaaagccacccttaggccaaagaactccatggcctctaagagggtgctatggtttaaatattttttccctccaaagttgaaacttaatacccagtgtgtcggtattgagaagtagggactttaagaggtgattggctcatgagagatctgtccataggaatagattagtctatccatggattaatgagttaatggattaactggtggcattataagaagaggaagagtgacttgagctagcactttagcatgctcaacttcctcgctatgtgataccatgcactaccttaggactgtagagagtgtccaccagatatggtctcttaactttggactcaagttctccttaaactgtaagaaataaattatttaaaaataaattacccattttcagatgttctaagcagcaaaaaactgacatatatagagtgcaaagccccagaatggcataggagaagacttgttgcttcagacagggttcttggcataatcaatggtgaggctcccaaacacagctgcaattttagccccagagccagctgtcctgactttggaagtcctagccccaatgaacttggctgctatgccaatatcccttgaagtggtgctggtttggaagctgtgactagggttaagtgaggtcgggggatgtggggctgccaaactgctgaagctctcatctgttagtgtctctggttgcttgagaactactgcagagagtggtgggcttagcacctgacaggtgctctcaaacagag

SEQ ID NO: 44394 - DNA, 1078 bp, Homo sapiens
aattgatataatttatcacttttgggtttttttgcaaagttttctccttttaggagattttttacatttaggtctgtaattgataagttaattttgtatatgatctgaggaaaggtcagagtttatgtattcatatgcatatcttgatgttccatacaatatgttgaaaacatttttcttcctattaaattatcttggcactttgtcagaagctaattgatcatatatgtgtctatttctgacattctgtcatctattgatcaatacatctacggttaacaccaatactatgctgtcttgattattgtagtgtttctgtgagtcttcagatcaaatcatgcaacttagttcttttcaaatgattttggctattgtggatcctttacattttaatatgtatttcacaatcaatttgtagatttcataaaaaagtctcctagggttttgttttgtaaataagggtgttttagtatagtaaaaaaaatataaaatttgctattttaaccatctttaagtattcaattcagtggcattaattacatttgcatcgtcgtgtcaccaatatttccagaattttccatcaccccatacagaaactctgtacatattaagcaataactcctcattccctccagcccctggtaatctgtaatctactttatttctgtgaatgagcctattctagggaaattttccaattctaggtatttatacaccatataagtggaatcatacaatattttctttttgcatctggcgtatgccacctagtgtaatggttcttaaaatgttttttatttttaatttttgtaggtacatagtaagtgtatatatttatggggcatgtgaaatactttgatacaggcatgcaatgtatatcgtcatagtaaatgggatatccatccccttaagatttatcctttgtgttagaaacaatccaattatattattttagttatttaacaatgtacaattaagttattattgactatagtcacccttttgtgctatcaaatactaggtcttattcattgtttctaattatttttttcacccattaacaattcccactccctgc

SEQ ID NO: 44395 - DNA, 1049 bp, Homo sapiens
tcaattctttttccaggttgaggttcttctcttattcactagccttttgggtacaaatgttcaacgagttactagttgcgctaacatccagtctacatttttccatcttttctgtttgggtatgttgttttctgttttctgtcagatgttttgctgtaatgcaatgcatattattgactgcattttataaccaaacagactaataaccccctcaaagaaagttatgaggttgatgtacataatatgatatattaagcagtttagtgggataaaataggtaccacaaataatttccaaagtcagtcattcacaggtagtaaagtcaactgtatttatttaaataagaataaggtctggatggatcccactaagtaattctcattttgggccctcattattttagttttgagttagttttttaatcagcagcgaggcacatcataacagtgaatagtaagaaatttcaggggagtactaaggaagaaatataaagttgtaggtcaatgttgaatgcctgttagaagtaattagatatacaagggtgaagctcttataaaattaatttacaaagcatatgtctatcttttgggtattaatattatcactgagatgggccaagtcagacttagaatcctgactcgtatttagtagtactgtaaacctataccagttaagaagtatctacctctcagagttactgtaaggattaaaagagaaattgtcatttaatgtcactagcatagtatatcaaatagtatgaacttaaaatgaatcctgttaattcagtaagtattaactgtatgctgttatgtgccagatattgggaattttttgtataataaccaagatgaaatgtatattcccccccccctttttttttttgagacagagtctcgctctgtcactcaggttagagtgtaatggtgtggtcttagctcactgcaacctctgcctcccaggttcaagtgattctcctgcctcagcctcctgagtagctggaactacaggcacccgccactacgcctagctaatttttgtatttttaggag

SEQ ID NO: 44396 - DNA, 1041 bp, Homo sapiens
attcaacaaaaagacctaacctaagtatatatacactcaacacaggaacacccagattcatgaagcaagttcttagagacccacagagacatagacttctgtgcaataatagtgaaaaacttcaacattttactgacagtattagagagttcatcaaggcagaaaattaacaaagatattcaagacctaaactcaacattggaccaaatggatattatagaccttcacagaactttccacctaaaacaatagaatatacattcttctcattgccaaatggcacatactctaaaatcaaccacataattggacataaaataatcctcaacaaatgtaaaggaactgaaataataccaaacacactctcagacaatagcacaataaaaatagaaagtcaagactttgaaaatcactcaaagccatccaattaaatggaaattaaacaacatgctcctgaatgacttttgggtaaatagtgaaattaaggcagaaattaagaagttctttgaaaataatgagaacaaacaacatactggaatctctgggacacagctaaggtagttttaagagggaaattcatagcactaaatgcccatgtcaaaaagatctcaaattaaaaacttaatttcacaactgcaagaattagagaaagaataaatccaccccaaagctagcagaagatgagaaataacaaaaatcagagctgaactgaagaaaatggagacatgagaaaccatgagtttatttatttattttttctttttgtttgtttttgagacagagtcttactgtgtcacccaggttggagtgcagtggtgcaatctctgctcactacaacctccgcctccctggttgaagtgatcctattgcctcagcctcccatgtagctggaattacaggtgcctgccaccacaagtggctaatttttgtatttttagtagagacagggttttaccatgttggctgggctgctctcaaactcctgacctcaagtgatttgcccaccttggcctccctaagtgctgggattacaggcatgag

SEQ ID NO: 44397 - DNA, 1054 bp, Homo sapiens
gaatttcagttgggggtctgatattcagtttgaaaatcttgagtggagaagaggccagttggatttatttctggcaaaaaaaaatatgtatatatagaaaagatcaactatgaacctcaaccatgtcaccatatttttaatctattaatttgatttgcattcagagaccacattatcttttgagttacagtgtttcctattatctatgaactgacctctacaaataagaagagaaataggaaaaacgtctgagttgccaggaagggttatttccacctagcttttgatccagtccgaccaactaatgaatcccccgtcaggggctaataaaggaggcttgttgtgagtgatgcagagaacgtagctctaagtggtcttacattaatgtctgttcaccttcatgcttgactttgagtctaatgacatccatgcacaaagaaggcagggtgaggtggtcttaaatcattatctgaacaccaagtctgtagaaaaaaagtccagttttaagttcattaagggatcctgctgaatactctaggatatcaaattaaccatttgaaaaaaccttttaaagttgagttgaaaaactaggacattttttcaaatcttttgtgattccgttttttgaagtgaataaaactcagagctttttaggtattttttttccccagccacgatgaagagaacattaaaggacatttgcttaaactacatacgtcaagtctaagaagttactttggagaaataacttctttggcagtgatgttattttctgtgaaatagtaaggatgatctggaacctgggactcagaaaatgccgtttgcagacccagatatttggactagctagacgatttggaaggtaaaacgaaggtacctattctgttacattatttaatgctgttagaaactgaagatgaaatggcctgtttcagaatttttcttaggcaggattataatatttccaaaaagaaaaaattacctttcttctcttacctagtttaatggctagagattatgggctttgaattcagcaagagacacgttccagtct

SEQ ID NO: 44398 - DNA, 1040 bp, Homo sapiens
ggttgatatcctctgtcgacaatgggtgtctctaagagccatgttgagtcatctttggatcttcacactaagtgtggtcttttcaaccaaggctgtaccgtgcatcatcatatagtcatccccatgacatttgtaccttctctaacaagagttatgattgccctcagctatcatgataatcgccactcttctgtcaggcttgatactaagattggaggagctgctctgaagattcagtttcattctacaaggattattaaacaccaattctatgccaggaactgtgctagaggagctaaaagggaatgatctatgctgctaagcggctatggtctaacaaggtagacggatggtaggacggtggtgtgtaaaaagtgtcatgaaagcacagatggaggagtggaaagagggaccaggaaaggctgccaggggaggtgacattccatctggatcttgttagtgcaaccgaagtaagaaaatgctattttaaactattgccacgttctaaggagggtggaaagaatttggatatgcctaggactgtagttggtatttgaatagacatggctatagccaagtcactatagatcagggtttcccaacctacagccttctcaactctgtgacatttgaggccagataatttgctgttgtaggacctgtcctgtgcattgcaggatgtttaccagcatccctggcctcgacctactacatgtcaagttccggtacctcctcactgaaacaaccaaaaatgtcttgagatattgttaaatgttcccccgtgaacaaaatcccctccagttgagagttgctacttctaagtagtagaacaagaaggatacagaatctcaagcaatcttgaaaggaggagaaagggggagcaagataatgagaaagaagagtaaaaataagttaagaagatggtaaaacttgagttaccaagggggttgttacctggcagagaacgtaattaaaaaatgggcatgtctactggtcagttcgaagtggtttgttttaatgcaaactgactctatatctca

SEQ ID NO: 44399 - DNA, 1023 bp, Homo sapiens
tgttgtctttatatttctcatgttcttttagtgtcatacaaatgaataaatgtgaattcccaagtataaaggaatttagcctcaagtgatagtttgaatctctttcccagagattcccgtacaaatgcttgaaaagggccaggagcttcacatgaactgtgtggtccctgttttcagttatttattattttcctgctacctaactcctattgccaactgtattagtttgctagggctgctgtaacaaagtcccataaactgggtggcttgaataacagaattggcctccacagtttgggagccagaaacctgagatcaaggtgtcagcaggcttggatcctcttgaggctgtgaggaggaatctcttccagcctctgtccttgcttcttgtggtttgctggtgatatttggcattccttggcaagtagaagcatcacttcaatctctgctttcctctttacatggcatctccccagtcatggctgccggattgagccctgattaatgaagttctgtctgacccaagcccatatttgttctggttctttgggtgaattttggccctgggattacccattttctcctgagggattagcttctgtgatcagagccttgccagctggtctctgcatgcctcccaagtcatgacaggaagtgtgcttctctcccatgctcagccccaaagaaatcacattcttttattttcctttccaaagtcatttccttgttaaagccattgtgtttggaaactccagcactagatgagagctttaagatgcaatctgtacttactgtgttgatagaagaacataatataaaaacacccttctgcagaaatgaagcaacatcagaatctatttatgtcattttttataggccttaaaagagttggcctgagaattaggagtgtattttctcagtttacttcatcatgtatcaactaagcaacaaatatagtttccttgaaaataaatggcttcataatataataaaatcagaaggctagcagatgaatagttgatt

SEQ ID NO: 44400 - DNA, 1035 bp, Homo sapiens
ctttgtgaaagttgcagacttatgttcagagctcaggaggaagctaggtgaaattttgatagacttttcacttagctaaaatgttttttatgtccagaagatgtatgtcttgcctacattttatgttaagatcttaactttttttgtatataagaaaatgcctatcagttaacagaccaggaaatatgtgagcactgctctgatatttataatgttttaaaatattatggtagcaagatgaacaatgttgcattttaattttaattttttctctttaaaatttgttttgcctttcctacaattcaaattctattaatattttgaccatctttacaattgatatcaaaatgttttagttcatgcttcaaataatcccatttggttctcacactttctttgttgaatcattgcagattttaaggtaaatcaggcccattggaattcatgtaacagtgatttaacaagtcaaggtgatatttcatggaggtgagatctgtaacaagatgtgactgtttaaattgatctttgaagtgttgaacaactttactgcagcatagtagatattttctcaccttttctttagtaatttttgccattttttcttaacgaaggaaactttctgagcacaaatgtacttagcaacaagttcttgatttgcccggaagttaaatcttaatagagtgcctgatagagtatatgataataacatgaaattataatcatagcagctaatgcctagtcagtacttttatgtactaggctctgtatcaaatgctttacatgtattatttagtctcatagttaggcctactttttggaaagaggaagctaagggataaacctatgaggatgaatggagataataccgaactcacagagataaaatgcggtggaagtagtgtacacacccagaatttgcctggatgccaaagttcatgtgcttaatgagtgcatctgtctcaataaatatacttttcttggcagctagaactgccaagaaatacacttttcctttagtcagctagaacttttagg

SEQ ID NO: 44401 - DNA, 1053 bp, Homo sapiens
tgttgttttccatgttaagatgttccttgattttcttccatgagcacaggtccctagagacattaaatcaaaattagcataaggaggacaggactgatttcattgtctttctctacttcttatataatgctaacatgtgtttccaggctgtttgtgtgcttattttataaacatgtttattgagtggaattttaaggtcttcacatggaaaaacttgtgaataaaacttttgtgaaccgaacttgctatttagttccagataagttctttctgtgcttttctttttgtttcctgcatggttcaatatggttccaattgccacatatccacctcagtccacttggtaactcagcctttcccttctcaagggttgatggtttagaaagacattcagcatgcagatgggtggggtatgcaatatatctctttgacctccctcatgtatttgttcaatgaagtaaatattttggaagatattttattttaaaagatcgatgagagttacgttggatgaatcaaagaaagaactgcatcctatttcaagaaaataaatttctccaaacaacatagctatgattctagagagtataaaagcaccagaaatgctgtgctgagttagatcagaccaactggatgtatcttgctcggtgctccagctacagtggcaaagatacaggtggcacttcgtgagtaagtgtggggtgggcatgccctgctgacaaagtaaatagctctaatttccacccagtgacatgctggaaccatcatcctagattatagctaagtcctccttggaacgtacttatactttcaagtctgtaccaattcttacaataaaacgtttcatgtttgccacctgctgtgtaaagtggcactccttttatttattctacagccaccttcttcaggctttcaggggtgcctttaattctaatatttgtgaatttggagaatgaacagtcttatttccataacccgcatgtcttttgttatattttatacatctttaaatcaatatgaaccttcttgtttctagacagtttgagttcaaaa

SEQ ID NO: 44402 - DNA, 1050 bp, Homo sapiens
ggcatccttgtcttgttccagttcttagagtgaatgctttcaacttttccccatttagtattatgttggctatggttttgtcatagatggcttttattacattaaggtatgtcccttgtatgctaattttgctgagagttttaatcataaagcaatgctggattttgtcgaatgctttttctgcatctattgagatgaacatgtgatttttgtttttaattctgtttatgtggtgtgtttattgacttgcatatgttaaaccatccctgcatccctggtatgaaactcacttgatcatggtgggttatctttttggtatgttgttggattcggttagctagtattttgttaaggattttagcatcaatgttcttcaaggatatcggtctgtagttttcttttttggttaggtccttttctgattttggtattagggtgatgctggcttcagaagatgaattaaggaggagtccttctttctctgtcttgtggaatagtgtcaaaaggattggtaacaattcttttttggatgtctggtagaattctgctgtgaatccgtctggtcccggactttttgtgttggtaatttaaaaattaccatttcaatctcactgcttgttattggtctgttcagggtatctaattcttactgatttaagctagaagggttgtatctttacaataatttatccatctcttctaggttttctagctatgtgcgtaaatgcgtcatagtagccttgaatgatcttttgtatttcagtggtgtcagttgtaatatctcctgtcttgtttcttagtgaggttatttggattttctctcttcttttcttggttaatcttgctgatggtctatcaattttatttatctttttaaataaccagctttttgtttcatttatcttttttgtttgtttgtttcaatttcatttagttctgctctgatctttcatgataacttcctttcttctgctgggtttgggtttggtttgcgcttgtttctcttgctccttgaggtgtgaccttagaatatcagtttgtgctctttca

SEQ ID NO: 44403 - DNA, 1075 bp, Homo sapiens
cttggttagtattccatgtgagctttagaagatgtgcatacatgttaaggattattatgtctttgtggatacttgtctaccttctgcaatgcctttatttaagtatttttcctgaagtttaatttgtctaaaattaatatagttattccagcttccttttggtcagcattagaatgatatgtgctctatccctttacttttaacatatttgagcttttatttatttattttaatttttccataagttattggagtacaggtggtatttggttacatgagtaagttctttagtggtgatttgtgagattttggttcatccatcacccgagcagtatacactgcactatatttgtagacttttatccctagtccccctcccactcttccccccaagtccccaaagtccattgtatcattcttatgcctttttgtcctcatagcttagctctgacatattagttagaacatatggtgtttggttttccattcttgagttacttcatttagaataatcgtctccaatctcatctaagtgactgcaagtgctgttaatttatccatttttatggctgcatagtattccatcatatatctgtctatacacacacacacacacacacacacacacacacacacacacacacacacaccacactttctttatctactcattgatttgtgggtatttgggttggttccacaatttcgctattgtggattgtgccattataaacatgcatgtgcaagtatctttttcgaataatggcttcctttcttctggctagatacccagtagtgggattgctgggtcaaatagtagttctactttaaattctttaaggaatctccacactattttccatggcggctatactaatttatattcccactagcagtgtagaagtgttccctgttcactgcatccatgctgacatctactgtttttgattttttgattatggccattcctgcagaagtaagatgatatcacattgtggttttggtttgcattttcctgatcattagtgatgttgagcattttttaatgtgtttgttggccatttgtatatctttt

SEQ ID NO: 44404 - DNA, 1418 bp, Homo sapiens
tgctactgaggtttttgtggctctttgttatgcagtactattatggaagtagatatctgatacattagttttgcggctctaccatcagaggtcaaaatatgttgacttgtatttttccagcagtggggatgagttgctgtaagctggttgctttctttcaaaaggttctcctaacagtataaatttgaggggactgattggctcctgggggtcacagaatagttttaaccctgtaaggctcagttgttcatgaaccagacagagatgcaggctttgaccttgacttcttttcacccacagttatcagttttacctcctttcctttgtttctattttttcctttttttaattgttcagcaaatattaactaaacatttagtgcttcctatgtcagacagtcattaggccacagactagactgagggaggatttgcaaaatgcacttaatttgagccaattaagaaacaatttaggtaaaacatcaatttggggatatgtgctgaatatttaggcgtacagtccttctatcaggagaacgaaaaagaaactggacctgctgtacagggcaatgagagaattctgcagatcctctatcaaactgaatataatgatgcccatccccctctggccagtcctaaataaagccacttctctgcactggagatgactcattgtattcacaataaggcacttgagaattactgtttacagaaagcatcaccagcagcagggtttaagaataccccacagtgaaaacacaaacacatttgtaatgatgagtgatggaaaaatagctcaaacctgcttaggtctgcaggtcttcctaccatactgtgtatacttgtattaggtggtagggaggaaatgccacactggaaagagaacactgagggtagatgtttgactacaatccaaattcctataaaagacacttctgaagcttctaacttttatggcagttttggatttacgatacaatagaagaagctgggagatggaaaccatgagaaaataaaagttcctttcactgctttggaggctcagtgtttatgtgatcgtttaatacaagataaaagtcacagggataggagtgtggagaactgattggaggagaattgttgtcaactcagccctggtggattgatgggggaggctctgccaggtcaaggttagtgaatgtcatcaaacttgtctggagggtttggatttgactccctggacaaagtgaattgcttgatttattaacaagctttgcttgctatttgataagcactataccaggcttggctggaggtgttcttgatagattggttggggagattaagcatggcatgagaacaagttaaaaaaaattatgtcaaatgtagtatatgtacaaagtaacaatcttatgtacaaaataataaagcacagatggc

SEQ ID NO: 44405 - DNA, 1061 bp, Homo sapiens
ctgcctcctctcaatggattattccctgcacacatgctccagtgtctttcatcttaaccacaccttccctcgtgcacgtcttctccatctgtgaaccatctctcagctctcctttagaactaaactttttaatggagttgtctattctttcctaccgggatattgtgacaccagtcccacctggtctctctgctaccactcttaaccactccaatacgtttttgatagagtggtagcaacaacctttctcacaaattgaattaagcaaattgttgcttttaggataaaatctaaacccctttaccatggctcacatagccttgcacagtctgacccttacttatccttccacccccgtctatgctcctctctttattgcccactcgaatgcagccacactgctttttccaatatgccaagatattttctgcacctcaggggcctaggaaatgctgttgtctctgtttaagctgcttttcacagccaccctctctcccaccacaaccgtatcctttagataactgattaaatataacatcttgagaaagttgttatatttctgcacagagcactctattgaaagtagaccctccctttctgtcctcccatttgctgtatcagtcctttgtttccttcatcactctaatcctgtatctcaacttgtagtgttatttatttttttatttacctttggggggggggtctatttcccatactagaatgtataaaggaagagaccatgtttggatgtctagattcttcaacattgtattctccgcctgtagcacaatatttgacacatattaggtgcacaagaaatatctgttgaaggaatgaatgaacatatttgatattttttctgttgagggttcacttttcattgatttgtaagaactttttatatattgaaaccactaaccatttgtttgttctgcatgctgcagacattttgctctttgtcagatatctatcaatttaatccatgatgtctttgataaacagaaatattgcattttttatttagataaatcagtctttcatgatttctgcttttggtgtta

SEQ ID NO: 44406 - DNA, 1042 bp, Homo sapiens
tatggagatgatgtcagaaaacaaaaactggccaacaaaacatcccaaaaggaaacaacacccctaagtaatgatgtattgcatatatttgtggacatctgaaatatttttatatttattctttggtaaaagtttatatgtccaagttctacttggactttttctttttgcttaggtgactgattcttttaataagcaaaataagtacttatcggtgccattggggggaaaaaaccactttggccttatctgctgtaaaaactaagctcacaagttagtgctctagagcatggaaaaacactatattttgttccttttctcatcatttccatttctaattaaaatggttattgtgtgtgtgtgtgtgtgtgtaatcgtgggattttgctgtttaaagaaggtggacagcaggacagagggcaggctggcctccctgccaggcctcacaggaactttgatgtggccactgctttctaaggctgaccctgattattggttcatccagagaggtaactaggtattagaagactgtatccctttaaccggcttcatagtagtgtataaattccacaattcagttctttaatttgagatgggaagtgtcaggcacaatcatttctcatgtttatggttcagtgcattttctcccaataggcaaatctacatgaaaaataaattataatcagaaggttgcttggtgagcattgaatcagctctcagcaaccagtgtcagtaagctctggtagtgcaacacactcatcttccccataggaatgcaactgccactcagaccagatattgttcaatatgcagagcatcctttctactagaccaggctgcagatgcatggccagcttttgctttcttcatttcttttcttacagaggtattatagactttctcttttgatactttttttctattagaatttaatgcagttgagttgattaatgtatgtaaaacacttagcccaattcctggtatacagtaagtacatgataactattattatgaataagcataactggttttgagtccaagt

SEQ ID NO: 44407 - DNA, 1415 bp, Homo sapiens
tattaattatactttgtaaagctgcactttttggactggtgaatatttaatgaaatgtagatcctgcgttgtcatcctgtggccctcattggtttttcccttttccacctcctttctggaggaagaacctaacgataaaactgtttctgatcttgccatctagaaaacactagtatgaagtggaaatttgtgtctccttaaaagtgaaatgaagcagcctatttaccaccacgtacctccaggccagtgggtacttatgagggtatgcaagatgacttttcagaaatcagccctgcttgggatagaaaccattgatttaataaagaaagcataggtctgtataccactcaagatgccattggtctgtatccaacttttttggcattaacttttaaaatatgcctttaaaggaaagaattcccaggagactttgtcaagtttcaatatagtaaattttatggctgagttataactcctaaaaactgaagtcaatagtagaaatgacagacctgaattagaagaggatagctataataaaacaatttttttattcccttatgatctagagtaaaaaaaacacacacacacacatttttaagttttttgttttaatgctttgaaaatggtttctctttcttgttatttatactttaatcagtgatgggtattagcattaaagcctaatatccacatcaaataatacaaggcacactgctgtaacacacaattatattaaccataaacttttacctgtttccagtctctttttgtttaaacatcattttttttttcctggcaagcctctatattctcattcacaccccagtaaatcactaagagattattgatgaagatatgtgtatttgggtgtttgaaggattgtaacaaaaatcaaaagtagaatagaattttagaatatatgctttctgcattgaggacttcatttgctttatagccttctttatatttgttgatattctttcttgccctgtgccaacattttagaaatacatttttagaaatttcttacaagatttatcagtatgctaccaataacaacacacactctctctctctcacacacacatacacacacacacacagacacaactttttatccatgtaataacaaatatcttgaatttataatgtgtattttgccagaagttaagtggttatacatcattgctttagctttacaaaatcactagatcactgacagattgttcttttggttttttttgttttgacattttttcatatagttaaaacccacagcactcaatttcatcacccaggcccaattcacaaacttaatcaatggcaaagtaaaactggcacctcttgatttcctggtttatgttttttgggtggagctgattcctgagtatgaaaattgtgttaggaaataatat

SEQ ID NO: 44408 - DNA, 2107 bp, Homo sapiens
caacttttctgtaggagagattattgaatctcctataaaggattatatgtaaatatataaattaacatttgtctgttttacaaaatagagtgtctgaaacaagaatacataaaatgttattttcaatgtactagagtagaggagtttggtatttaaaggagttctgtactttggtaaagccaaaattcctttgattacactagtggttggttatttaatcaggatgtgaattcaaattgcctacaaaattttgaaaaaatgcagatgtttggctgactccacatctatcagattgcaatttctagtggtagtgtccaagctcctatatattttgtaccaactacctgggtaatttgatgggttttcagaactactcaactatataaaccaaagaacctcaaaccttaacatatatatgatcatgtgggaccttgttaaaatgcagattctgagtcaggagctctgggtgtgacctgagattttccagttccagcgagctccatgtgatgtccgtgctgatggtgtgtgatccacactttgaacaataaggctataaataataaccatctacattttaaaagatttcctttttttttttcatttaagtgtggtgtatctgtttcctactcttgcttattctataagagaagtgtaatgggctttagatccagtctaaaatagttttggtttggatattgtcttccattaaagtttcagtacgcagaggatgaaactttgtccttcgttttttccaatgaccatcagataaatgataaacatgaatctaaaagtaatttctcatttccgatcctcctgtcagctatggtcctctgaggtcaaataaaagacaagtagaggaagtaagtcatctgttcagagactctattgcctcttaaaaataacactcaactctgaagattacacatgcttaattttcattatgatattgttaggactaggtgtgtttattgtttttaaggcattgactgacaattttgtttttgaataagttctattttaaaaataactttaatttctttacttaaaaatattttgctttcaggtcctctttgctagaattttaatttggtatgttgcatacagaggtggaaatagtgttatagcttttaaataactaaattaactttgttggtaagaattaaaaataacctaaaccttactgggttgatcataggaagctgaagggatgctggggctatgatacatgacaggagatttactgacgtgactgtagttgatttgggggctgtggggtggtgacagctagatttgtttacatgctgctgatgtgtagatggtgtcctaggtatgcaggcaaacaggtatttgctaggttgaattaacccaaattccttttagtctcttgagtaatgcaagcctttgtattacatgttaattaaagagtttattacttgtaagactagttgtgtttgaaatgaggtgtttgccttttaaaggttgaagatttcaacttagcacactttattgaatagaagatgaaagaaattatttaaaaatacgattggggacagattagtaataataagcaaattaaacaatttttttggcagagcttgttcagtatcaaaagttaaagcattccatgagtattcttcagatttcactgtcttacattgacttatttcattcagtcagtaaacaagtaagctcctgcttcgtgcgaggcactgagtcaggtacagagacaagcaatgcagttcctcttcaagtatgatggaagaggaatacattataaggacacagaagtggaatattaaggcacactgaggagttaggaaagacttataattcctaaatttattcttgagttttgaaagagataggcagaaaaagtttccatgtaggtacagagacatgaaatcacatgtagattaagggaaggagtatgagacagggaaatggccaaatcaagaaggcttttatgtaccaagtaaatagtttgaactatatttcaaaattaggagtaccgttgaaagattataaacagggacatataatagcaccaaggggactgaattggagtggaggtggggatgtgggattgtgtgagggaaatcaattaaga

SEQ ID NO: 44409 - DNA, 1026 bp, Homo sapiens
tatatactcttagtgattcctctattcccgaggtatcacttatcacttccataaagatgactccaggtccgttttctagtctggctgttctccttattataagaccatttgttttcaaagttgaatgtcagacatctccacatgaatgtgtcaccagtatcttaaatgcaacaaaaaactcagtaatccaaacttatcttccttttaaaatttcttcctatgtgctccatgtctcagttgttctaacccctacccttccggttacctatgctagttggaatcctggcaaatgccttaacttctttcttttatactctccctaatctgtgatcaatgcctatccatcctgcctctgaatgtttttcacgtttgcttccccttcccatctccacttttagtagttttgttatcacttaccttcactattgcagtagtctcttaactgacctcttttctaatctgtcttccgtgctgttgttagaaatatcttcctaaaacacagatctgttgttactgtatgttcatcgcttgactaatttacttatctttcaggtctctgccaaatgtcacttctaaataaagtatgtctgtcttctttgttgtttgtttcatgttcctttcctactgtcatctaatactgtttgtaattgtgtttatatttgtgcattgatttgtttaatgtctttcttcccactggagagatttatgtaagggactggggagagttatgtagaccctgggcctagcacaatgctcgggacatagtaacacttaaaacatatctgttgaatgagtggatggataatagcaaagtacaggcagtgcaggcaaacagataccaagtagcaaaggcagggaaattacagggtcctagactcttagtacattctcacagaccttaatctgtagtttaaaatagtaatgggcttctctcttttgctttttgcatttatttccctaaggatgagagtgaacaacttactaccccacactgacacttcagtgagggcactgtggaacctttct

SEQ ID NO: 44410 - DNA, 1051 bp, Homo sapiens
gagttgattggttatcatttcatttatccttgcttgcttcaaacttttcacactgttcttaagccttcaaccccatctttgcttcctttataaaagtcagatcttgcttatatcatgacaaaaagtagaagatgtttgtttatgctcttttcacatcaggactattttttatcttctgtctcttctttggaggaagagctgtttttctgttccaagtccagcacttccacccttgcctgtctacttcactggactttcttccaacaactcctcctctttacccctccccagcttctgtctccctgtccactagctcctcttcctcaacctacaaacatgctcaaattcctttcagtcaaaaaataaacttctcttctatactaccttgaacctagttactgccatctagtctgtcaaacttccatgtgctctcatactaccctgttttagtactgattctgtcacattgtaattgtttatttccttgttttccttctatatcagactgtaagcttctgagaaatctgtctcttgatcctggttgattcaccgaagcccaagctagttcctagtgcatcgtacgcattcagtaaatattttttgaatgaatgaacaatgttagagccatgcctctgccattcactttgtgaactacctgtaatttttttctacccctacatttcggttgaaagttcacttgaaggtcaccacataaatgtgaaatctagtggcttctctctttacatcatgcttgacctctgcaaccattagtgcttacaaatttaccttttccacacattcatggtcacgtatacctgggtcattttgggccagtctcagtattgcattcaaaagaagcagacaagccccgaacctttggaaagtaatgaacttctgtaatatattagtgaaatcttctaatgagatagaaatatacaattacataaagctcagcaaacttcaaataagttctttttacccaccttcccatatccttacacagcttggcaccttcaatctctcttttgtaacagttcacccaaaacttgta

SEQ ID NO: 44411 - DNA, 1014 bp, Homo sapiens
tcttttggggaaacagtcatacagtggttaaagcacggattttttaagagtcaagaagacctgaattcaagtcctggcttctttgcttactagctctgtagtgtgggcaagttaccaaatctttctaagcttcaattttcctgtctgtaaaatgattatattagaaactaccttataggtaggtttattgtgggaatttataaaagcttaatgatgtgtatagtgtacttagcacaatacctggctcagggaagagctcagtaaatattattactgtcgtagtgatcactgaacttgtatcggtttctttctgaaatactttctagcacttagcttttggttatcttgctttgccatttgatgtttgttgccttcttgttggcaataatccaaccgttaaatgaaaagtcaaatgtaacatctgtgataaagccaagatacacagaagtttattaagttagagcacttcgttattttatgggcctttatgctggagtttggtgccatttttggtggcaccttttgctaattgttcacgaatttgctgaccttttatgatattattttgtttcttcatgattaatgtcttattgaacaatgtgtagttttgaatagcaaaactcaggacagttttgttttgttttgttttggtaaacattaggctgtgggtacaggaatgtattttgagattacaagcaagaattgtcttttctttgtatcaccaatgcctcatagtgtacctagcacacaacagttgctaagagaatgatgaagaaagaaggaaggcaggaacaacacttcagttatcttcaggcttatcttatcattagtcaacagtctgtcttgggttttacttcttttcccattacatgatctaatctgtatagcttctctacatgtgagattcctcttcatttctggttacttatggtttctgttgcctgccttcattgtgtgaaccttctagcttctgccattgctactaagtaatagtgacaggttcagactcatggt

SEQ ID NO: 44412 - DNA, 1028 bp, Homo sapiens
aaatgttgtggtttgattatcacacgtttttttatttgtgtggaaaacttgagatgaaaccatcttttagaagtaatttactgttgcatagttttaaaaactaggttttattagtaaactcaaaagtgttcatttattcccatttctcctcagataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattcccctatttttctttaaattttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagt

SEQ ID NO: 44413 - DNA, 2560 bp, Homo sapiens
acaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctggtgaggaacagttaacagagttttgcttttttccccccatcgaactaaaaaaaaaatcatttgaccataatttatagctggttccattttaacacgtttgcttccatatatctcatggcaatgggaactgcaagagtaatgtgcatattgcatttacctcttcagtgacctttattccagtggcttgggaacaaaagttaacttcagaacttatcttccacaggacaatgcaatgtagttgtaggtagatggcacagggtcagtgctttccttttaatgttgtaaaatatatacatttatattggcttatgtttacaatagaagtcttctgtttaactaactttgcacaggtttaatttgattcagtgacttagtctactaattaatgaattgtaggaaagttaaatatattagaatgaacttgtgaaggcgataactataggaaaaaatcttttgaggcactgtaattattgtaaaaattaatctgtgacggctaaataaaatgctgcactcagaaaaaaaaatccccgaattgaattaaaaatgattagcatttatcatttacttttaacatagtgcttccaggcaaagggggaaagttggtggtaaatagaagtttggattttttttccttctccttgggagtgtgtgttagttactgttttttagttttgatctatggaaacaatgcttatttaggtcccaaatgcttcccctctctttttaataaactttttggtgatcattttaacatagttaatattattaactagggatttgttttttgtggttgtgtgtcgtaagaaaagtaaaattcatatttggaagaaagaaaaatactacttttttttttttttttttgagacggagtttcgctcttgttgcccaggctggagtgcagtggtgcaatctcggctcactacaccttccgcctcctgggttcaagcaattctcctgcctcagcctcccaagtagctgggattacaggcataagccaccacacccggctaattttgtatttttagtagagatggggtttcatcatgttggtcaggctggtctcaaaactcctggacctcaggtgatccgcccacctcggcctcccaaagtgctggggttacaggcatgagccaccgtgcctggccaaaaaatactacttgttaaagaaggttttggaacaaatgtagatttttaaaaaatgcaacataaaatgagtagactccctatacttttcgcaagtctatatatattttaaaagttcaccttctatacctgtgtcccctgtattaaggcatttaatgtatttaatgagtattaaattag

SEQ ID NO: 44414 - DNA, 1060 bp, Homo sapiens
taaagggtgtaattattgtacaaggaaataaaactacctatggtttttaaataaatctgtatagtttttaattatttgttttagtaaaattgtgtcatgttaagaagacatgtaataggactgagtttagcaaatacttctacacatcatcccatttatgtttacatatttgcttacaaatctttcattttcataagatgctcaaatagactagattagattagactattatggattaagttaatgggaatgctgttatgttttctaaaaaatgccatttttatttatgtagtaacatttttcatgctgttttatcaattgagttacgagaatttgagttgcctttgctagtctaaaacattcagactaaaaatatgaaatatcatttttattatttaggacacctaagtgcttatatattttatattaagggcatttgaagcaaaagtagcccttcagattatatatgttccttaacatttttgtgtatcatgatgagaatttaaaggaaattttagtttaatagtagtctttatctttgtagaatactgaaaagtagataatgctcttataaaaataaactggtaatatgatatattctgagatagaggttcataatatatcttaaaatattagagggctacagcaggctaattacttcagattaaaatgttgttttttccttaacagaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattc

SEQ ID NO: 44415 - DNA, 1832 bp, Homo sapiens
atatcagcaaatttgccttttgagttattttttatttaggcaaattctgaaaatactattattttaattttctgagtacccaacagtttaagttagaggtgatttagaaatatgctgagtggtacaaagaaactaatcttggattaaaaaaagaattattttacttcattactgtatcctgtaactaagaaattttagtttcttcaagatagtaatctcttgcatttctggttaatctaatgtctactgtggtagcccttctttagcactaaggcatttaagttgagactgactaaaaccttgggagaatggtatggaagtctggactgtataacttggggacaaagatcccttctagctctgaggctctgttcttcctattccactctactcctaagcacaccctcaatgactcatctatttctaggctctttccattacaattaggtcacacacgttgcatttaaagaactatcctggtggtgctatatatctttgacagatatttgaagatagaaccctgaagtccatgcttttgctcttgttaacctgtagggtataaatcaggttgaatggtagtaatatgttaggttatctacctttatcttcaagctcagatagttatcttcaactgctgtatcatctccttttgtgtctcaccttctgcctacactgggctgtctatgaccaggtattaattcctatgcaagctggaagttcataaaaagttctgtcttatgaaggagttgactcatttttaatgtccaccacttgatgtgtgctatactgactgcttgaccagttttaacccatcctgtttgcctgacatttcagcttttcctttgaactgttttcttggatttaaattacaaattcttattgacttctggtatatctttattagtctgcttaacttgcaaattaagttaaatgggtttttctttttataataagtaatatgtgtctgtggttttaaatagtaaagtacaaaagggtatagaggaaaaaataagtttctatactattctgtccttcagttcccctttgctcaggcaacgctgctacatggtttatgtgtcttcttccagagaccttttatacatatacaaacatatatccctcattttcttcttacacaaatggtagctgactctacgtactcttgtgtacctttgctttattaactgtagattcaactatttattgttgacatcagtccatagatagatgcctcattttttaagaagcctgcaggttttgcagctgcaggttttccacttggaaattcctgatgattggctgacttgagacctgctgtttgctctgaacccctggtttcttctactaccttgactgtgccttaccctttgtgtagtttggctttggctgtgtcattctgataggatcatgtttctaatatggtgtcttcaaatttccctcctctctataacactttcagtttatcttccttcctctttgacctctctccccaaaccaaaacaaaattttaaatagcagataaaaagtgtactacctttacatatttattaaatatcttttatgtgtttattaaattggtttagttgagttcaatattctttcagaatttcttagttgtgtgctagaggcaaaggaactatggaatgcccctatggttagaaagagaaaaatgaggggaaaagagaaggataattttgtctggtattcaagactggtctttaatatgaagctgacatcttctttttaagttcttgaaatatataatattgtaagaagagaaatatataatttgtagaaaaaagattctacatgtagaatatgctagagcagta

SEQ ID NO: 44416 - DNA, 1029 bp, Homo sapiens
gtgaaccatacttttgagacacctggggcctaaatcactcaagtcagcagcccctgctcattcagccctgaggatgactctggctgtatctggatgtatctttcaagttgtggtggctgacttggccaacaggcccagagaatcagagcctgatttcccagccagaggagattcgctaacccagtatgagtgatgctgctgtacccgtctctcctcctccctccatttcagcccttttgcttctccaatataaatcataattccttccctgaagttgtttacagtctatcaagggtcacagtatgtgcatctagactgcaatcccaggaggcctctgtatgctgagagtggttgatcaatggatcgtatgagggtgaggaggcagggagtgatccagtgcaatgaagaaaggcttcaggatatgaacctgtctgtgagtgatgatctgacctgcataatatggcttagatagggaagtgcatccaccgcagcagaaaagcatggaccaaaggcccagactgtgcaagcccattgtattaatagattggatattgagggagaataacatttgtggaatcacgggatgttagatctgaaagggatattacagcatgttcggtcatgcccctctcttaataaaacaggaaaccaagacccacacaggacaaattggctctatcaccagtctggcttaggagtagagtagaaactcttgtccagagtgatgggtcatggctggatggctagcacagtaggatgccaggttcactgggggtttgggcactgtcagcctgggtgagcagagtagcagtaggcacagagggagggggacagcaaggcagcagctccattgatgtgccagccttccctttcctcccctgccacagctcctgggactgttaaagagatacaagaagagaggccaggcatggtggctcacgcctgtaataccagcacttagggaggtagagccgggtggatcacctgaggccaggcatttgagaccagcctggccaacatggtgaaacc

SEQ ID NO: 44417 - DNA, 1077 bp, Homo sapiens
attctcctgcctcagcctcctcagcctcccgggtagctggaaatacaggcgcccaccaccgcacctggctaatttttgtatttttagtagagacgaggcttcaccatcttggccaggctggtctcaaactcctgacctcgtgatccacccgcctcggcctcccaaaatgctgggattacaggcatgagccaccgagcctggcccatctgctgctctttagatccaggctggagggcctcctgagccaagattaggcctgcccacagccctctgatgacatcaatggggagaacaaagcgagtcttttgtatgctactgtgaattaaattcaggtaacatggtatttgctattaattatgagggaaaagctttagctagtctgagtcctctccctatacacattctcctgtgggatcccctcctgttcttccctcccacccttccttccttcctttcttcataactccaagttggaagggacttggggatgagaaaagaacaaaggaggaaataaaggcagcgaagtttggatcttcgttctccaagttgctcagaatctagtggaacagacaggaccttgaacaactcattttaacacaacctggtgggagttatgagggaagaagcatagaacccaaagaacaaaggggaagagggactccggggatgggaggagagctttgcaagggaggcagtgtgtgaactgaggcctgaaggacaggcgttccccaggggaaagaggggaagcagggcattccaggccaagctccggagttagggaaagccatagttggtttgggaagattcaatatggtagaggggtggagtgtgtgaggctggagagctaaaattttgcgggcttaagtctgtttagtagggacctcctgggagatctaacctacccaagagacacacatacacacacacagacacacacacacacatacacaacccttgatggctatgtttgcatttacactccagcccccttggctacaattgcctggccagtggtaggcaagagacgaagaggctcttctctcctccctttcctcctcccttccttctcctgaccct

SEQ ID NO: 44418 - DNA, 1075 bp, Homo sapiens
tggccccaggtaaagttgtgtggagcaaaactgccctgctgagccctgaccatttcttggcccacacaatcatgagaaataatgaattgttatttaaggccacattttagggaggtttttaatgcaggaatacagggaaatgaaacactttctggctcactctttttcctacatcatctgtcccagtttgtggcaccatgatccacaatcatccacactagacacttcggttgtaggagacttctccgctctcacctctatgccatgtcactggccaagctctgccgattcttggggagggtgtaaaatgttactcctaaataattcctgagaccgccccacctcgacctgcctgttgccagcacatttgcccagattctcaatcttcttgccctggacaggtgccatggtttccacaccagccatctcaaactccagccttggccagagtcacctccctaacaggcatgttgccctctccctgacctaaagcctcatggtggctgcccatcaactgtggaataaaggctcaactttagcctgatgcactaagaactctgcccattgggtccacgcttgcttgaccaaatttccctgctcttctaacttaaaacttcaggcttcagcaacagagagctctgctgggttttgccactcatatgcgatttctcctttttgtgcttctctccagaatgccaccttctctctcctccttccagctgattctcagctcagcaatcacgctttctggaaacctttctcctttcctcccccagcatctaccacacttgctggactggggggccctttctgggagttcattgccatcagatttgtgtgtcaaagaaacagccacattggaaaggagttttacaccccttcccaagctagactgggcggggactgggggactgtgagatggctgccaggcccagatggaggctctcacgcagtggaggccctaggaaggagagggaggcttctggccttcatggaattgaattgaattcatcatacatttctcctttcctcctccctccagccccagctgacagcggggccgacaggtgaattc

SEQ ID NO: 44419 - DNA, 1003 bp, Homo sapiens
acagactgggaactaattctgagaagagaactgctgagttactgaaagaccttttggaccacccctaaatggagcatcttgatagatggcaaatccagtgtttcttaaacttgtccatgctgcccagagcccactgccttttatcagatgtgagacttcactgccacagtgtcatcccacagtttccttccctggacatttgataaagggaaaatcatttcttgtcctttaaggcagggactattattttttcacttttccacataccccacaacacctaacattgatttactcgtagtaggagtttcatactgttgaactctctaaaggccatttgttccagggcctagctgggcttgtgaaggacaacagagtcatttcctaaggaccccaaaagacagcatgaaggaaaaaataataataaactgctgttcacagtgccttgagtgtaccaccgtactttctgctatgccttgtccattccaatctggacagtctctgtgcccctcctttccactcaagtgttatccagcactcaagttctggctcaaggcccaacatctccgtggggacctcagccatcccagggcattgtgaccccttcctctaagtccccggcacactcgctgattggtaccctctcattcgacaaagcatatgccattgtggcttacttgtcatttctttaggtcttgccttcccaagtagatcatgagccactataagaactagctcccatagtcccagcccctgggcctggtacatggcaatgcttagtgattggtgattgaggataatggtggtaaaggatgtaccagacagtcatctcctgaagagatgccgaacaacctgtccttgttttatgtattttctctttctttcctgtccagttttattcctctcatagtaactgctaaaaaaatatcagttcctgtcactcttccaccccttttctccctctcccctgcattgtggtctgggccttggtccactagcaactccc

SEQ ID NO: 44420 - DNA, 1090 bp, Homo sapiens
atataagcagaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaatttttattctttatttctcaaatggaaacacctgaaaaagcattctggagtgctgaatttttaagatgtatattttgttaagcatattctctaaatgagatattgtgtggctttttagtaacaacgtcatttctaatatgtgtgactcctttattatgtatgaacattctttgacattcctaattcagctctgtagtcttacacactgcaggaactgtctaagcgagagcagagagaaatgctttctaacctaatcgctgcaggcggagacacttggaaaagaatggggggaggtggggcctgacagagagcagcacttatgtgtttgtcagatgaggggatttccagttgaattggcctgcagtggcctaaagacactagcctggttagcgatgacctgcatttctctcatagagcacctcccttttcatcgtatccactagctctctaagtcctccttaatgaggacacttgatcctcattaagtctgccccttaagatggcttcacacctactgaaaaactccaggggtttgacatctcactttgattgaaatcttgtcttcctataacatttgattccctgggctcttcagccctatcacctctgcttgtctttatccactctcttcttcattcacttttggctacacaggccttccttccatctcttgactcttgaccacctcagagcctttgtatccgttccctttgcctggagagtttttcccttgcatctttt

SEQ ID NO: 44421 - DNA, 1034 bp, Homo sapiens
tggctcactgcaacctccacctcccaggttcaagggattctcctgcctcagcctcctgagtagctgggactataggtgcctgctaccacgcctggctaatttttgtatttttagtagagacagggttttgccatgttggccaggctggtctcgaactcctgacctcaggtgatcagcccgcctgggcttttcaaagtggcatgagccactgcgccaggcttatctttatgtacttaagaagttagctctttgtcatgtggcttacactaatctctttcagtttgttgtttttctttttaccttagctgtgcaagtctcaaacaaaaagaagaggaaattaccctctgatgtgaatgaagggaaaactgtttttatcaggtatgtctttctgcctccagaattgcttttgcgtggtcttcatagatctctcttccttcttcttctctttttggcactagttctgttacctagcccagaaattagatcaagcacatctggtcccaggaacatactaaacaatgagaaatgtaggacaatcagaactataacacagaagacagatagcatgggtcctgacatcacgttttcatttagatttcatgctttgtaattgggttggcatcatttggaagaaatcagttcaactgttagaaacatcttgcttccggcctttgttttagggggagtgctggagaggattgacactgcttgtctcaaatgatttctgtctttatgcctaacttatcttctgatgcagtgtccagaataaagtaaggcatctcatctgtttccaggaaaactaggtgggagtgggggtggcaataggctttatttcgtgttgctgttgtgttttagctctactgactgcaatagattgctgcttttatgaggtcaggatgtcttcagtatacctcaggcctgccttctagtccttaagtaccagtgtactagggtcatttgcatccgattttagagttatatattttatcttcttgtacaatcttttagaattattttcttgggtgcggtggctc

SEQ ID NO: 44422 - DNA, 1065 bp, Homo sapiens
aagcagtgatcattctgaggaggacagtgacctagaggaaagcgatagtattgatgatggagaggaactggctcagagtgataccagcactgaggagcaagaggataaaggtttgtttggattttcataaatgtctttagactttaaaaaagttactgaagttacggaaatgagcatcagttctgcttagatctctttttaaataggactctaaggtgttctatcaaatttatgtttaaatgctgaaaaggaaacctttatactcctttcttccaaaggtttttttgttgtttcctttttgtttgttttgttttttaagtgagttttggagtggtgtttgagggttaagattcttagggaattgaaaacctagcttaatgctgaggttctacctctctctggattgtccaacttgatagaataaccaggtaaacagcatcttatacagataatatagatgaaacagatgatataaccatctcaacatcaagctagattttaaacaactccttggagttgagatggggataaagaactgtttagtcagtttggactgacataacaaaataccataaactgggtggcttaaacagcagaaacttattttctcacagctctagaggctagaagtcccaggtgccagctgattcattttgggtgcagctctcttcctagcttgcagactgctgccttctcgctatgtgcttgcatggccttttctttgtggcttgacgaggggagagagagaacaagtaacagtgaactctggtctctcttttcttataagcacagcaatcctatcagattagggcccaaccttaagacctcatttagctagcctcagttacctccctaaagtctctgtctccaaatacaattatatttggggttagggcttcaatgtatgaattttgggggaacacagtgcgttccataacaaggacctctttgaacatgttgtaaaactttagccaatccttattgctacctttattgagaataaattcaacttgtttattgaggaaggcaggtcattacagaatgagaaatggctaataactggtt

SEQ ID NO: 44423 - DNA, 1032 bp, Homo sapiens
tcttgtgggcctgaattgcagtaatttacttcttagtattctggctacctcctgctgcctctcacttctttctttgtgcatttgcacacagatgggaagatgcgcggttttggttttgttcagttcaaaaacctcctagaagcaggtaaagctctcaaaggcatgaacatgaaagagataaaaggtaagctttctatacccatatcattgacccagatatttctggtgttttggtgaattagtgtagtaacccactttctgcattttcaaaagatgtttgcattattaagagtctcattgctaatacggtagctatttaggtgaaatactctagaacttgatcttggggttaaacttgaaagaacccttgccagtattctttcttttatctggtgagagtgtccttttaaatccctagtgaaaaatgtccctgagataattgctgatagatgcaggttggtatctagattcctccttggttatatcactgttcagcatctgtgggctatttattaaactgactgtgatttatatattgacttatcaagtactgtgcctaaagaagttattgccggccaggtgcggtggctcacacctgtaatcctagcactttgggaggccgaggaggcaggtggatcacctgaggtcaggagttcaagaccagcctggtcaacatggcgaaaccccgtctctactgaaaatacaaaaattagccaggtgtggtggtgcatgcttgtaatcccagctactcaagaggctgaggcaggagaatcgcttgaacctggaggcggaggttgcagtgaactgagatggcaccactgcactccagcctgggcgacagagcgagactgtgtctcaaaaaaaaaaaaaagaagttattgccgtagagatgtcctagcttccaggtagggtgcagatgattccagaatgcctgttttgattcctgatagtctaactggaaacatagttctaattctttatttttttactccatcttatcccaggtgtggtggctatgtagaaaggcaaaat

SEQ ID NO: 44424 - DNA, 1030 bp, Homo sapiens
ctgattggcaggtacagtgatcagtttgatacaggttatctcatttaattttctcagcaatcttaccggatggagagtcttaatgtcattttacagacaggaatccgggatttaggggaatttagtaactttaagtttgtacggctgttaagtagtggacccccgatttgatcctcagacctggacatcttagccaggatgctatccacttgttcattcatttattcagcaaatacttaatacctactgtgtgccaggaagtgttgtaggtcctggggatgcagcagtgcacaacaccaaaccaaaaaaatctttgattttatgtcttcaaggtggggaagagagccaataaacgagccaataaacaagccaaccgtgaaaatgatgtcaaatgctaaggagaaaaataagccagggaaaggggttaggaagtctatgtgcatgtgtatagtggggagagggggtgaagagtggcaatatagatagggtggccagagaaggacggactgaggtgagagagtgaacacatgcctctccggaggaagaacaattcaggaagagaaaacagcaagctcaaaggtactgaaacagaggtgtttttggtatattggaggagtagtaaggaggacagggtgactggattgaagtgagtaaagggaagagaattaggagatgagatctagagtagcagatcatgtaagatttttttttttttttaaagactgcgtcttgctctgtcgcccaggcgggagtgcagtgccacgatctccgctcactgcaacctctgcctcctggttcaacccattctcctgcctcagcctcccaagtagctgggattacaggcgagtgtcactacacctggctaatttttgtatttttagtagagacggggtttcgctatgttggccagggttgtctggaactcgagacctcaggtgatccgcccgcctcatgtaggatgttatagaccattgcaaggactttggcttttactcagagataggaagccactgattttaagcagagagca

SEQ ID NO: 44425 - DNA, 1049 bp, Homo sapiens
ggattcatttagtcaatgaatatctgctaaattccaactgtgtgacagaaactaatttaagtatggagattcagatgtgagcaaagaaacaaaaatccccgttctcataaagcttcctttctggtggggggattgaactggagggggtgtctaaggctccttccagttgtaaagttctgtgacttcaaagaaaaactctttaatagaatcacaaacaagccaagcagggagctggggggccgaggcagagcgcgagaagtaggagaaggaagaggggaaggatgacagctcaaactccagcgaagacattgaataggggcgcgggggagggaaaggtgagaggccaagaggtggggtgagtctcatatgtaagacaagtgtgtcctggatacggtaggggactctgactggcattcaggctactgcttgtggggtgggtaaggggagggctgcatcattgcctcaagccaaacgttctttgcccacagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacggggtaggcgcgctcttcggcctggttgccttgctggcgctgctggctctggccctcttgccctggcggtgcccgcccggcgccccctgcctggcgctgctggacctgctgctgctgtcggccgggaccacgcgggccttcccgctcttctacgacgcctatgggcacagggatcgactgcccgcgctcgcctggctgctgctgcaggaccttccgctgccctgcttggctgccggcctggggctggcctgcctgctgctggcccggccgcgcccgccgcggtgccccaccggcctggctgcgctgctgctcctggggctggggctggcggccg

SEQ ID NO: 44426 - DNA, 1051 bp, Homo sapiens
gtgggccgagattgtgccaccgcactccagcctgggcgacagagtgagactctgtctcaaaataataataataataataataataaattaactcttgcttactgtaacttttttactttataaactaaattttttttaactcttggactcctttgtaataacacctagcttaaaacacaaattgtacagctcattaaaaaattttttctttatatctttataagcttttttctattcttaaaattactttattttttttttttagcttttaaacttttttgttaaaagctaagacacaaacacatattagcctagacctacacagggtcaagatcatcaatatcactgtcttccacctttttacatcttgtcccacttagaaggtcttcaagggcagtaacacacatggagttgccatctcctaggataacaatgtcttcttctggaatccctcccgaaggacctgcctgaggctgttttacagtaaattttttttttttgtaagtagaaggaatatactctaaattaatgataaaaagtgtagtatagtaaatacataacccagtaatatagttgcttatgatcaattattgtatactgtagataattgtttgtgttgtccttttatatgactggcagtgcagtaggtttgtttataccagcatcaccacaagcatgtgagtaacgcaacatgcagttgttcatctctattatactcataggatcactgtcatacatgcagtccatcattgaccaaaacatcattgtagcacataactatagttctaacattcatggagctttttcgtttttttgagacggagtcttgctctgtcgcccaggctgaagtgcggtggtgtgatctcagctcactgcaacctccaccccctgggttcaagcgatcctccagcctcagcctcccgagtagctgggatcacaggtgcccaccaccacacacggctaatttttgtctttttagtggagatggatttcaccatgttggccaggctggtctcaaactcctgacctcaggtgatctacccgccttggc

SEQ ID NO: 44427 - DNA, 1034 bp, Homo sapiens
tgggagccgtcacagtgacacacaaacaacttacagacttccacaagcaagtcactaggtgagtgatactgggggttcttaaggaggtgtgggatgtgggaagaaacatatctttatttcttatgtgcccttgggaaatggacaatttatagtttgtttaaccttgaattgcacaaattggcattggaagccaatctggtgggaaaacattcaccatgctgtgtatgtatgtacatatatttaacatatgtgataactggtataagattttttaacggtaagtggaggcactgtttctcccaaaggaaaatgcactgagcagctcactccccgtcaggagatctgtctatatttttctaagtccttctgagttttcatccacattcgggggtcaggaatgtaggtacctgagtaaggcaaagcattggttataaaacatcagaaagtgatgtagatgacagtgaattggagaatgttcaccatgcctaaagatagtcaaattctaatttcaaagaagttgtgtagtccaaacagaacatctgcctgggatacattaggcccatgaggaacttacaatctctggattacagcctaaaatgtaaagtgtgtgtgttttttttactgtgaacatataaatatttttaatacagttacatagtcttcctaattattgttttatagccataaaggtgttacttgatttccttataatgcctctattagtagacatttagatcatttttcagttttttagtattacagataatgtcaaaaatagagccttttccttctactgaatattttcctttaaaatgtaatcaccgaatcaaaggttatgagacttatggtcttaatggtaatgacagcaacttaagttggattttatagctaagtgttcctttgccctgatagtctttttgtatctagagtctttagagttttgtctaaattttagacaatgacttataatcatacagtgtggaaagatatatgggtcaaagaaggaatgttatagcaaggttagtagtagtgaa

SEQ ID NO: 44428 - DNA, 1084 bp, Homo sapiens
aatggtgtgatctcggttcactgcaaccactgcctcccacgttcaagtgattcttctgcctcagcctcctaagtagctgggattataggcatgtgccaccaccagcctcccaagtagctgggattataggcatgcaccaccaccagcctcccaagtagctgggattacaggcatgcgccaccacgcccggcttatttttgtatttttagtagagacgggttttcaccatattggtcaggctggtcttgaactcctggactcaggtgatctacccgccttggcctcccagagtgctgggattacaggcgtgagccaccacacccagcccatatttgggtttataaagggaaaaatggaaaagatagccatagtgcctcacagcccatctacccaaagttggattgaatttgcgtgttctattggaagtgacttaaaggtggccaaaaaatgataggatgatttaaaggatgtgcttataaaggtgatgtaagtaaatgactttatcatctggttttctttatttggtgaaaatgatactaagtaagcaagcagggatcagggctctgggtcctcagtgaaattggtctttgttcactattttgggctgttgtcttttcccaggcataccaatcccattgtggaaaatggacagactcatccgtgtcagaaagtcatacaggaagtaagtgctaatggatgcttgtggaatcaaggcttgcttcttttttccttacagggctttgggtaactcacctgagaagatactgtcttccaagttcatagggagattcagtttgttgatgtggtttcaatgaaatgagggacagagccatccaaatgtcttttattttagatttgataacaaaacaggctgcaagggaatgccttgaaagaccagagaagtggtagaaagagattcactgtgtgactcctagagttactaggaggcctgatcaataccagcagaatatttttgacaaagctagtgacttcgttttcctcagtgatgacatacttcccctctacttttttcactgaaggttatgtgaggatcaaaagtcatgttttaagaattgcttttgag

SEQ ID NO: 44429 - DNA, 1026 bp, Homo sapiens
caagtatattaatatacttggacttcctttcttctgtcttctgagaaggaaaggtggttttttgttttgttttgctttgttttaaaggtagcttccagacccgaatatcttaaatagccttctgtgggaatgagctggtatacagtcattcattaacccctcacttctcttcatcttagcaacctagcattctttggagcacaataataaagacagtcatcttcaatgtaggtttatgtagtagatgaagctttgaacttgggaaattttcctgtgtagtttatatctgcattgtaaccacaaatatcactatttagatcttatttaataatacattatgggatttcacccccactctcatgcctcctgaaccccatggaaattatatttctaactcattgcttgcaagagctttttttaaaacattctttgcctagaaaaagatgcattacattttactttggaaaaaatatatatcacaaaaacagactacaaggagaaacattgagttttagtctaattctgttttatctcttttatagtatttatagtagtatcactttctgtgggatgacatgtttattattctattgccaaagctgaaacattagcttttcttgtggaaatatacagtggtatgcctagcttactctagcttattatctattctgtatcaaccaggtatataagtaagtaaattacttgtaaaataattttttggataatgcagaagtgggaactaagaaattagtaagttatttctgaaacaacttgggtaagtctgtaacctctctctacttcagttttcccattgagaaagtagagacaataatagcagctacctataaagttgtatttggggattgtgttagtccagtctcatgctgctataaagaaatacttgaggctgggctcagtggctcatgcctgtaatcccagcaccttgggaggccaaggtgggcggattgcctgaggtcaggagtttgagaccagtctggccaacatggtgaaacccgtgtctactaa

SEQ ID NO: 44430 - DNA, 1042 bp, Homo sapiens
agcctaattgttttacattccagtagataatccctaccttaatcaataatttcattatgggccaggcaatgtggtttatgcttataattccagcacgttggaaggctgaggtgggacggttgcttgatgtcaggcattcaagaccagcctgggcaacatagcaagagcctgtctcaaaaaaaaaataatacattaaccaagcatgttggcatgcacctgtagtcccagctactcaagaggctgaggcaggaaggatcacttgaccccaggagttcaaggtggcagtgagccacgattgtgccagtgcactccagtctgggcaacagaacaagactgtctctaaaaataataataatttcatcatgggttgcaaaatgatatttgactatttctgttatttcttgtacatataagttggcattcttatgagctcctactagaaaggtaggataaatcttaattcttttcaaaatgaggatttattttaaagctgccttgaatttttttttttctggctttgtctttttgaagtatgatggactcatgttcatttaggtccaaccaggtgtctcctttccaagtttcagaatcccattctttaccagtcagtttcctaactttcacatgagaagtgtggagggactgtaaattcacctgttgtttgtaattcagcaagtcacacaactaagtttggtatacgagtttcagcagtactaactttgtagctacaaaaagtaagagctgcttttagactgggcgtgaaagctgtggtgctcagactgtggcctgaggtgagagttaatggacttgaatttgtcattttctttttgtaagcacttgtgaatttaaaataatcccatccacatgtattttgtgtcatggttactgccacagcagtcaactacagcagccacttgggcattcaaggcacgtgcctgacttagcacatcatgacaatcaatcacaggtgatattttgaggaactgtgatgcagtctgaaaaatatatttcctgtggtgcttaaaaatgtctctaattttgt

SEQ ID NO: 44431 - DNA, 1063 bp, Homo sapiens
gagactaaaaccacacaggtcttacagatgtcactggtttgtctccttccacttatattttggggttcttgtagatacccttggagataactagacaacacctagttttgttgctatctaatgctctgttttttttgagggatttgtggagattgtataaagcttcatagaatctttttgctatttaaaaatatatcagctaggcatggtagctcacgcctggaatcccagcactttgggaggccaaggcaggaggatcacttgagtttaggagttcaagaccagcctgggcaacatggcgaaaccccatctctacaaaaaaatacaaaaattagccgggtgtggtagcagacacctgtagttccaactactagggggctgaggcaggaggatctcttgagctcaggaggttgaggctgcaatgagctgagatcgtgccattgcactccagcctgggtgacagagcgagaccctgtctcaaaaaataaaataaaaagatattaacatgagcaaagtaaagatattctgatggtctattaaatcataggtgtgcttgggttactggttaatcaatggctaaaatctttggaagatttttttacttgagaaaggaaaattggtgctattagtactacattaattaattaaacatttgttgaatacatttaagacacgatgtttggactaaaaagtacaaaaattagtaaaatatactatatctgtaaagaagttaacacctcatgcttactttgcaccccttatttcattgaaagctaaggttggggttttttggtggggggcgggaggggtggtttttttaaaaacagggtcttactctgttgcttgggctcaagtgatcctctcgcctcagcatcccaagtagctgggatcacaggtgcatgccaccatgcccagctaattttttattttttattttttaagtttttttagggtctcactctcacccaggctggagtgtggtggtgtaatctcggctcactgcaacctctgcctcctgagttcaagctattttcctgtctcagcctcccaagtagctaggatt

SEQ ID NO: 44432 - DNA, 1050 bp, Homo sapiens
gtagcattcccttgattttcctatctattttgttaatctttgccctaaatctttattatttccttctttttgctagctttggatttagtttgttctttttatggctccttaaggcataaaattaggttgttgatttgagaccttttttcttttttaatgtaagcatatatacagttatacattttattcctcttagcacagtttttgctgcattctataagttttggtatgttgtgttcttatactagttcagtttagttcagttttatactagattttatactagttcagtttaatatgcaacattggggtttttgttctgttttattttctaaacataaacacagaaacacaatacaagtgtataacttagtgaattactatatgtggatgtccttttagccaccacccaagtcaagaaacatcttcatttgtctgaagatgttttctgatttcccttccttgacccattggttttttgagtatgttgtttaatttccacatatttgggaaatttctagtttcccttttgctgttgactcctagttttatttaattgtgatcagaaaagatgttttatatgatttcagtctttgaaaatttattaagacttattttgtggcctaacgtatcagtctttttaaggagtggtatatttcttgtttccttcactgggtcccaactcaagagtttggagtatttaccagggcttctcttcgatatttctgaattccagtttttatttccccagtcttgagaggctgtccagagcccttcagcttcttagcctcttgtcttccactttcaaattggcaaatgccatgaggggaaaagtggagccaaagagtgaactgaactctctgctcttccattcccttctttctgggaactgtggcctcatattttagctttggtgtctttaaaaaggttctttgtagggagtatttagtgaattttttgtgttgtttttttttttttttttttttttttttttttttgagacagtcttgctctgttgcccaggctggagtgcagtagtgtgttcttggc

SEQ ID NO: 44433 - DNA, 1021 bp, Homo sapiens
gtgaataaaaatccatataaaacaaatatttaaatagtttccatagtaacacaaataatgtgtgacccatatcctagtcttccatattgccatgtccatgcgaacccaactcttacgaaatcccttaattcaagctggactcatggttaacaattacaagagtgatatctacatattaatactagcagaagcacaagttgctgattgatgtttcattctattttcccaagcagaagacacaggatgctaatgtcctgttcctctacttggggtgggagatcgtgcttctagatacactgcatgagtttcgatgctggtcctgacatcacatgtagattgttggcctctggaatccattaaaagtacaagtagcagcaacagtgtcagcgcccatgtttttaaagagcatccaattacctacatatattttgggcagatcacagtgctcaacaatctgatcaaggccatcacatgttcttcccatatactggatgaataatacttctcactgatctaggtctcttttgcagcaggggctttacatgtgcatgatcataaaggattgattaaatgatccatatacttcatcattcatgtaatacataaaggtctgttcgcttgactcatcttcctcttcagagcctgtctgttcttttttttctttctttctttttgagacagagtctcgctctgtcacccaggctggagtgcagtggtgtgatctgggctcactgcaagctccgcctctcgggttcacgccattctcctgcctcagcctcccgagtagctgggactacaggcgcccgctgccgtgcctggctaattttttgggttttttttttagtagagatggggtttcaccgtgttagccaggatggtcttgatctcctgacctcatgaactatctccctcagcctcccaaagtgctgggattacaggcatgagccaccgcgacggccctgtctgttcttttaatatgatttttttggcaatgaaagctgatgccacatgaaatatctgc

SEQ ID NO: 44434 - DNA, 1057 bp, Homo sapiens
ggccaattacttaagcgactcagttataagtttttaatttaagttgtaagtaggagataacttttacagagacaatctttgggttagatattacctcaaaagttttatagttcagtatggaaactgaataggcatgcttcagcatgggtgtatgcagctttttgatggaaagcatcaaaagcacaaagcagatgaagtaaagtcatgctttgatagactaagttggcattgtcatgtttggtttatcacatgtccataggaattttcttcttagatatcatatcagaaaggtcttgggttgatatggtttggctatgtccccacccacatctcaccttgtaataataccccccgatttgtggcaaggtggggccaggtagaggtaattgaatcatgatggggggttccctcatactgttcttgtggtagtgaataagtctcacaagttctgatggttttataaatgtgagttcccctccacaagctctctcttgcctgccgccatgtaagacgtcgctttgctcttccttcgtcttccgccataattgtgaagcctccccagctatgtgaaactgagtcagttaaacccctttcctttataaattacccaggcttgggtatgtctttattagcagtgtgagaacacattaatacatgggtcatggaatatcagcttcaaacttctttgctagtacttttcctttttggaatttattgattctttagcctggttataaaacctagggtttttggcttttctctggtcattactgatttatcttgaaagtttaggcattttttgtgtgtgcttatgcttgcaccttccagtcaaaacatgcttttgaaaggaaagccttctagaaaatagaaaatattcctatacaacttcagtagatgagttcagtctaggaatactctgtgccttgcactgatagaaactgggagtatgtaaataatgaaaaccaaagatctttctcccagagagtgtaccaatgtagctgtgtcatccagtgtagtagccaccagtctagtgtgactatttaaacttaaaattaag

SEQ ID NO: 44435 - DNA, 1956 bp, Homo sapiens
actcttcgattgtggcatcaatctaatcttgtttaagttctccctttgccgttgcttcttgggccgtgcttttccgttttgtcttcctcccaccaaatccaaccccagtgtttctccaccttccgcttaagaaggctttattcgtctcccctccgtgtccaagacttgcatctggcattttgctcccagtcgtagccttatgcctcactctttttgcctattttcactccagtttgagtctgttcttctcgaaacttctcaggtttctagattcttactcatgcgagttttccccttgctttggagtggcaacataatatgaagaaaaaacagtaattctgctttcagaaaatctttggagttctcattttgtttcatattaatcctctaaccttgttatttctctggcttttagatttttatttataagatgggtatcactgctgctttgattattccatataaaactgtgtgtgcatccggtgagatatttaattgtagcttatatctgttgtatttctgcattctttgattcatgttttatgcttcctgccctaattttcacacctttgctgtgcttcatttctgtgtaaatgtgtattcttggttatctggctgacttaggttctaatgtaggatgtactttaaaaattaagtactttgaaaactaaagaggctttttttacaggctgacaaaatactcacctttacctttatttttgcattttatactcacaaccatattttttttggcccccttccctttattttaactcataactgatacttaaaggtgctctgccttattaaatcagctcctaggctgcaagtgcataatatttaaaaatttgcaactttgactttttaaaaatctggtcttggtatggagcaactttgccttttttttttttttttttttgagacagagtctcgctttgtcgcccaggctggagtgcagtggtcccatctcagctcactgcaacctcctcctcccgggttcaagagattctcctgcctcagcctcccgagtagctgggattacaggtgcctgccctgacacccgactaatttttttttttttttcttgagacagagtctggctctgttgcccaggctggaggagtgcagtggtgctatctcggcacactgcaacctcctcctcccaggttcaagtgattctcctgtctcagcctcctgagtagctgggattacaggcacacgccaccacacccagctaatttttgtattttttagtagaaacggggtttcgccatgttggccaggctggtctctaactccgacctcaggtgatccgcccgcctcggcctcccaaagtgctgggattatagatgtgagccatcgccccccgctgcaactttgactttgaatattaaacctaaaaaactggcacccaagtcctcttcagaaaataaaggaatacgactcactgtaggctacacaagaaaatcattcacatatggtctcatttagtgtttctgtgatctctggagagtcaacaattccctgatctttgtatagttttctaaagtgtaattaggagaagtgctacactatactaaaaaagtaatctctttctaattaaacctgcttgttgtgtgtattttaaatcaatatttgagtgcttaccatgtgccagcaactatgctgggtgtttggatttggaaatgaaccagacaaaaatctctgcttaccacagaaggtagttgtgattaaatgagttaatattctacgaagaggttagaaaagttcttggaacatagagattaaaatgttagcaattgttatttaagtattagtcacttttctctccttactttccaatactctattacaaccttacatcatcttcaccatcacagttaatagtcagagtccagacaggaacagatggcacacttgacaggataatctgagtttattttataaagatactat

SEQ ID NO: 44436 - DNA, 1041 bp, Homo sapiens
gaattagctaatgaagaaaattagtttaaattgcttttaaaaataaataagtatgagccgggtgcgggggctcatgcctgtaatcccagcactttgggaggctgaggcgggcggatcatctgaggtcaggagttcgagaccagcatggccaacatggtgaaaccccgtctctactaaaaatacaaaaatcagccaggtctggtggcaggcgtctgtaatcccagctactcaggaggttgaggcaggagaatcgcctgaacctgggaggtggaggttgcagtgaactgagatcacgccattgcactccagcctgggtgacaagggcgagacttcatctcaagaataaataaataggccaggcacggtggcttacgcctgtgatcccagcactttgggaggccgaggcgggcggttcacaaggtcaggagatcgagaccatcctggctaacatggtgaaaccccgtcctacgaaaaatagaaaaaaattagccaggtgtggtggcgggcgcctcccagctactggggaggctgaggcaggagaatggcgtgaacccaggaggcagagcttgcagtgagccaagatcactccactgcactccagcctggacgacagagcgagactccgtctcaaacaaacaataaaaataaataaataaataaataaaataattaataaataaataaataaatatgtaatcccagcacattgggaggtcaaggagggtggatcatctgaggtcaggagttcgagaccagcctggcccagatggtgaaaccccgtctgtactaaaaacatgaaattagctggctgtggtgctgcatgcctgtaatcccagctaccaggaggctgaggcgggagaattgcttgaacccgggaggtggaggttggaggtggaggtggcaatgagctgagatcacgccattgcactccatcctgggtgatagagccagactccatctcgaaaaaaaaaaaaaaaagacataaataaataaataaccccaaagcccaaatacgatactgaagtatggagctgagtgaca

SEQ ID NO: 44437 - DNA, 1051 bp, Homo sapiens
gctccagcttaccccgccgccgcgtcgcgtgcacggagcgcttcagaggtttggagggggccggaacctcaaaagcaactggatgagcacaacgcggacgccccggagaagcggcgcaagcgggcccaaaatggttgctgatcagacgagtggcatctctcgcccccctaccgcgggaattgggacctccagactgtgcctgggggatcggcaagtggttcccctctggttttttcggcgctgccttcccggtggtatcctcactctctctctttgaaatgacctctgctttcctatctctaactcttcccagatatttgaaagcaagtttttgtacaaagcaacatatgaatgtattcagccattcgatcgttcggcgaacatttctaggtgtctcgtgctgtgccagatattgttctgagtgcgctgaagatgcacctgttagcaagacaaagtcctggctcccacggagcttattcgaagcaataggggcccccaagcaggtgcctgagaagtagggaggggtggacagtgggaaaacaacctaacggtggagacacacgaggggtctttttttacttttagaaacgggggtgggtggtcaccctatgttgcctaggctggtctcgaactcctgggcccaagcgatcctcccgactcagcctcccaaagtgctggtattacaggacaccatgcccggcagaggggtcgtttttgttgtttttttagtgtcgtcaggagactccctccatcagaattactcaggctgattgttttgagtcctgggacccagttggtatccagaatcttggcttgtttgcctaggaacctgcattttcacatccccatctccacacccctggtgattcttatgcatataataatgtgaaaagcattgcattgaagaattgctaaagggtgtcagaaaacggattaacaaaatcaggaagctttaattttcaagattctattaacctcaaaattcaacatatccaaaaattgaatgtctttttctccagtgttttctaggagagtgccaacactagccacc

SEQ ID NO: 44438 - DNA, 1002 bp, Homo sapiens
ttagtaaatagcaaaacccagcccacattagccatctcttccccagcgcccaggggcagggctctctggcctggcttgtgctggttcccagagtccctgctgtcaggtgctgggagtggaggtgccctcgggttcccttgggagtggtgaccacagctcagggcctgggttggatcctggtggctgccctagggatggtgtctgctccatgcctgcccacaggaactgcaggttacagatatgaggggaagggaggagaggagggggctgaggagggaccgggaccagcaggaagggggactgtggggttgggcctccacaccagggcgaccctgcaggaaggaccttgtcgcagttgcggggatgggcgcctctgtcctggccctgcctggaccatcctaactgtctctgtctcttcctcagcacagaccgaggcctccccagctcctggggggagctgcttgcctccccccgtttttggcaatggtagaactcacactggtgaggtaacaggatccggtggttctagacttgccaactatggggcgaggactcagccggcaccctgtgcacagccagcgagggaagggccggccatgctggacctgctgttctccgcgaggaaggaggggactcaggtcccggactgctgggtagtggcagagggcaggtgcagctggaagtgacactctgtgtttccctgcatccccctgaggtcacaggtcctcaagtcagctgggaagccgttctctggccctcaggggtgctgccaagaggagctggggtccagctctgctccaggctgtggccctggagtctgaatcgaggagtgagggaactgggggatgtttggtttcagggctttggcctggctcctctgggtggtgaaccttctcaccctctcccctgaaaggccctgttcagggtgggctctagggccccgagggagggtctcctaaccttccacaggtcactaagagtggttccttcctgggctgctgg

SEQ ID NO: 44439 - DNA, 1549 bp, Homo sapiens
gcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcaga

SEQ ID NO: 44440 - DNA, 1028 bp, Homo sapiens
ttttttcttgctgctttgtaataacttatttttaaaatccacatttttgtcttcctagtttatcatttgtcttttacactatggaagtgttttccatgtctgttttctttaagggctgtattgttgatatttaattttattttaactggatttgcctttttttacgtgacacaaggatgctttttttaaaaaagttttaaaacattttaagcatgttatgcttttacttattacattaacgttaactttggaatattttgcaggatgtcagagggtgactggtcagagtaggcatgcatgtgtcatttgaccaagcaagaaataaagccagttttcctatgtggacagtattgaatcattttagtgtgcatgtttctaaggtagtaagttatcgtttagaaaagaattagatcaaattagcctagactgaactatcttatttaaatatctcttgtggatactcagggctcttgagcaaggactttaccaaaattacacctggcctcttgcagtcagttctgtgtctcattggacacgggcttggagtgccaaatatttaatttcaaatctttaaaaatatttattctctatgagattattaaaactttttaaatgtttctgttttgtattaacagtatataatttgcactgctgatggagaaatatgagaccaatctattgtgttttcctttttaatgttacagtgggatttgagagcttcccaaagcctctgtcacctaaaattcctactgagaatcatttttggattttaccgcaaagcagatacatagaacagattttaaacgagtagtcctctcttctaatatgaattaatttggtttctagaattgaatcttagcaccttaaaggggcaagaatctcaggggtaggtaagttttagaggaagggagcacagccatgttacccctctgtgattagagccctggagcataccaaaccttgaggcaagtctgaagaaggtggagtttggggggcagtgaaaacagatgctatggataagatctgaa

SEQ ID NO: 44441 - DNA, 1047 bp, Homo sapiens
gtctcccagcctgaccagcacatccagaaatcgatcattatttttgtcattttaacctgccttcttagtgccttccttgcccttgactttgcagcagagaggagaaagaaactcgtggtctctcccataaatacacgtggtaacagcagtgaagtaattattatatattttgtggcaagtcattcattcagtggtgatggaatggcttatttttaatgcagtgtttttctttggactaaacctaaattcttttttctatctcatttagtgcctgtccattccaaggcagcataaagttagcatagcttctcattttactggtttggtaaaagttttaaaggtttagttcagtttgcttttgggttttcatatgaggtagactatgagaactctttaatttatgatgtgatatataattaaagacaatcccattgtagctggcatgtgggctattactggggatcatgggaaagagaaggcttggaggatcttctttataaaatacacgtaagtatggactgaattccaaacaaaccgcaaaatggaaggaacctcgttttatcgcatccaggtaaaggatagaaaaggtatcttcagttttcccagaagcaacatccacaaggacaactcgtaattttaaatgattaaaagtaattgcagtagatcagtgtcattcatagcaaattagttctgattgatggagaatgctgcatctgtggatttttatgttataaaattaatttaagacttcttttgttaaactcgtttaatcttctgcactactccgttctttcattatccttgtcagttttaagggctggaatatctttgtacaactaaattcagttgacttcttctggatacccaagttgaacagacacatatattagtggagctctggttggaaagaggacaccagtacacactattagtagcctactgcatgtggtttgtgttttttgcctttttttttttttaagagaagttctctctctctcaggctggagtggagtggcacaatcatagctcactgcagcctcaaactcc

SEQ ID NO: 44442 - DNA, 1032 bp, Homo sapiens
attattttatttttttgagacagagtctctgttgccagactggagtgcagtggcacgatctcagctcaccacaacctctgcctcccaggctcaagcagttctcctgcctcagcctcccaagtagctgggattataggtgtgtgcctccatgccctgctcatttttgtatttttagtagagacagggttttgccatgtcaggctagtcttgaactcctgacctcaggtgatccacctgcctcggcctcccaaagtgccgggagtacaggtgtgaactactgtgccaggcccaaaagtaggcttttgattaaccctttaggagttaagagagtaatatactatttagctaatatactgctaatttatatacatgcatttgtacattatgtaaatttgtaattttcagttgcaagtaagcaaatatgcactattgccataaaacagcaaagcagtcaagtttgtttattaaggagctattgatatttcatcgatagccttctagcttctaaatattttaaagtgcgtaactgaagttggaatttctctcaaaatcttattttttgttttgactatatttccttgctctcaagatggtatcattatttttccctatttcccttcacttttctctctctgaaactgtttctgcagttggatcatttctgactttgactatctgactttgtaaatctgcttttaaaaatattttgttggggatgggggtgtggtacttagatttcttatctttctgataaacctgtcttaaaatgtttctatgagtcttaatttttctttgaaaattttttactctattatttggaagtctggaggaataatacattcagggaaaagccaagttatagtgatgattttcctatttaagtaacatttacttggtttttgcctatgtttggcttgtgacatagaaactctaaatgaagcataacactagagaagaaaaatttcctctcctaaggctagactgatttagtctgctaggtggtaatgaacatgcttgccatttaaccttact

SEQ ID NO: 44443 - DNA, 1051 bp, Homo sapiens
cttaactgtatgttaatcatttctgttggtcttgagctagcagttttgctaatatggcagggtggctttttctctgagatctatcacctgttagtagtatgatgctgaaaatagctctaccactcttgttgtatcacattgcacacctagatacagtctactttcacctcccttgactttccagggttttcttgcttatttactcatattggtgtgattttcttatggtagggtgtttctttaacagcaatttttttccataaaataattcatttcttttgcttattttcactatgggtttttttaaaaagcagcattccagtttttgttgaaagttttttatcccacttctttcatcctaaatgttgataaagataataaatacaggcagcttataatagctatttgaacgtattatcaaataaggtattttcctgttaactacacttctgtatagtttttaagcagaatttcaatcaagaagacactatttttctatatctctttagattactttttgatttttttaaacactgtttatacaagtttttatcaaacttccaacagataatgggtactgcctctcataaatcttccaaagggacaatggaaactgggcccagttgaataaagccatattcatttgttttggaacgcagagttctctgcatgtagattgcatttagcattctgtctagtgtatccatctgtagttttgcttttttcagaataaaaccttgacagtaattttgaacctgttactttatttctttttgcatgtattgctttaaaaaggccgaagtctagtattctcttcccctttttaagttttatgaaatcaaggttaaattgatattagtgccacttaatatttgacacctgctatgcctaatgaacttgaagtagtaaagggagcagcaggggtcagccattcatattatgcaagataactggagaacgagcagactatgattagagctttagactagtgggttctaacctctttataagagcaaattcattatttatatgtgcatatgtgttacctttt

SEQ ID NO: 44444 - DNA, 1061 bp, Homo sapiens
ttgaaagataacctagaacttattattttttaagagacagggtgtcactctattgccgaggctggagtacagatgccagcatagctacctgtagccttgaactcctgggctcaagggatcctcccatttcagccttctcagtagcttggataacaggtgtgtaacactgtgctcagctagttttgttttgttttttaaataatagagatggcgtcttgctttgttgcgtaggctagtctcaaactcctgggctcaagcagtcctcctgccttggcttcccaaagtgctgggattacagacgtgagccaccacatgcagccatagttttaaaatttttgtagatatggcgtcttgctgtgttgcccaggctggtctcaaactcctggcctcaagtggttctcccacctgggtctcctaaagtgttgggattacaggcatgagccactatgcctggccgagaatttcagtctttatgtgaaatatatcctacaattacagacactcttaggatgttccttttcttgtctgaattcctatccctcaggagcctggaataaagctatattgagagttttctgtgtcttattgagaattttcacatagtcttattaaccgtcgttgcattctgctggttgatctattttagcacaactgttgaaataaatactgttcatttaatgccacatccttatctgaaaatcagttcaaggataagcacagctgagtcatttaagcttatatgagtacagtttttgaactttgtggattgtgctttaaactagtgtttagattctctgtaggtgcaaggcttctttcctcccttgctctcacacattctgtgcccttggctgcactaggttgcatatgcattattgaggttaatgggaagccaaatgcagagcagggagccacagtgagtagcagctctacgactcaatagcagtccgaccttggacggggttgcagcccgacagtgtattcattttttataatggaaacaatacttgcatgatagggttgttgagaggattaaacgatgtaacatatgtaagacactaaca

SEQ ID NO: 44445 - DNA, 1827 bp, Homo sapiens
ttgttgccaggccggagtgcagtggcacgatctcggctcactgcaacttccacctcccaggttcaagcaattctcctgccagtagctgggactacaggcacctgccaccatgcccagctgtgtttttttttttttttttggagacggaatcttgctgtgtcgcccaggctgaagtgcagtggtgtgatctcggctcactgcaagctccgcctcccaggttcacgccattctcctgcctcagcctccagagtagctgggactacaggcgcccgccaccactcctggctaattttttgtatttttggtagagatggggtttcaccgtgttagccaggatggtcttgatctcttaacctcttgatcccccttcttggcctcccaaagtgctggaattacaggtgtgagccaccgctcccagccgcaaatggaacttttgcaggtggtttggccattagccgtgtacatgcttagagtgtgtttaggctagtggacaggatgttctctgtgtgtactgtgtaaccttgaggctttgcgtctatttctatttccctagaaatgaaatctaaaacaggctgctttccttccccctagctttccaaacaaaagtaaggcttgtagatgtgaactagactgttgcaaagttctggagaggatggctgtggtttgggatttgatttttggtaggcttttttttttttttttaattgttagaacttgagtgtgataaatggcttctttttttttttttaagtgggaagaaaatacaagatcattaaccacttgtgcatattctatttcaaatggcttagaaatttaaagcaaacttgttaaagtttgtagaagctgagttgttgatttctgtggtggataaaagccagtgctgtatctggaaactgttttcctgtttttcttagataccccttgaatcggatctgtttaatggaagaggatttttctgttaagctggttataatgccggttaaactttgtgtttaggatgttaaagtcctggaatgaatataattacctgcctatataaaaaaagctgaagtcatttgacgaaaagttaacaagtgcaggcatgtgagctatttgaaaatttaaaatgcatctgagagagctttctaagattcagagggttttatggattttttctggctttttaataattgaactttatatgaaatgtacattttagctagatggacttacgaggcagatagaggtcaaggaatttttaaattatagattgtctttgcattgcctttggtctgtttctgtattctgaactgatgattgaaagaacgatctgtggtactcaacatttttatggattttgagatacaaagggagctcaaaagcaactgcatgctggggatggtaggagttctcttgaaagacaggcagagttaggagggtctgggccacttagcccgtttgcttttgctttggccacaggtacgggcaggctgttttacaaggagttaaagttctgcttctaaacagatgcctttctgtttcagtgtttcttcctagtgctctgaaaaccatatgtggggaaaatagttcgttctgtttagaggttaagggtgttgcctgcctgaaagtaccagtagtagtatttagtatttatttatttttttgagacagagtctcgctctgtcacccaggctggagtgcagtggcgcaatctcggctcactgcaaactccgcctcccaggttcatgccattctcctgcctcagcctcccaagtagctgggactacaggtgcccgccaccacacccggctaattttttgtatttttagtggacggggttccactgtg

SEQ ID NO: 44446 - DNA, 1032 bp, Homo sapiens
tttttttttttttactttgtttttgtttttgagacaaggtcttgctcagttacccaggcttgagtgcagtgacacaatcatagctcactgcagcctcgacctctcgggctcaagtgatccttctacctcagccacctcagtagctggtactataggcgtatactaccacacctggctaaattttgtatttttttgtagagatggggtttcaccatgttgcccaggctgatttcaaactcccgggctcaagtgatctacctgcctcaacctcccaaagtgctgggatcacaggcaagaaccacagtgcacagccttctttcttttctttcttacatgttaaacatatacatagagaaagggtctacattgtataggctggttgtgagctcctggcctcaagcatccagcccatgctccttagttttcagtgggacaacaaatggtcttcacaggtgttttttattgtcaaatatgaataggtatagctttgtacaggttggtaattttaagaatttggattttggggccgggcacttgagcctgaccaacatggcaaaaccctgtctctattttaataaaaatacaaaaattagctgggtgtggtggcacatgcctgtaatcccagctactcaggaggttgagcatgagaatcatttgaacccaggaggcagaggttgcagtgagtcttgattgtgttgctgcactccatcctgggtgacagagcaagactgtctcaaaaaaaaaaaaaaaagaatttggattttttggacaatgtctttcatgaggatactttcagtctttatctcttactcttgctacattgtatgtagcaagtatggatatagttaaaagaacttcctttagaaagctggagtgcctcctgttaatcaactgtatgtgcgtgcatgtatatataaaggtgatgatatgagagattgctttggacttcttgcagcttttggcattcctgggctgccagtccctttttaataggagcatttgtcttgctttaagacatgaaagtttgaggcc

SEQ ID NO: 44447 - DNA, 1044 bp, Homo sapiens
cttgaactcctgacctcgtgatccacccaccttggcctcccaaagtgctgggattataggcgtgaaccaccgtgcctggccatttgtgaatatcttatgtctttcgggttctgctttgctgggggactgggcttatgtgataaaattacttaccttgagcattaaaggaaaacaaaaagttaaacttttttttttttattcatagtttagcttgtaccctcaacctttaactcagaggacctgatttgggagttcagcggtggttgaaggttggtagaggagaggcagagtgttgggaggaaaggagactgcctggaggaccgtccagggctttcgtccttggctctgtgcggctcagagaccttggggctttcacttccttcttgggttatctgtgtccttatctatcaaataaggagttggtttagatgattttaagtctctccaacttgaatattctgattttatatgtagacattatacatgcaactcttattttctgtgtgtgtgtgtgtgtgtgtgtgtgtgtgtgaatgtaaaaggccttcacaaccatatgtatacctggtattgccttctagggaatacagaattgaagatagagttatgacataaaatctcattttgaatcttattctctttgcagagaaatatgcacagtaaaactagataaattctgcaatttattaccttcttggtatgaatttttactagggcttttttagaagttcaaagtagaaaaccttttaacaccttcatttggaattttaaaatgtggcagtgaaatatttcacattcagaaacctgtgttaatgttaactaggaaaagtctcagtcttacgccattagtaatgatgtgttgttatcctttcatttctagaaatggatccctggaattagatggagtattgtgaaagtataattttaaacaaatgtttttgtagagacagggtctcactatattgcccaggctgatctctaactcccaggctcaagtgatcctattactttggcctcctgaagtgctaggattgcaagtgtgaa

SEQ ID NO: 44448 - DNA, 1050 bp, Homo sapiens
cttggctcaccgcaacctctgcctcctggattcaagtgattctcctgcctcggccccccaagtagctgggattaccggcatgtgccaccacgccagctaattttgtatttttagtagagacggggtttctccatgttgttcaggctggtctcaaactcccgacctcaggtgatccgcctgcctcggcctcccaaagtgctgggattacaggcgtgagccaccgtgcctggcccctaaatgttactcttatcaggcacttaattgactctgggcaattgacagtgcactcattgttggaatattctattcataaagcagttatctttatttcaagcaagaaaactagatttcaatgctagaattcaagtcttttaaaacaaagtgtaaaactcatatttgtgtatcttttttaatatgcagagccttttttctgtttaaccatattgttgattttctcctctttatatatgtatatatatatttagttttaattgacatatttatggcatacagtgatacttctatagatgtattcaatgtgtaatgatcaaattgggcatatctgtcaccttatttatcacttctttgtgttgggaacatccaaaatccactcttctagttatttgaaaagacaaaatatttgtttttatttatttatttatttttgagacggagtctcgctttgtcgcgcaggctggagtgcattggtgcaatctcggctcactgcaacctccacctcccgagttcaagcaattcttctgcctcaggcttctgagtagctgggattacaggtgtgtgccaccacacccggctaatttttgtatttttagtagagacgaggtttcaccatgttggcgaggctggtcttgaactcctgacctcaaatgatccacctgccttggcctcccaaagtgctgggattacaggcatgagccaccgtgcctggccataagttgtgtttgttttttgtttttatttttgtttttttgagacagagacttgctctgtcgccaggctggagttgaagcacttctcctgcctcagcctccc

SEQ ID NO: 44449 - DNA, 2077 bp, Homo sapiens
ggagtgcagtggtgtgatgtcagctcactatgaccctcgcctctcgggttcaagcgattctcctgcctcagcctcctgagtagctgggattcaggcatgcactaccacgcccagcaaatttttgtatttttagtagatacagggtttcaccatgttggtcttgaactcctgacctcgtgatctgcccacctcagcctcccataatggtgggattacagatgtgagccaccatgcccagccttaaatttatttttaaaagttatatatttatctatatatatttctgcttctatgtatacctctatatatacatatgtttatttttacctttcacctctattttgtggtgcatatatatatatacacacacacacacacatatacacacacatatatatacacacacatatatacacatatatatacacacacacacatatatatatatatacacatatatatacacacacacatatatatactttttgtagaaatggggtcttgtcctgtctgtttttgaactcctgacctcaagtgatctggctaccttggcctcccaaagtgctgggattacagggtgagccaccctgactgttttttaaaatttttattttatttttttatatatattttccacttcagaattttctaagcagttgaaattactcctttaaatgagaaaaccttgatgatttttggtgtatgtgtttttatttcagcttttttttttttttttttttttttaaagacggagtcttgctctgtcgcccaggctggagtgcagtggcatgatcttggctcattgcaacctctacctcccaggttcaagcgattctcctgcctcagtctcctgagtagctgggattacaggtgcccacgaccatgcccgactaatttttgtagttttagtagagacagggtttcaccatattggccaggctggtcttgaactcctgacctcaggtgatccacccgccttggcctcccaaagtgctgagattataggtgtgagccaccactcctggcctcagctcatgtttttgttgttcttttttgtttttaaagcaaggtcggtctgtgttgcctaggctggagtgcagtggtgctttctcggctcactgcaacctccacctcccaggctcaagcggtcctcctgcctcagcctcctgagtagctaggagtacagtcgtgtgctataatgcccggataatttttgtaattttagtagagatagggtttcaccatgttgcccagggtggtctcaaactcctgagctcaagtgatctgcccaccttggcctcgcaaagtgctgggattacaggcatgagtgactgtgcctggcttgtcattgctctataatgtacttttcattctaatacatttcacgtttatccttgcagcatttttgctttgagatgttatggcccactttttgtgggttaaaaatctggaccacacaggtcagttaaaggtgctgagatcagagtaagtccttatcacagtggatctggggctaactatggtttcctaagcttttgtcccttatagctttgcctgtgtagtagatgctcagcaaacacctgttaaacggattagaataaattatatactactgggttttcaccaagtccttaggtcatttttagactaaactttggcacctgcaattgaaacgatatggaaatcttgcaggaaagtgttgaatcttcctccaatgatggggaattcaattcttttctgtgtggatgtcatttgcctttttatgtagtgttcattttcccacatgtaacgtgtgtttgttttcttaaatggtcctaaatgctaataccttataggttattcaatgccgttttcagatggttgagattgtttgattcctggtgtttaagataaaaggaaattaaggttgtgcattggggaaagaaacagctgaaacttgctttacttcatttgtaaaatagaataccttaaactcatccaaattatggagctttttagtaccctgttttataagttgcaaagtgtttccagttcctccttacaaatttagaagttctaaaaggggttttccttaata

SEQ ID NO: 44450 - DNA, 1048 bp, Homo sapiens
agtgcattgtagaaacttttgaaaacacagtagtctgttgagaggctgttgttgcattagtgattctcaattgggtatcacattggagaagaattaagcttttgggggcccaggtactatggttattgtaatttcttctctgtacctcaccagatgcttggggaaggtgtctggttgtttataggctggtgctcaagggggtatctgcccatgaccagtagaacccaaatcctcaagagcctggggaagccctacatggcagccatatgcttaagagggaaggaggatcctttttgcctctccctgctttgtaggtatctaggacgttatgtaggcagtgtgaatagttgctgctgatcttctgacctgtccctgcagagaagtcagagagaggagtaggtagcccttgtgaagggagaggcttggctggactttgccattctctggaagactttgccattctctagaagataggcatggttggcgggtctgtcagtggactcaaaaaaggcacctgttctgtagcacttggaggatccatatttaggatatcaattaattgagaatgtaatctttgtctttggttcaatctcctggtttctaacttttaaaccatttttagggaagcattatatgtgaaggtaggagatactccctacatacaaaatcatgttattaatgttgtgaattatgcatttcctttttagtattaggcaactttttttcatatatcaagttatcatgtacacttttcaaggttttttggattataaaatcttagttgaggtaatataaatagaaaactagatacagagtgcgtgtctggtttgtgttacctcagaagcaattgggctgtcacttagcctagcaaaaagtaaatttagttgttttgtccaaagggtgccagtataactttggtaatctggattttgcttttctttctttctttctttctttttttttttgagatggagtctcatgttgtcgcccagtctggagtgcagtggctccatctcggctcactgcaatctccgcctctcaggttcaa

SEQ ID NO: 44451 - DNA, 1005 bp, Homo sapiens
ctgtaatcccagcactttgggaggccaaggcgggcagatcacctgaggtcaggagttcgggacaagcctggccaacatggcaaaaccccgtatgtacttgtactaaaaatataaaaaattagccaggcgtgatggtgcgggcttgtagtcccagctacttgggaggctgagtcacgagaatagcttgaacccatgaggcggaggttgtggtgagcctaaattacaccattgcactccagcctggacgacagagcaagactcttatctcaaaaaaaaaaaatcctcatatgtttgggtacttgctttgtgccagcattgtgctgggagtttagtagtgaaaaattcagtatgggtggtcatggtgcttatgcaattagttaaaacttttttagtcggaaaggacaggctgtgttaggtcattgctgtgtgtagtgcctttttgagtaacttgtatttacttagagtggacttttcaaggaatagaaaggttaaaatgaattttgtgtgctaggatgtatatggggatctgtacacctgtttaaaaaaatttcaaaactaaaatattaaaatatgtagccatttgtctttgacttaactttggtattttgctgttaatcagtagttactctatccctaagttagtagtctttgttactctttaatttgtgttcaaagggtagacagttccctaaatcttttaactagttctagtgtcaattgggaacctgtggtttgcctctttatttccagtggactctgttttagtgagatgatgagatgaaagttggcacagctttatggtcttcaagctaaaagttaaagatttggcaactctcagtgttctgaatttgtcttccctgcctagattttggtgacaaatataacatactggtacttattttggttaggcaggaacctacatgagtaagcattcacagcttcagaacatctgattcctgcagtgcagttctagtaaattacacgcaagcctaaaaattcagcttt

SEQ ID NO: 44452 - DNA, 1178 bp, Homo sapiens
atgagatagacaataaaaaagataaagtactttgggccaggcacgatggctaacacctgtgatctcaacacttggggagtccagcgttggtggattgcttgaacccaggagtttgagaccagcctaggcaatatagtgagaccttgtctctactaaatagaaaaaaagaaaaaaagtgaaccaggtgtggtggcatgtgcctgtagtcccagctgcttaggaggctgaggtgggaggaggattgcttgagcccattcgattgaggctgcagtgagtggtgattgtgccgctatactccagcgtgggtgacagagcaagacactgtctcaaaaaacaaaaagagaagaagaaaaaaagtacattggacagtggttagtgctaaggaggaaaaaagcacaggagggtaatgttattaatgtttagagaggaggggtgaaatttgaggtagggtcgtcaggggagacgtcattgacttgtatgaagacctgaaggtagtgaggaaccagctgtatgaacacatgagaagagcattttaagttcttttggaaactcacttttagaataatcagtgttctctgtgttttatgttaacagaggctagtattactagcttgaaacaagctgccctggttaaagcgcctctcattccgactttgaacacaatcgttcagtatctagaccttactccaaatcaggaatacttgtttgaaaggatcaaaggtaattattgatttgaagagaaaaaaataagagcttttttactatgctggaattttatcagtgaagattaacaaggaaaaacttttaattaaaagtataacatgtcttataaatacgtattaattatagcttaataactttattttgtgtaggaaacttaaatatgagctaaatgggctccagtgactatttcactcatttcctacttttagactcataagaatgggtgccattatgacattctttatagttccggtgtgctgagccttatttctcttaatttttataattcctatttaataagtttcttccttatatttctgtgatattcttattatttggtggaagatgtgctctcctgaggagactgacttgagaatcaggaaatgtaggctccctgacacccccatacaccctctgtgcctctctacttacagagcaattcataacgttagaat

SEQ ID NO: 44453 - DNA, 1018 bp, Homo sapiens
aggtacagtatgaatggtacatatataaggataaacatgactgttactatatggtatttattttcatgagatttttttcttcctccatatttagtgaattgttatgttttgagaagataaaggaataatatgtttagttattgagatcctcccttttcagttctcagttttattttccaaagagcttttctattggagccttttatttacctagaattgtgaggggaaacaaaaatgaggtccttgccctcagaaaacttaaagagttagagagataagacaacatatgcttgaagctatttcaaagtagattatgatttctgtttttctagagaagaaccctctaatcttgggccaacttttccatatacagagtgagtgagttccctatttccaactccacgtcttcctcccaccttctctagtacctgtgtgttctgggttctgttaggcatatggacttccccttccactatacggagctccacttagctctgaaggggctactacttctgttgtttcatccttcaacattcatccatccactctgcatcttctagaactattttgaaatcacttgtgctcattttttatccttttactcttatttaaatagggcatcaaaatagaggggcaaaaaatggtagcctactttattgaaacagaaacctggatggcattttatggataattcctgaacccaatcctagacttactcaattagaatttataagggtggggcctagacctctctctgggacacgttaggtaattttgttacagccaaagagtacagctgtactcttttgtaccatttgtcacagctggcaaattaagatgcatgtagtaaatgttggaaggatgaatgagtcaaatcatctcctgaaactggagtttgttgtagtttctgttataggctagtctaaaaatgctaacatgtttaaaatatgaagtcttagtcagacagagtattagctacttagaagaaatacaaatacatttcctcatctgaagtccc

SEQ ID NO: 44454 - DNA, 1029 bp, Homo sapiens
ccgggttgaagggattctcctgccttagcctcctgagcagctatgattataggggcccaccagcatgcccagctaatttttttatttttagtagagacggggtttcaccatgttggccaggctggtctccaactcttgacctcgagtgatccgcccacctcagcctcccaaagtgctgggattacaggcatgagccacctcgccctacccatttttgttttaaaaaataaaaatagatgtacccagaattcaggtcaaagttaggagagtacaacaaggaggatacagaaaaaatgataggtgtatggtacaacatggatgagtcctgaaaacactatgctaatgaaagaaaccagtcacaaaagaccacatattatatgattctagttacatgaaatgttcagaatgggcaaatctataaagacaggaagattagtggttatctaaagttggggtgggaaggaaggagaaaaggggattgattttagtggaagaacaagaatgttctgaaattgattgtgatggctgtataatcctgtgaatatactaaaacattgagttgtgcactttacatgagtgaattgtgtggtatgtgaatttatatctcaataaagctatttttaaaatgataaaagcaaatgttaatgaactgttatctaagagcttttttctgtgtgcatgggaaatcccataaaatagacaaatctgtcaaatcagcagagcaaataagacatagacttaaggagaaattgaaatggaagatttagaaaaggatacagagaagtgtaaaccaaaatgaatatttttacattttatggtaagagcagagaatagctattaccataatgtttcatgtgtctgtgttgttactgatctttttaagttattctgtctgctgaaaacactcttaatatcatcctttgtttaatgatgataaaacataccatttttaagtgcatagttcagtagcattaaatgcattcaaattgtgcagctgtcaccatcatccgtctctagaacttatcatct

SEQ ID NO: 44455 - DNA, 1067 bp, Homo sapiens
ttcaatctaattatttcttcatttgtaaatattagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagaggtactcgaagctgattcatattttcactgcattttgcctttatattaatctagacgccaatttcagggatcttttttttttcttgccttagaaacagaactggcaggagtaaagtctcacattttaatcccagccttctactttatctttatataaatgctacctcctgaatctttttcactgcattcttactgagttaatgtgagaatatattaataggagagtttaattttcatttctcgttccattcttctccctcctacatataagtttgttatgaggaattagctttacaaatactatcttttgattcagagagtatgatttttcccccttttccgactgctgaagcttataataccctgtccggaagtgacagtgccacacatagtgctctgatactgagtaggtgcaaaggaaaaagcagtacttggtgtttattctaaagctgaatgtggctgttccttctttttattttatttttctgctccttcttctaaggcatgggcctccttattccaaggattacatggactttagtccgtgtagtactttctaactaatattaactgttgattatagggcagtactgattttcagcagatgtccatccctttgactgataaaatagttctggagaaattagttctaccagagaaagaattgctatcatcatcccaccattattattattcttttagctttatattattatagttacttttgcgagaggactctaaaattgcactcaagaagagataggccaacaggacttccactgaggatgcagtttcttatcaaacagatgttcttctcctttggttcaacaaaatatgcactatatagcatagagttatagtgtttattggatttaaatgcagaatttg

SEQ ID NO: 44456 - DNA, 1025 bp, Homo sapiens
  misc_feature (1)..(342): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcaactttaatgttttctcctattccttttctccttgttacctatcttgccctaaagatgtacgctaccttatcttcagcctcccttcttttagctgctgtccatatttcattcagatggactctgtctcctcctgaatggcacttcctagccaaattctctctagtgtctgtctctcatctgtagaaaatcttcacatgacagagtaacttctaagagtaactttaataccgcacttacatgatattcatttgtttctcccctttggtgatttgccctcccttaattatatagagtaaaatttcatctaccatctgtacctggaaacaaagaagtttcacccttgagatgggtttccaacatgatctccagccactcctcttccaatattagtcatccattctacaaactactcaaagatctatcctggtgtctttaagtgctgccctattagggctcatcttaatccatctccttctaatccttctcattaaacttctcacaaaagcttcgcattacttttcaagcacttgttcttcttccattgtatctactgcttttcaaagtctgcaattaagagccaacatttgactgaataaacccacattttttaagggtttacaagatttcccattctgggaaacactttcctcattttacctgtccatgccactccaccta

SEQ ID NO: 44457 - DNA, 1047 bp, Homo sapiens
cttgtcattgtctgtcttttttattatacccaccccagtaggtgtaaagaggttgtgtgaatctagttgtggttttgatttgcattaccctagtgatcagtgatgttgaacatcttttcatgtgtttattgccaatctccatatcttctttggagagatgcctatttaaaatctttgcccatttaaaaaattaggttgtcttttattgttgaattgtattagttctttgtatatgttggatactaaacccttatcagatacataatttataaatgtttcctccaattctttgggtcatctcttcactttcttgatatagtgttctttcaaacacagaagttttacattttgataaagtctaatttttctgtgttttgtttgcttgtgcttttggtattacccctaagaaaccattgcctaattcaaggtcacaaagatttacacctgttttcttcaaagagtttattatagttttacattttacatttgggtctttgatccattttgagatcatttttgtgtatgctgtgggatagagattcaacttaattctttgcatgtggctatccagttgtctcagcaccgtttcatgaaaaacgatttgttctccattgaattgtcttggtgtgcttgtcaaagaattgtgattttaatttctaatttcctaattactaatgagtttgacaacttttttctgtgtttactatccatttggatatcctttctattgaaatatttgtttgagttttacccagtttttaacttggttttctgctttgttcccattgattttctaggagttctttatgtcttctaaatgtgagtccgatgttgattgtatgtgttgcaagtagcttttcccatactctagcttgtctcttccctttcttggtgtcttttgatgaacagagctccgtaagtgtaaggtagtcacatttatcagtcttttactttagaaataatgtgtttggtgtcttgcataagaaacattttcttaccccaaattcacaaatatatcctctgtactattttccataagcattatag

SEQ ID NO: 44458 - DNA, 1031 bp, Homo sapiens
tctttctctttcttttctctttctttcttttctttctctctctctttctttttctttctctttctctttctttctctctctctctctctctctttcttttttttatttattttaaagtcttgctctgctgcccaggctggagtacagtggcacagtctcagctcactacaacctccgcttcctgggttcaagccattcatatgcctcagcctcttgagtagctggaactataggcatcccagcactttgggaggctgaggtgggtggatcatttaagatcagatttcttataagtctcttcaaaactaggcttcctccatcatgctcctcaaaattcttccaagcttccacccagtgcctaattccagtcagttctacaatttgaggtatttgtcgcagtaacacttcacttacaggtaccaaaatctgttagttttttttattgttgccataacaaattaccattaaatgtaatggcttacaacaagatccatttattatctcagatctgtagattagaagtctgacacaggcctcatggggctaaagtgaagatgttggtggagtgctgttgcttactggaggctttgaggaagaatccacttccaatctcatttaagtcgttggccaaattcatttccttgagactgtaggttgtaggtctctgtttccttgctggctttcagctggaggttagtctgtgcctctagaggttgcctgtattccttctcatgctttcaatgagcaactaaaggcctctctttgagtcccttgcatgttgattcatacgtgtcagagccagcaatagtgtgttgagctgcactttgaatctctctgatttgcctttctgccacatttcttctgcctcctctttcagcacatctgctttaaagtgctcatgtgattagattgcacctacctgggtaatttaggtgacaatcttaattatatcagcacagttcctttgccatgttgtaacgtaacatattcatcagttctaggaatgaagacatagacatctttggggagcc

SEQ ID NO: 44459 - DNA, 1129 bp, Homo sapiens
ttctaatgataagtattagttacatcagtgtctactgcacctttataagcagtgtctagcaaacaatcaaaaaatacagaggcagtgacatgtaacccataaacaagagggaaaaaaatagtcagtagaagctgacttacagatgacccacatatagaaattaggaggcagtgactttagaaattactaggcagtgacttttaaacaacttctctaaagtgaacaccaaaggagttttgtaaagtgaacttttgtaacttttgtaaattacatctttccactaaagagtggaaaagatggacaaaatgtgtaaatgggtaaggaattcaatagataaatagaaactagaaaaaaaatcttgaaccaaaaaatacaatatcaaaaataaaaatttatttgaagcacttaatagcagattggacacagtggaaaaaagattagagaacttaaagacaagtcaatagaaattgtccaaactgaagcatagggagaaaaataagaaaagaaaataaaagaatagaacatctgaagcctagggaatatatcaaaaagtctaatacttgtgtaatgagtctcagaaggaaaggaaacagaatggaatagaataaatctttgaagagataatggatatgttagtccattttcatgctgctgataaagacatacccgagactgggcaatttacaaaaggaagaagtttaatggacttacaattccacgtggctggggaagcctcacaatcatggtggaaggcaaggaggaacaagtcacgtcttgaatggatggcagcaggcaaagagagagagcgcttgtgcagggaaactcccatttttaaaaccatcagatctcatgagacttactgtcatgagaacagcatgggaaacacttgcccccatgattcaattacctcccacttggtccctcccataacacatggaaattcaagatgagatttgggtggggacacaggcaaaccatatcaatggatgagaattttccaaaatgaatgaaaggggctgggtgcggtggctcatggctgtaatcctagcactttgggaggctgaggcaggtgaatcgcttgagctcaggagttcaagacaagcctgggcaacatgacaaaaccccatct

SEQ ID NO: 44460 - DNA, 1048 bp, Homo sapiens
tcatgaggtcaggagatcgagaccgtcctggctaacacggtgaaaccctgtctctactaaaaatacaaaaaattagctgggcgtggtggcaggcatctgtagtcccagctactcaggaggctgaggcaggagaattgcttgaacccgggaggcggaggttgtggtgagccgagatcatgccactgcactccagcctgggcgaccgagtgagacttcgtctcgaaaaaaaaaaaaaaaaatcttaatgaggtacagcatacccactagaatggttacaacaaaaaagcttgacaatacccaaataaaaaagcctattccaatatcgaacatttggaacaattgaaactcccatacactgtagataggaatgtagaatgatacaaccaccgtagaaaagttttggcagtttcttataaagttaattatatacctgccctgtgaccagtaataccccttctaggtatttactcaaggaaaatgaatacatatatggccacaaaaaagactgtacaagaatgtcataacagccttatgagggttcttcaaaaagtttgtgggaaatgtgtgttatgaaaaaatatccatggagtttgtattagtccattttcatactgctataaagatactacctgaggccaggcacagtgcctcacacctgtaatcccagcactatgggtggctgaggtggggcggatcactttaggtcaggagtttgagaccagcctggccaacatggggaaaccccatataaaaatacaaaaattagcttgatgtggtggcacacgcctgtagtctcagctactcaggaagctgtgacaggagagtcgcttgaacctgggaggcagagattgcagtgagccaggatctcaccactgcactccagcctgggtgacagagcgagattccatcttaaaaataaataaataaataaatatatatatacacatatatatatatacatatatatatacacatatatatatgcatatatatatatacgtatatatatatacacacacaaacacacactatccgagactgggtaatt

SEQ ID NO: 44461 - DNA, 1053 bp, Homo sapiens
ggagttttagaccagcctggtcaacatagtgaaaccctgtctctactaaaaatacaaaaaattagctgggtgtgctggcaggcacctgtaatcccagctacttgggaggctgaggtgggagaatcacttgaacccaggagggggagattgcagtgagctgagatcgtgccactgcactccagcccaggtaacagtgcaagactccgtgtcaaaaaaaaaaaaatcaggttgtcatcttactgagttataagtttctttatgtattctggatagaagtcctttatcagacagatgttttgtaaatatttcctcccagtctgtggcttgccttttcatttactggactattattttttttttaagtgtagttttacatgcggtaaaattcatcctttttagggtatcattctatgagctttgacaaacacatatagtggtgttatcaccaccacaattgaggtttagaacatttccatctcctcaaaaagttcccccgtgtctctttatcatctgtttctccttgcctccctcagcccctggcaatctatctcctttctgtccttataaatttgccttttccaggaagtcatatgaatgatatcatactgtatgaagccttttttgagtttcttttcagttacttagcataatgcatgtgagattcatccatattattgtttgtatcagtagtttatttttattttgtcatcgtattccattgaatggatgtacctctgtttatctgtttgccagttgaaggatatttggcttgttaccagtttttggtgattataaacaacattgctataaacattcatgttttgatttttggatgaacatacatttttatttcttttggataaatgcctgggagtgggattgctgggccatatgtaggtatggtatgtttaactttgtaagaaactaccaacccatttttctaaaatatttgtaatcattcccgccatcactgtatgagagcagcagtttgctctgcattctggccagcactttgtattgtcgtttttatttttgtttttaattttagctatt

SEQ ID NO: 44462 - DNA, 1028 bp, Homo sapiens
catggctcctcattttccaggttccagctcatgtctcaggaggccgctaagcccactcctctgccccagcctgtgtctgcgcacgtctcttctcccttcctcctggtttcctctggctgatacctgctcacctgaaagtcatctcaggtgccacctcctccagggattcctcgcattagattagcttccttcttccccattcctagctgacttccttcattatgcctcagatcctttttttggaagaaaaagaaagaaatggaagacagactggccagcagggggagagagagggagggagggcatatcagagaattcaatatgctgcgttttaaccagatacttttcttcctctcccacaaggcatcagagtagagactgcctttcatctctctcccccttgtgtaatagcacagtgtctggcagataactgttgcttgctaattattagaaggaagaaagggagggagaataaaagccagcatcaccatgtgatcttcctaagtgcgacagatgtgagaaaagaactaccttaagctccaggggccctagaggaacggcgctgcgtgctagtgcagatggtagcaaacgctctcacctggcttggcaacacttcttcacctcttctttctaccaccacagcgactgtctccctccagcccatcctactgccaaattcatcttctattaagcatagcttcaatcacatcatttctttatcaaaacacttctacagaggagttccaaatgctttagccgggccgtccagggcctccacaggatgaccccagcccatctagttttctaccactctttatgtgtttcctaagtaccattcattattttaggacttggtatttgctgatgaatttacttacttacttgagagtgtggcaaaagcacatcctaaactttcagttaaaaggagtttgattgattgacctgctctgagtttaaggcacgtgctggtcactgtgggagccattaaagaaggtattgttctgtggccgccaggaacagatagccca

SEQ ID NO: 44463 - DNA, 1033 bp, Homo sapiens
gtggagttttttcaaggtcacgagttaagcaatagagtagaatatctttgcagctgcaagaggaggtgcgagcagcttgttcacaaggtatattttgcaggagtttccccttacaagatcttatttgcttgagagtagcgttaaggatttctgtgccaacagttagctggatctctggggttgaatcgttatcaccaatctatagttaaaataagcattaaaaaaaaaaaggagtctactttcaaagttttcccgaagtgccagtctgaagcagctacctttaaaagctgttcttgaataataggttgctatatcctagtctgtaatcttggactaatgtctgaggaaggaaaaaaaaaaaaagaatattctctctttgtccgattaagaagtggaggtagacagcgattcgacatgttgtatgggcgaggctgtgctgagcttgcgtctgggacaatgaccagacagatgaaaggagaagtgagagatatttttagcacatcaggactgctttgaaacattgattttttttccatctcctcccaccccccataattccagcaggaagattcagtggcaggcactttaattcagtgtaaaaacatcttctatattacacactaaaatattcatgaggaaagggagttgctgattttaaggcgtagctttaaaacccacgtctgtcggcttgatggtcagtgtcccgccacacagtctggaagtgtgacgtggccaaggaggacccccagaaggatcctgtgtcttccgtggggactactcctttcctcagaggagcgggttcacaggaaactggagcagaaggatgcctttagccccactcctgttggtcctcagtcccttctcctttgatcaggtggttcaagcacgccttgaagttccggtgttcaaacaacgtgacctctgcaattacgttctaatacttgtcggtgcccaacttaaaccactagcaatgttagttaaaaacatcagggaggccgggcgcgtggctcatgcctgtagtcccagcactttg

SEQ ID NO: 44464 - DNA, 1538 bp, Homo sapiens
tgatcctcccggcaactctgcaaaatagatttctgcagccctgttgtactgaccaggaaacatcagcctgccctgatggcagggatgtggttagcaggtggaaagccaggactcaggctcaggtcttcgaacccagattttatgccctatgtaccgccatgtggatattctcaaggcaactctctgaaatatttccagaatctttcacaaaagtcctgtgtcgtccttgtcctggccaactagactcagagggaggactgatggattttcatctccctcttccccttcgtcttttcttctcagcatcttcctaccctccccaccaccgcgcttctccaccaaaagtctgatgctggcatgtaatggaccctttccaagtttcaaggtgttgacagtaaatcttttgtatttagaccgggccggctgctttccttttcttgtgggtagaactctggaaaagtggaggggggtgggtggggcttcaggtaaagtacgtcagcaaattggataagtcggatcttcgttgtgtgagtgggtaagagatgaactggggggaggggtgtgtgtttgggcagtgagcaagccggcaagagaatgtgagtgggcggccagttggttggcaagtgagaggctgtggagaggttgctgctgggacgggctgtgcaattaaacagttgagcagatcttaatagcagactggggcggtgctctccgcaggcctgcggggagcagggagcaggggaagcaagcgagctggaagcatcttcgggcacagagctagatacgaatttcagaagcacataacctgaggaatagaatgcaaccagaggagggagaaatagagattccaggcagcgtttcctaaacttaaaaagttttgaatacccagttttgccttgttctggggacctctggcaatgttgttcaagggaggaatttttaatttcatagaaaagtgaattttaccaccacaagagaacatgagaccaaggtcataaatccctttgtttggagtgtccgttctgaactccttgtatacttttatttgcaggaagaggctataccagcaagtattatggttttactgggtggggcggcaaggccaggaagagatggagatgctgttaaaggtccttgctccagaacattcagagatcagaggaactcaagaggtcaaagtaggctgatgtcattgttcatccatttattcagcaaaactttcttgaacacctactgtgtgccaggcactggttggcagtgaggtgaagacgatagtgatgaaaacaaaggcatggtctctgtcatcatggaacctaagtaaacacataccaaaaaaaatggcccaagaaaaatcatgccctgaggggaaggcactcagatgaaaaggaccttcttcccagtggtcccctgaggaggtgatttccaaggtctcagctaagggatgagcaggaatgtgtgggtgcagggggtaggggtgagagctctcggcatagagagagcagcacatttcaaaggccctggagtggggaaggaggtgg

SEQ ID NO: 44465 - DNA, 1051 bp, Homo sapiens
gcttttcaaactgctgtgatgacttacacagacaattcattttagataatggtgagttaagcctggcagcctctgagcgttttcccctcatttgttcaaacacctgcagttgggtactgatgcacatgtttaattgcttaaacttaaattataaaatccctaaaaggatgtttttctcctagaaaataagtcaggtctcttgcaaaggctgcctgctttcatgagcttcttgtatttcccgggatgcttatgcgccagcccctgttaggtctgcttttaaacacaggaagttgagcccttcagggaaagtgccgatgtctgaaccatcagcaaaatcactacacccattccctgggaagtctagttcatcagaaacaagtttaattcgggaactgtagtttatccaggttccgtgaaggcaattagcactgggcaaagggctgtttgatcagcctagagagagaccgcctttacgcctaaagctccagtcatttgtctctactcccgccgactcgcagcggccacagaagacatcagaactggatgaaaatggccctgcccctgcgacagagcagggcgcttctggcttgcgccttgttatttgtccctccagtggttcctagctgttgtgacgtcaaggctgccattcagagcagagaaaaaggaaaccatggcctctcttcgcatcagtagcccggacaagctgttgtttctcaggcatccaaagcgctttctgtctggcagagctgtgcattccatgcctgggtgacctggttaaatggaggaaaccaaatgctatccgctgaatgctctccaaaacaagcactccgccctgcgcgtctcaagcacaggcttcactgcctccgaggactgtgaagggaacagcagcactgcctgcatttgctgctggcatattcagcttctggtcagggtcttaaaggagaaaataacatcctcaatggcctcgattaatgcacactcaccaacgtgtttgtgctgcctttggggtcagtgctacaaaatccttttttaaaaaaggattcggaatcac

SEQ ID NO: 44466 - DNA, 1053 bp, Homo sapiens
atagaaaagaaaggttgtgtgtttatctgtggctgggatgatcaagaaatgcttcatggataaagagcctttgagccagacattgaaagaaaggtaatgttggacttgaggtcttggagtatcctcgttgaaggaaacatgagcaaaggcataggtagggatgggaaatgccggggtgcagagtgggcaggaatcgatttgtagttgctgggcaatgatgtgtgtaaaccactaaggagaagatcaggtagcaaaggtccttggaggccagaacccagagggccttgaatggcacgtgactaaatgatttaaacttaagttactggggagcaatggaagaatttgagtggctagagtccccatcctgaagaggccttgcggggatcagcatgtgggtgcctctggactgtgaaatagccagagctgggaagccttttagagctgctgttgtggtccaggagggaggtggggagggcctgggtgaggggaaggccactagatggagaaattgaatttatgagatgggatttaggaactgcctagataataggggttggccgatgggaagcaaaaatgcccccagagctttgaacccaggtgccattcattatttctatgccatctgccaggcattgcatagctattatctcatttaatctcctcctaatcttgtgggttggtattttcatccttatatcagagacgagaaaactaagggtcagagaaaattagcaattggtctaaaattgtacagttgtaacaggatctagaacagggacttcagtacaggcctccctgacccccaagcctgtgttctttctactgtactaggcttggaagacagcgtacgtgagagcaaagacaagctctgtccactctgtgcatattcagtgtaggtgctggtgagattcccgccttcaggtgtccagcaagtggttggagacatggagccgaatctcaaggacattgggaggattgaaggtcaaggcttaagaaccatctgcatcctcatttatttattcagcagctatttgttgtgtcttcgtggaccag

SEQ ID NO: 44467 - DNA, 1045 bp, Homo sapiens
cttacaagaagacctgtactataagaagaagcagcttgttataaattaccccgtctaaggtatttcttcacagcagtgcaagaacagactaatacaacctcatctaacatagttgtggctcacagttctggaggctgtacaggaagcatagtggcttctgcttctggggaggccgcaggaaacttacaattgtggcagaagtcaaagggaaagcaggcatgtcttacatggtcggagcagaagaaagagcagtggggacagaggagtgccacaggctgttaaatgaccagacctcacaagaactcagtcactgttacgagaacggcaccaagggggaaatccacccccatgatccaatcacctcccaccagatccagcctccaacattgtggattacatttcaacatgagatttggatggagacacagatccaaactgtatcattccacccctggcccctcccaaatctcatgtccttctcactttgcaaaacccaatcatgccttcccaacagttcctcaaagtcttgacttttttccagcatgacctcaaaaatccaaagtctcatctgagacaaggcaagtcccttctgctcatgagcctggaaaataacaaacaagttagttattttcaagatacaatggaggtacaggcattgagtaaatacttccattccaaaagggagaaattggccaaaagaaaggggctacaggccccatgcaagtctgaaacccagcagggcagtcattaaatcttaaagctccagaataatctcctttgactctaagtctcacattcaggacacagtgatgcaaggggtaggctcacaaggccttgggcagctctgctcctgtggctttgcaggattcagcccctgtggctgctctcaagggctggtgttgaatgtgtatggcttttccaggtgcagggtgcaagctgccagtggatctaccattctggggtctggaggacagtggccctcttctcactgctccactaggcagtgctccagtggggacactgtgtaggggctccaatcttacat

SEQ ID NO: 44468 - DNA, 1686 bp, Homo sapiens
ctttttattagaacccccaggaggaaatacctgttaccttagggcccagcacacatatttgtacatgtgggtatgtggtttcctgaagcttactttatgcaagctgggatagagttttttaattctatcactttttcttttccctttttctctctttttattgttcatcataaccagcaaagtggatttcttaacctgctagtcagtcggttgtcctttgacaagcttgcagtatttcagtgctatggtagggacgcatggtttcttgcccttctccctgtattcttcagtaacttctacagcatttttttacccctaaaaatgcctcaaacctgccttaactttattctttatgggccgagctctctccttccttttgtaataagcttctgtttctattttctcacctactgttcccttctcaactttctgtctgaacttgaacattcttctcctcctgatcaatacctaagaatgcttttgtttaccgtttcgaataagatcaatccttctgtgctgttagatacctggttatctcttggttggtgccatgggttgtagagagacatctgctggcccaagtgtagtgttgcattgtttttctgtgctgaatcaccttgtcattttttagtaccttaaactttcatagtgtgcaagtgagcttgtatattggaatgtgttgaagtcatctacctaatctcttcaagcatttttagcatttagctcaacatctaattaattgaaatgtagtcatacattataacccagtttaaggagctgcaatctagtaggggaaaaggatttcatggtaaaacctgagtcctcaccttcatgtattttttaatgagactgaaaaatgacagttaaataaaggttcagatccatttaaaacttttggaaatgataattcactcttccaagataaatgagaactgaatttttttatttgtataaatttgaaaggtacaagtgcagttttgttacatggatatattgtgtagtagtgaagcctgagcttttagtgtaaccatcacctgaatagtgtacattgtacccattaaataatttctcatgccttacccgcctcccactgtctcacccttccaagtctccagtgattgttattccacactgttatgtccacgtgcacacatatttagctccacttatcattgagaacatgtagtatttgactactcacttctgaattttttcacttaaaataatgacctctagttccatctatgttgcagtagaagacattatttcattttttatgtctgagtagtagtccattgtatatatcaccacattttcttcatccagtcatcagttgatggacacttaggtggattccataactttgctctagtgaatagtgctgtgataaacatacgagtgcaggtatctttttatataatgatttgattttggggtgatatatacccagtagtgggatggctgtatcaaatggtagcagaacttaatttttaactggtgtaggtttgcagcttggtttcttatgtgagaggtatggttggtgctagctataaagctagtgctggaaaaagacaaaatctgaaatctattgcttctttactttgaaactctagttagattatcacagtgattctgtaccatccttgtcttagcaaaattctcactgatttcagatgcaagtttata

SEQ ID NO: 44469 - DNA, 1130 bp, Homo sapiens
gatcttgtgatgaagtgatgctggggggtgttttctgactggctcctgacatggggctatgccagagctcaatctggttggattctggatcctgttatgccatatccacttttttttttttttttttttttttgagatagagtctcactcttgtcacccaggctggagtgcagtggtgcaatctcagctcactgcaacctccgcctcctgggttcaagtgattctcctgcctcagcctcccaagtagctgggattacaggcgcctaccaccatgcccagtatttgtatttttagtaaagatggggttttgccatgttggccaggctggtctcaaactcctgacctcaggtgatctgcccgcctcggcctcccagagttctgggattacaggcatgagccaccacacccggcttccacttcttagttcagtcccctctccttggttggaacatttaggttgcccctatagttgcatgcttggttcatctggacatgctcagcttacatgatgttcaacctgggggcccatggcaactgaaaaacaactcacaactttgttacagaagagatgaaccagattggtctgacgtggttaaaacagcagctttagctgtgattgaaaactggaactaatttatgtgtctgtcagcagatgaatggataagcaaattgtggtatatctatagaatggaataatactcagtaatgaaaaggaatggactattgatacatacagtgacatgtatgcattgcaaaataataacatgctgtgtgaaagaagccagacaccttttcctacaaaacagaatactgattccatttaggtgaaattctagaaaatgcaagctaatctgtagtgacagtagatcagtgcctgcagatcagaggatggcttgggagaggagggagaaagggattccaaaggaaagagcacaatgaaacgtttgggggtgatgtatatattcattatttgattatgtctaatgatttcatgggtgtatacatatgtcaaaactcattgtatatttaaatatgtgcaatttattgtatatcaagagtaactcagtaaagttataaaaactaaaactatgcccattcaaaaagcaaacagatgttcatagtaccattat

SEQ ID NO: 44470 - DNA, 1049 bp, Homo sapiens
tccacagtttgcagcctgaacaactgagagtggaggtgcctttgctgagataggggggtggattgtggagggaccgattggaggcagcactaggagctcagttttaaacacattacatttgagattcctctttagatatctaagcagaaaggtcatgtaggcagagtctggacttcagtgggaggtcaggattaaaaaggcaaatttgaagtcattagcattgaactgttgttcaaagtcataagaaggattgaggccaccaagggagtgagaagagtggtctggggcctctcctggtcccatggagtcagcagggcagattgaggaacagacaggaaggtgtaaatcgtgatactctagacaccaagggaagcagtagtaacccaccttgtcagatgctgctgatgggtcaggtaagatgccagctgaaaattgatcagaagatttagcagtgaggaggatgttagtgatcttggcgagtggtttcagtgaaatggtagagacaaaagccagagtggagcagattccagggagaattggaggaactggattgaagagtgagtacagacagactctcttttgagtaacttgtgaagtccagaagagtcaaggaaagttttggttttggttttttaagatgagagaaattacatgtttctcccaatgcatgtgttagagagatttcaagttatttttctgaaatggcctactagatttatgacatttaagaccaccacctgtgtgtgttaggggtggaggtgtagtgcttccctcctaagatgatttcatagaattgtgttgtggaagaggcagaggggtgggagggatcgggggagagacagagaaagagagagaatgtagagattggcattgtatgttaaaggtggcttttgcaattgttatgaaatttggctgcttcttgctcagtgtctgcattcacattccgggaattaaaaatgttaaggtaacaaatgttaagactagttctcgtcaactgaaaatgttgaaaaagctgatgtttggggtgtaatttcttttccttacttttg

SEQ ID NO: 44471 - DNA, 1070 bp, Homo sapiens
aatgtacctttgcctaagggccccatgtttgtgtgaatagtagtaatgtttgcctgagggccagcttgtttatgtgggtacatttctactgttaagatttttgtctgaaaagctttgcttgtataggggaggaaaatcgtggtgattctttaaggcctgtaggcgaccttttccagaagtttattgtggatcaaggagagaggggatctccgtaatttgaagtgaataggttctctggaagtttcttgttttgtttttgagacttgagcatttctataatgtgaaggggagagtccggaagaggcagatattttccaagtatttacatgagcaaccacaagagtactttaggttgctggatgcgatacagttgtggtgtggtcacagctggatgtacccagaggtgcggtacagtacagagtagcagaagttctgccattagcattttggagaaaaaaaaaaacaactagtctggagtagagaaactttgccgttacatctcttttctccccttaatttgtttgatttgtctcctggtcagataaactgttggtgggacgtttagatgtgggagtagtccatttcattagtattttctgtacagagattccaaagaaaactcatagtaaacagaggtttctccctgaaaacaaatgatactagctacagtgtatttgtgaccagtatgtattattaagaggtaccgtgtcacaaagaactttatattcctgttgattgctgtcaaatattgttacctctatggcaggcatgggtatattatttagcatactttagggattggttttcatattacttgcagttttgatgaggaaggcttatagacctactcaggcaaacctgactggaacgtgagtatctgtggtctggtgtggaaatagctctctagccccatctccctcctcccattgtccacccccatcctccttaccacgaaacacatttttcaccagcattgccaaaccacttgggattcctgcgcatggctttgcttagtttgctcttctgcttcttggatacctccttcaggaaatgttccctgatttctcctc

SEQ ID NO: 44472 - DNA, 1036 bp, Homo sapiens
gcaggactttgggatgggaattttgctctcctttgcgatctcagggcgtgaagaaggcgtcccctccgctgccggcggagctgatcggctggctagtcaatttccccttagcacgccccgtgcgcccaccctcgctcagcccggggccccctcgccgtcccccggaaggggtctgcggttcctggccaggacgttcggaaggcgagcgggggaaggtagggctgtcgcgggaacccggcttgtgagagcgatttcgccatgtttgtgttgctaagagcactttttcccctttgctgtggcttgatgccacatggctcctccggagctgctgccgggctgagagagtgtttttttttttttttcaatgtccgcattccagctaatgttgcgcagataaaattcaaacttgaggtaaacagaagaagaggaggaggaggaggaggaggggaggggggaggaaggggggactgtttccatttcgagatcccacctcttccctccgcgcagcccaacatcccgaacctagagacaactcttgcctttctcccacgtcccccacctttgctgtcaacaagaaataaaggcggggcgggggggggggttggaggtagggggtggcgtgcttattaattagaaaggacgcggtgtctcggttctccactggaatcagcaactccctggaactcgggcctctggccccgtccctcttttctccggcagggacgcaggatgccttggtgcactctagagacggggaccggagggtgcagcgcgcctgggtggggcgaagggcgccggtctcctcacgccctctgactttaggataccagacagtgtctcttcaaccccaccccaggcgcaggtttccagaaggcggggtgggtggggcccccgatttccagaaggcgagttacctagcaggtgtgtggggtgggcattgctattcggtaagtctgttgcatggggtaggatgacgtggggagcttaaaagctttaaagccagcgcaaaggtagagctgcgtctgctgtttttgtt

SEQ ID NO: 44473 - DNA, 1045 bp, Homo sapiens
gaaagtttcccattttcccagatttctctcttttgttgtcactgtattgctcctcctccacccctgcatttccatgggcacctcattatttaaagccactgctaaaaagccaaaaattagtagccaaaccatccaagagctgtttcctcacagtgaaggcccaggggtttcaagtgtatttgttttaaagtttgaacatagtaacttcagtagactccccagctttagagcattgatgggatctggatttccagtggaaaataagacaagccagaaaaatgtgtacatctacagcccttagtccaggaggagctgatggccagacacacaaaatcgaacctttccagctgccactctgctggtttcactaacctatgcacatccagagctacggaggcctggcaccaatcatagaatcttagggcatgaggcactaagacctggaagcctcttcctttccttcccttcctcttgacttctccagaccttggagagaacattgcaagactgagtcctctggggaaaggtgtacttggcatccctggttgctggggctaaaggtgaacttagcaatgaagttcagctagagactcatgggcagccagggcttgtcttgcctgctctactggttttatcattacttctactgcctgaccacatcatgccctggccatctcaaagcttggaattagtgcccgtgcaaaatgggaataatgatatttaccaacgacatagtattttgaagattaaaagggataatggatggtaagccctcagaaaagtgcctggcacatagtaagtaataaatgtttggcattatatagttggcatagcattaaattattttatggttttgttaataaatgctggagaaatgccaattttcaaggcacttccatgctctccacgccaggccctctgctgaacccacggacaaagattatcttctttaagcctctcaactttccttatttataggtgagaaagttgaggcttccagatgttgcacaaaattatactgttggtgagtgacagagccagaata

SEQ ID NO: 44474 - DNA, 1063 bp, Homo sapiens
ggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaagactggcattgtagctcctcacacattcctttggctgggttagatgtctatgcttacgggaattgagctgatttatattgttaataatttgcatttgtgctgtacctttcctctcaaaggctccagagcatttcgtggagcctccgacaggcaagtgatgcttataacttgcctatcaggtaggtagaattcgggaagatctttacaaattgtgtgaactttcctttctttgggatgacttaagtcatcctgcctggggcaagaactagattagataaccttggttagga

SEQ ID NO: 44475 - DNA, 1045 bp, Homo sapiens
ttggtaggtggaggagagggagaaggaagaatgctgttgactcctgggaaagattggcattttgcaggctattcattcactagaattcgtgtagatgaacacaaaaaggaggcagctgaggcagatagactatttgaaagttaagtaatagtagtgtatgcttgaagtgataacttagcctatggtaaggatatgggaaactgaggaatgttaaaagtgaaaggtattttaaaacaggaactaacaatctcagtgacttcttgaaaataaagaattagccggtgctgtggcttatgccatatcctagtactttgggaggccaagaagggcagatcacttgagcccagaagtttgagaccagcctgggcaacatggtgaaaccccatctcagcaaaaaaaaaaaaaaaatcacaaaaattagccaagtgtggtggtacacgcctgtagtcccagctactcaggaggctgaggtgggaggatcacctgagcccaggaggtcaaagctacagtgaactgtgatcacagcactgcactccagcctgggtgatagagcgagatcctgtctcaagaaaaataataatttaaaaaaaggttttttgttcttgcgatagtttactgagaatgatgatttccagtttcgtggggggaggggggagggatagcattgggagatatacctaatgctagatgacgagttagtgggtgcagcgtaccagcatggcacatgtatacatatgtaactaacctgcacaatgtgcacatgtaccctaaaacttaaagtataataaaaaaaaaaaggaaaataaataacaacaaaagaaccaaaaattgatgtatgatgatgagctaacaatattgctgttgatgaaaagtaggaggaaaatcttgtttggataagaaaacaaataataaattgaccataaccagttgatacttagagtcttagaaggaatctaaaaggatcgtcagatgtagtccctggcttcagatggctaagattactgattgtatattttatagaagaactgaagactaaagaaaccta

SEQ ID NO: 44476 - DNA, 1078 bp, Homo sapiens
agagaagacagggatgccctttgtgtctcttgtctgtttttcaggcagccacatttgtcatagttgaacctacttccattttgatattccagggttttttttcaggcttttgtatgccatttattgaattctggcaagatttggccgttctcggatcttctttatctagggaaatcctttgtgcaaatgtgggaggcaatcctctcaagcaatagaatgaaaaaataccagcagaagcatgcattagttatcactggtagcagaatatggccctggcccaagcaggttgcatctaatagcctcttcttgcctggaagtcttctggttcctggaatggcttggagtgatcaggcaagccgctgccataaaggaggaggcacagcagcagctggggagaatcacatttggcccacaatggcagtaagatggtgcctgggaagccctgctctcggatttggggggagctaaattatgaaggttggatgtgagatggtgtcattaaggactttctggagagatcgtgcaattaactatgaagccaaatgagccagtgggttaatatatggggaaggtactcctaaaatgctcataaaggcaatctagtgactgtcataaaactttcttttaaacagatactttttgaaagggtaaatgctaaatctgaacctcaaatcagctttaaaaacagacatagctaagatcaaggctcaaacattaatagaggccaactcttttactccagaaagtgaagaaagagactgctaagcccagatgattttttttcctggctttgcttcccttttagaggatgtggattgagccagaaaggggcattatctgatctctattattttcagaaactgtggattttgtatggcaaggtgcttattggaagagagccaggcttctcatgaatttcaacttgacaaaatgcccagtctgaactacatgaccataagaaagtgccgaaccaagaaagtccaacccaatgctaaagatagaacactagggaaaagtctagtgcaaggaaaggcaaataaattttgtttcaggcaccaactccaattgatcgtggtgg

SEQ ID NO: 44477 - DNA, 1052 bp, Homo sapiens
aagcttatttttatgaatacaacatttaaaaattaggggccaaggatgatggctgcagtcctatatcagtcccaacagccaaagttatgtgtttggttgagtgttacgatgatcctgatttgtggtgataagtagtggcaaataataacttttttttttaacagcttgccttgcaaccacaagatgctcatccatcaatctgatccaaatgattaaaagcgaaataagtttctgcttcaaagttaaataatcgacattatctaataaatcataatatagaagttgggacaaacagccaaaactttaaatattaaaccacattatgaaaataaccttggatacctcctgggctgatcttttgccatcttttctcatgcacttcagtgttcattcactaaagggagggaaggccttccgcactcacgctttggcccggctcacgctgcccccgcagcacagccacagcacacctcaccttcaccaccttcctcccgataaactcagccttttgttaggacctgtctcatgtgttaattcctctgctttctctgtaaagtctttctagacacctcccttcctactaaaaagccataattaattaattgttccctgtgtgtttatgtcactccagcccttatgacaatgtaagtggcatcagtgttgcctgtgccccatctcccttctcaagtgtgaaccgtttaaggtacaagctgtatctgagccagcttgatgggagcatgcctctctctaacaggtgctcaattagtatcaatatttccatctactaaattgaactcttataaaatgtccatgcttcttaacttagactcctgcagttcagaatggaagactagaggttaggggcaacaaaaaaagcaaaaagaaaaaaaaaagtgcgttttctcgtgtgtgtgcatttaaactacattctggatttaaaagcctgggctaactcactcacaggtgcaaataagagtgtttttactctgaaagggatctaatatagctctgaatttacactagaggaaactgttgtctaaaaactaagaatt

SEQ ID NO: 44478 - DNA, 1027 bp, Homo sapiens
gtttacaagcatttgataaaatgattaaaccctaaggtggaattactactttctgctacagtacaatttgtgtgttaatggatattagtgttattgtaatgtggattaaaataaaattttttaaaaattaaaggtagtttgaggtttatttaaagagccaaagcccttcagccttctgtagtgaactatctctttagaggcagcagagagagaccttccaaggatgggccacaagtctcactattagagattaatgtgagatcttaagaatttagacatattaatagaactggttatagattttttaagttactctacatatattattttaagttaggtgtttatttttctccctaatgatataatgacttttttttaggtggtaaacctttttttgtctctatcccatgagaaccttcgagttggctccccgaatatttctttattctaagacaatagctataaaaacagctaaatttcggatacattagagatcaattttgactagagtgatctgtgaagttttcataaagaagatgactttttagttgagcctttaagaagagtattgagtaggtggacgggaaagatattcagaaggaaaactgtgctctgtagttggtgggtgacaaagcagtgtcttgagtcagaaagactggtgcaagataaaactggaaaggtcagtgggtcattagctgctgggctgtgaagtttggtcttcattgagcaatgagtcatgggaagatgtttgaccagatgagcactctgatttctgggctcctgaaggaaaagtaacctggcagtggatgtgaggtttagttggagacatgaaaaataagaacttgaagaatgagataaggtcagctgtggtggttcacacctgtaatcccagcattttgagaggctgaggcaggaggatcgcttgaggcctgaagttcaaaaccagcctggtcaacatagtgagaccctgtatctacaaaagaacaacttaaaaattagccagttgtaggggcatatactggtggtc

SEQ ID NO: 44479 - DNA, 1031 bp, Homo sapiens
tccagccaagagctatggttttttaagaacttgagtctgggccgggagtggtggctcacgcctgtattcccagcactttgggaggctgaggcgggtggatcacttgaggtcaggagtttgagaccagcccaggcaacatggtgaaaccttgtctctactaaaaatacaaaaattagccaggtgtggcatgcacctgtaatcgcatctatttgggaggccgaggcaggagaatctcttgaacccaggaggtggaggttgcaatgagctgagattgcgtcactgcccaccagcctgggcaacagagtgagactctgtctcaaaaaaaaaaagcttgagtcagattatatcgtttctttgctgaaaaccgtccatgcttttccatagccgttagaataaaatccaaacccattacatgcctgttaaagaagaaaggaagccaataaggcctgaacatggggattgtctgatgtgctggactggatataagatggtgtaagaaagaaagatgattcctgtatctctggcttcagcaaatgtgtgaaagatagaaccagttactgagtctaggaagaccaagaggaataagtttgttcattgaaacaaacaaaaaacaatgtgggattgtgttctctctctctctctctctttctctctctctctatctatctatctataaaaaaaaatctgtttatttttgagatcgagtctcactccatcacccagactggagtgcagtggcacaattttggctcgccacaacctcctgggctcaattgatcttcttgcctcagcctccagagtagctgggactacagatgcgcgccatcacccctggctaattttttgtatttttttgtgtagacatggttttgccatgttacctaggctggtcttgaactcccgggcccaagcaatctgcctcactgacttcccaaaatgctgggattacaggcgtaagccaccgagccgagccctgtgttttaatcaatttaaattttaggtgtttctgatacaattgatttcaataaaac

SEQ ID NO: 44480 - DNA, 1025 bp, Homo sapiens
agaccagccaatgcgtattttcctattttactgactgaaaaattaaagtacatgaatattaaattttttaaaggaaattgcagtgcttctgttagaaagtgctcttcaatcccagttttatgttcagaccatgagacagctgtgcgtctgtaaggattacgtttcaacacattagcttcagttaaaaagatatatttggtcattaaaacatttgcaaataatattagctcataacatcatcaaatagaagtgcccacatctgaatttggcatataaagcaagtttgcacagtaaggttggcatttaatgaagggaacctaaatccaatttgtccgtgtagactaagataggattttaactttggtcattcttatcagaattttggggactagagggagtccttggcattcaccactcattcaaaaacacatttattaatctcctacagtgagccaggctctattcaaagatataatgatgaatacaaatggcacaaaagcccattggtatctggcacggagctttcagttgacacagtggcgcaatgggcccatggaggctgtgtgttttgtgaagaacactacctttttactacctttgtcccttcaagagctaaagatcatgggattttggggggaaagttagtaggttagagagatccatcaggttaaattatcagatgaagaccccaatacattggttgcctcaagtagttctttctgaaaataaacattaaataggtaagttcctttgaggaccggaactcattcccctttaatcactgtgatagtgcctggcacataataaaccttggataaatttttttaaaattaatgtgttcgtccaggaatggggtgggttccatggccaaataattttgaggaatgttaggtttcacaaagctgaacagatttcttttctacaggccttctcagaagttacgtacacttagagcctccaggatgaggatgctgcatgatgtgtttcaccattatacccaaaacatggaattgttctgagatgaa

SEQ ID NO: 44481 - DNA, 1059 bp, Homo sapiens
gatcagggcagattccctgtggtttctatagttaccgagagctacacaaacagagatgaggttctgtagtccacaggtttggatgttgaagttaatagaagcctacaccacttttaattgtaatgtcacaagcaacagaggttttattaaagtggcttggattgtgtacattgagttactctcaattttttttatcatcaacaagtaatgatagtttaagtaaatgcacttagatgttaattgttctgtagaaaaatgaataaggcccagtatcagcatatcttttgttaacataattgacacatttataacttaggtgcaaagatggaaccattttacaatctacctgctttcctaaaggaagtttattattgcagatattccaaaagtagcaagcaagatattttttttccctagtttgtgctctggggaaaaatatcaatacagtatagtaggatatgggggtcttatccttaattcattattcaacaaatcctcaaaatgcgttggcttttctgttaacctctctgaaatttcgaatgggaaatgtggtttaggtaaccttgagctgcttttcaaatctggctttagggatatgagacttactttttttctagggtgagctgttaaaagtgcatccaggtaaaatgatccctttaactggagtcagtttttctatgtctaactttagaggaaagatttgcaaatcatgggatcagcacttaatttggggctctatttaccatgtaggctgtcaagaagtattaaccttaaggtaagatgagaacatggagtacaaagctgtgagttgatggcatacagtacagcggtattaaatagcattatccatcctgcttgctacagtaaataggatttcactattatgatgtgtcagggctttcagtaaaatcaaatttacaagacactaaactgccatcctctctgctgagcagctttattctgggatcttgctttcatattaatcctgttggtaggaaatacttgtaccaattgtgcatggaaattataatttaatgatctcttccttttctttattca

SEQ ID NO: 44482 - DNA, 1010 bp, Homo sapiens
atctgaacataagttaaatggattcaaagtcttatatgtgatagaagctttgattctagttttaccagaagttgtagaaaagaacgagcttttgtacatattttatatattttctcactggggaatgatttcattacattacaaagatttgagccactctcattgcttttgtaccttacgcctttgcaattcaacccaaccaccagatgatagataacacaagcagacccaaccccaatctacaatatgtacagacatttattgaacaaaactttattagaaatccagtacaaaatgattcatatgacccgttttgtaaaactcaatgaagttgcagttttctgttcttttaagtattttctttgcaagaaagtttcacctgagacagatgaggctttttgtatttgatctcaaacaaccaacaatcctcttgtagtagtctgttcttacactgctaataaagacatacctgagactgggtaatttatgaagaaaaagaggtttaatggactcacagttccacatagctggggagacctcacaatcatggcggaaggcaaaggaagagcaatgtcacttcttacatagtggcaggcaaagagagcttgtgcagaggaattcccctttataaaacaatcatatctcatgagacttattcactgtcatgaggacagcacaggaaaaaccttcccccattattcagttacttcccagtgggtcccgtgcatgacacgtgggaattaggggagctacaattcaagatgagatttaggtggggacacagccaaaccatatcacctcttaaacctgtggttttccacagaaggcgattttgcctcctaggcaacatttcgcaatgtctggagacattttgcttgtcacaactcagagtagggggtagtgctgctgggctgtacggattagaggccacgagtactgctaaacattctacagtatgtaagatctgtctccataacaaagaattatctggtccaaattgttgatagtgc

SEQ ID NO: 44483 - DNA, 1036 bp, Homo sapiens
tgtaaacgcaccaatcagcgccctgtcaaaacagaccactcggctctaccaatcagcaggatgtgggtggggccagaaaagagaatataaaagcaggctgccccagccagcagtggcaacccgctcgggtccctttccacactgtggaagctttgttctttggctctctgcaataaatcttgctactgctcactctttgggtccacactgcctttatgagctgtaacactcaccgcgaaggtctgcagcttcactcctgaagccagggagaccacgagcccaccgggaggaacaaacaactccagacacgccgccttaagagctgtaacactcaccgcgaaggtctgcagcttcactcctgagccagcgagaccacgaacccgccagaaggaagaaactccgaacacatctgaacatcagaaggaacaaactccggacacgctgcctttaagaactgtaacactcactgcgagggtccgcggcttcattcttgaagtcagtgagaccaagaacccaccaattccggacacattagcatctgcattccagaagacctgaaccgacatagtatacaggtggatttgaagttatttttagtgtagtgtgcaataatggttgcagaaaatctttaaaaacaaatctttatgttgaatagggctgaaaattgctacaaatgtttgattagtaattttttacattttcttctcttaacttcaagccagcatgagaagaaataaagtcagagcaatgggaagtacactgctgtcaagaggcaggagtcccagaaccaattctctttctgaccttcaagaattcccttagcagacaaagagcttggagcctcgcttacttcctagaaaatgaactgagtgatctctggatgttttcttcagctctgaatgtgaaacagattgcaagaaaagaggttgagtggccaattggtcccaatagtgtgaacattaagtctaaatttaaattgaacaaatacaagttagtacaaagaaaaggaattcagaagttgtgcggtaattgtctc

SEQ ID NO: 44484 - DNA, 1011 bp, Homo sapiens
tgggatggctgggtcaaatggtatttctagttctagatccctgaggaatcgccacactgtcttccacagtggttgaactagtttacagtcccaccaacagtgtaaaagtgttcctatttctccctatcctctccagcacctgttgtttcctgactttttaatgattgccattctaaatgagatggtatctcattgtggtttttgacaagaaatggggaaaggattccctatttaacaaatggtgctgggaaaactggctagccatatgtagaaagctgaaactggatcccttccttacaccttatacaaaaattaattcaagatggattaaagacttaaatgttagacctaaaaccataaaaaccctagaagaaaaaaccctagaagaaaacctaggcaataccattcaggaataggcatgggcaaggacttcatgactaaaacaccaaaagcaatggcaacaaaaaccaaaattgacaaatcggatctaattaaactaaagagcttctgcacagcaaaagaaactgtcatcagagtgaacaggcaacctacagaatgggagaaaatttttgcaatctacttatctgacaaagggctaatatccagaatctacaatgaactcaaacaaatttacaagaaaaaaacaatcaaccccatcaacaagtaggcgaaggatatgaacagacacttctcaaaagaagacatttatgtagccaaacagacacatgaacagatctgatcatcactggccatcagagaagaacaaagctaagtctaaaccagccaggcctgaggactgagtcagacaagaggaccccctgcctccctcctgtggcctttgcctttgcctcagggtggcttctttaatgggcagatgatggcatgtctctcttcagtcacctccatcccggcactgaggtggctgatttccatcctatcttgtgtgcgctgttgctttctattcagatgactcgtgctttgagcgcattctcttctttccattgctccctt

SEQ ID NO: 44485 - DNA, 1040 bp, Homo sapiens
aggagtgagaaaaatcatcctcatctgccctccacatgccacttccagaactttcttatggttcccggcctgtgtttctgccccctaactgggctcagtctgttttaaggtgtttcccagttgtcctgtccctgaccccatgtttccccaaagtccgttcctccttaccatagctcgaaatccttgccgctctcttccagtggatgaccttgagagcttgttgaggtaaataggattgcagagtgtttttttgttgatttggtttttttttttttgagatggagtactgctctgtcacctaggctggagtgcagtggcatgatcttggctgactgcaacctctcctgcctgagcctccctaatagctgggactacaggcgcctgccaccacacccggctaatttttgtatttttggtagagacagggtttcaccatgctggccaggctcgtctcaaactccggacctcaggtaatctgcccgcctcagcctcctgaagtgctgggattacaggcatgggccaccacgcctagcctctttgttgaacttaatattattcttctttattttcgctttctcagtgaagctttcttcctcatcgtttccaagttgttgtgtttcggtaatctgattatctgtcatttcagagtccctgtcctcccactgagccacatgcgcacacacatctctgtcaggcacccctgtcatgtaaggcacgttgggtctgccagagcggcaccccttgttccaactttcaggtttaatgcttgagaacatttgaaggctgttgtctggaaaagataagtgtttttatatttctttgaattttaggagttgtctaccacaacaaataaactagatcacactttttaagttcaatacttattatcctcattctgtggaaaaaatatattttctattaatcatgtacataatagtactaattatgggccactttggctgaacacagttttatgcttaggcttacataattaaggttgtaatgttatttctggatctttgaggcattagtagagatca

SEQ ID NO: 44486 - DNA, 1028 bp, Homo sapiens
cagcgttcacccaggcctcatagaattctttcactttttatcctttatccatgatgtcactctcttcatgttacaagtcttggctggcctgtccccttcctcattctgactaggaagatgggattccctctgaatcaggcctggactccagcctccaactagagtccccagcctactctttagctggggtttagtggactctcttctggaacctggctcggttctgtgcctcgatgagagaaggaggcttgggttgccttatggggcctatttcacaactatataaatcaattttttttgtatgaataaatgaatatgttaggagatccttcagggtaaagatgtctttaggagtaggttgagatacttcacaggtaagatggtcccttttaaaaaattaaaaggaagtcttaaagacgtctgacagatttgttttctgtaaggttagttttttcttgctgaaacctacttatgagtcctaagattgtgttcctccagtgcttatgaaatctgttctgactttctgacagtggaaatggacatctagttccaagaataggcttaaattaaagattgtcaattttaaacagtttaatagatatgtaaggaatggagctattttaacagcgtctttcattttttgaaaaataacacatgctttagaaattcaagctgtttttaaccaatcgcttccatctaacttaacagcagctgttgcacactattataaaaggcctgggcgagatacagtgttgaaaacttggtgagtctgagatttgttacatattttatcaagttacctgctgtccctgcatttacagatatgctagattgtttgatgtctacttttctggatgaggagcagatgtggttgacggctgttaagttaggaatgcatgcagaggttcccgagacttggtgtgtatattcaaagaacagggactttctcatttagcttctttgtgcctaataaacacagctaaggaaggaatcagaagcattagtagtttgtagaacatttatggttt

SEQ ID NO: 44487 - DNA, 1046 bp, Homo sapiens
tctttttcaagaggtatttcatttaattgacattgatattgaagatgtaacttagcatttaggcatctgagtaatcatcatcgaatataatgattagtttacccacattaatgcctaaaattatacggaaggctaaaaagtactgcattttaaaatctagttttaatactttgattagcgctttatgttctagtataagaaaaacaatacagtgaccttaacgagatcagctgttaccagtgagcaaaccactttcatgtttttgttgcttctagttcctgtagaaaagtacttcatcatttatagcaatttttcttttgtagaaagataagtttgggtcaatcttcaacaaacattgtgcaaaatgtcttgataacaatactgtcttatatttgtttgcattgtactggttttccaaataacttttatgtatgttatctcatgtggtccttagaaaaatccaaagttaataattattatttaacatttattgatgaggggaatgcgaatcaaaaagttcagtaactggatggaaatcactgctgcaacatacgtgagtagatcgtgacttgatccctacttgtcactcttgttactccacttctggagtttttccacaagagtgtgctgccctctatgtggtgagtgctgtattagtgcttccggggttacaaagcaacctcaaaacttgaactctcttgggtcttaaattctagttagaagactgatacctgcatatagatagaagcacaaagtgcaaaagggctgagtaattcaggccctggagatgggactgggccataggggtgaatgaggagaaaacctggtacaatttcttagaagagtaagtgtcagagctgcaaggggcatagggatttgaaatgtgtctggcatccatcttgagagaaaagctggatcgaaaaggtatagcgatgggagaacatgggttctactttaggatgttgagtaacttaatgttgcaagaacttagggtgctggggtgagggagggctgataacaggacaggtgtggagggtagagaacag

SEQ ID NO: 44488 - DNA, 1030 bp, Homo sapiens
aaactgttagtttaactgcaagcaatgggggcttcaagcatgctattgatgagatgccagcaaattgagccctttgccactggtgacacttgtgtcaagaataactttagcacgttttatcaagaccagttggagaagcaaatatagtaattatccacatcctttttggatattaggtttaataataatgagtgctgtccagctttccagagtttctaattaataattggttcttaagaacacagcatgtggtttctcacagtttgaataagattgggaaatagggcaagcttaaggtcctgcatacttttatgggcctgatagaaaaggcagtttaaaagaagagcaagttgtaggaagacattcaggtgtgctggtgtgaaaatttaatttgtgcctttattgacctctgctccctgaccttgctgtgtcttaactttgtggcatttccatgagtacactgctcttccttcttgcccttttgcaaccgcaagcttttgatttcaaatggactcttccagaattagatgaatttctcagtttttactttggtagcagctacagtcttttgctcacttgaaaatgatcttatcccctgttctttagtactttatcattgaaataatggaaaataagcatgttagacctgcatttaagaggggacaataatgcctgtcatttatcgggtgcttactcatgccgggcactatactaactccacgtacgttcttaaattgttaaagcatgaggtggttgtattcttgtgcctatgcaatggttagaatgtcccttctaaaactcacatcaaaatttaattgccattgtgagagtgggcctctcagtgcactcgtgaatggattactgctgttatctcaggtgtaggcagttgtccaggcaatggtctcctgatgaaaggataagtttggcccccatcctctctctgttttgtgtgctcacttgctcttctgccttctgccaaaggataatgcagcaagaaactcctcaccaaatgccaagcagatgctggcgc

SEQ ID NO: 44489 - DNA, 1030 bp, Homo sapiens
cacagtgtatcaagggataggccttggttatatagaaaatgcacttaaatggaacaccttatttcccagggatgccagataattgagttatacctaaaatcttgaactgtctgactagcacacatgcatacacatctagcttctgtgtgctgagaggtgttaaatggtttggaaactgtaattaagtagctgaaattgtgctgcagaaccactataagcattgcctcatgtagtatttcaaccttaagtgctaaaatttcatctgagtagctgtgactaatctagtctttatttgtaacacattcaaattaggaggtgtatgttcttgtccatgtactttctcattagcactaatattgctaatgggagtgacaaatgtattatgttttttccttcgatcactcacgccttttagataactagctttttagaggaggtaattttccttgtgatacatttatggagctctgtgtttaacagatttactcaaaagaatatgtccgtagggactgtttattagttgataggctccggggaaaacaagtttggattaatcagtttgaatcacagaagaaattgtgatggcagttagtgtaaatgggaatagcacatactcatttgttcctaaatgtctttccagcattttccgcctagtttatttgaacttggaaggttctttcctaggctgtttactttgacacttgaacacaccctcttcattcttcctttccaaattttcgtttgttcaaaggactccttaatgtttagagagtcactgaacagtgtttggtacagtcataaataacaaagaagatacattctgaaaaatgcatcattgtgtgaatactagagagtgtacttacacaaccctaggtggcatcggctactacacacctaggctaaatagtatagcctgttgctcctaggctacaaacctgtgtagcagattcctgtacttaatacaattataacacaatggtaactctttgtgtatctaaacatatttataaaggtacagtaaaaatatagc

SEQ ID NO: 44490 - DNA, 1057 bp, Homo sapiens
tatgtgttttcttcagacccctcttttggtcttttccattctcatgcttcctacctatcacttgtaaagaagtttgaggtcatttaatcacatctaaaccattttaacttttaatagacaataggaattcattttggtgcttggcaaccccattgatatgtacttgtgtgaatatgtttatacatatatgtacaatattaaagaaatctcatccattcttttatatttatttaccacaaaaataaagttctggaataccatgccttacttgaaaagcattatttctgagtattttcacatttatttaattaattgttttaatgttaggtagtgctggcttaaggggaacctttttgaaagctgaatttttaaaacaatgaaaacccaagaagtcttcatgatttttaatggcaattttaaaaaagcactctcattaatgtcaggaacagattaaaatatgcattctttatatttttcaggaagtactaaccaatgccgttagacaagagaaaaaagtagaagggaaaacatggaaaggaggaagtaaaatttccattatttttagattgtatacctgcaaaatgaagaaagccagctgacaaacttttataagctgagagaattcagttaggtaactgcctataaagtcaataaagaagttctttatgtactcataagtaacgagaacaaagaaagtttagagtaggctttcattttggaataataattttgtaacatattgacagttatattaaaacaaatgcaaatgtttattatacaaaatgtttattatacaaaaatttgcaccagtagatttgaaaacgtaaaacatccataatcctaccactcctgatgactagtgttaatacttgctgtttgattcctgtttttaccatgcatatatacttctggggagtgtatggataggatggaggaggtacaaatttcggctcatattttactactatttatacatttttttttacaacaatgtaattattttattacaacaatattttttacagcaataaaaatgtaatatttctattatagcaat

SEQ ID NO: 44491 - DNA, 1070 bp, Homo sapiens
cgttttaattacagaaaatgtcttcaaaatctgttttgccattttaaagttttggctgtgaaaaagtcaattgtcagtgtgtaatggtggaaaaaatatcttaaaaagccattgatatagtatgttcagtagacatgtgttacttgaacactagtagttgattttccatagaaactttttcctcttgagtttgggtatcgttgttggtaataaacatccctgcagaactgactgcgatttcacatgaattgtttaaaaataaaccaaaattacacattatatattccctctcccaaaggaatctccttgggaagctgttacgttttctactatagctgcccttatcgaagtttcgatcctaccctcccttctccttctccgtccctcactcttccaccattttcttcccctctttcttttctttctgtctatcaagagttgcatgaaaaagcacatctctttgaccagcctccaaggtgataaatcttcatcagctgagaataaatttgatttttggaaacagccagcagtcagagtcaaggtcagtgggtaataaaactatagtaacattttgagttagagatggggagtgactgtaaagtagtgagcccatttttcttgagtttttggaaggcaaagaaggaaatcccaaaacaggaaatctcagtttattgtgtatatttgttaaaaacaaaagaaaacaaaacaaaaaactagtcttgtttgataatgacattgcaagttttgtatattatttatttatttttgtatttgtgactttttccccccaatggttgtgtctttcaactgactgtgggatccttgtcacacttttattttatgttgataatccttttggcattttaaatgatatctgtatgtcatattgaaatacagtaattaaagtggcacaacataggaggaaatcaaatttcatttaatgtttaattacataaattgactacctgatagatttttttttaaatttggagtttaacatttgaaaattggcaggaaggttttaatgcttgttttaaacatagtcatcatctagatctgtactatcaaat

SEQ ID NO: 44492 - DNA, 1028 bp, Homo sapiens
attatttttaaaaatttaagtagagacagagtcttgctatggatcttgaactcctggctcaagtgatccttctgccttggtctcccagggtgttgggattatagatgtgagccaccatgcccagccacatatttcttgttatcatcacagaactatgtagtattttctcttcttttcttttttttttaaatctaaatgttaaaaagaagtctcaatttacttacttaaggcaatatttacttcaaaattcttccattactctttggacagatgttttattgagtgcttactgtatgaaatttactatgttaggtactaatgatctatgaataaaagacaaaatcttgtccttgaggaataaaaggtaaaagatacactaaaaataatgtttaaaaatgctaagtctgttatagagccatgctacttatagtcttgtgaggattcccacttttgggaaagccaggactttgtctttcttttaactaattgctatgtttgcatttatttattcaacacgtaattgagtgcctaatatatgccagtgctgagcaaacagtaagcagtcaatacatatttgttgattgaataaatgactgattgcatctactgaagccctggaaataggaggagaggaaatggggaagaatagaaaagattttctggggaaaggacccctgagctgactcttgaagtatgagtaggatttgctcccaaggttgaggagtgggatgaaacagccttaggtattgcaggcaaaagcttggaaacgtggggatagggggacactactagaagttgctgagtgggaatcattgtggcagttagaacatagtctgttctttaagtgggtgtgtgtgtgcaggggattcacgacttaacccttgcctggcctggccctaggtcctgtttataattggtacctgattgccacaaaaagcctgctttgtcagtcttgtggtctctgttttaacgttaatgctggtcaatggttgtatctaaactgtaaaagagagggtgtataaagagac

SEQ ID NO: 44493 - DNA, 1034 bp, Homo sapiens
ttgtctaatgtcagttgtgttctggcactgcttcttctacatcttctcatcgtctggcgctgtttcgaaggcactcatcaccataatgtcgtccatcttctgttaattcgtctggtgtggtgtctgttagttctggaatttctccaaggtccatcttgaagcccttcatctcccaccttttttggttatattcacaatctctttcatgatttccctggttgactctgttgtaaatcatgtgcaatatctggacacagtttcctccaggaggagtttgttgttttgggcttgatgactttcatggctttttctttaacaacagtggcatcttcatgaggtaatcctttcagacttcatgatgttctctctgtccgggttctcttccatagtgttgacagtccttttcatagattatcatgtctgatgaagaaaggtccttatgatcccctaatctataggctgaaataaaaacattctgtttgggggtaagtcaccactttgatgtgttcaatattgaagtcatggggttctgggtggctagaggcattgtccaatatcagaagaactttaaagggtagtcctttactggcaaggtattttctgatttcagggacaaatcattgatggaacctatctagaaaataggttcttattgtgtagaccttcttgtacaaccaaaagactggcagctcgtgtttatcttttccctatgaggctcaggggttagcagctctatagataaggacaattgtgccataaactcaactgcatttgcacaaaactagtagagatagcctatcccttcctatcttaaatctttgtacttgcttctcttctttactaatgtatgtctttcatgccatttattttctagagtagggcacttttgtctgcattaaaaatctgttcaggcagttatcctttcttctcaatgattttcttaatggcatctgggaactggtttgctgtttcttggtcagcagaagctgcttctcctattatcttgacatttttaagtaaaacctctttctcaa

SEQ ID NO: 44494 - DNA, 1101 bp, Homo sapiens
gcctgggtgacaagagcaaaactccgtctcaaaaaaaaaaaaatctttaagatatctttcaggttcaaaattctaagtgttgactttctaatggaaattattttcatcaggaccctttgaagttttaaaaagggttaatgttagggttaaattgatttataaagatgatgtcatatgtttcttttcaaggtatttttatcctccgtgtatttttatctcagcagctatgtttgtagtaatagaacaggtgggttaggaagtagccagtgaaaggtggcagatcactttgggcaagagcttgagtcagcattgggcctcggcaagtgtaaaacagaagactgtgtaaatttgaacatggcaactgtaaattgcaatgcattgtcatagtaagaaaaaagaagtaaaattggtatttacagccaaatggtgcttttccactgtcacatatgatggacagtgacaaaattatcatctcagctatcacacttttgagtcatgccagatctttaagttttctgtgtctcatacagataaaaataaaggcttgattgtggcatttgttattcttgtttgcttttaaaactagttgtctatcttcttgtcttctcctgggattgaccccaaacccagaaaggttaatttactattggaagcccatttttacagcacacaggcctcaatttattttaagagcatgtttgccaactctgtgctgctttagccctgtaaacatgagtcttaagggaatttttaagaattggcaatagtgggagtttcacattctgctagcagtcttctgcaagtcgtgtttcacattgtctctgaaacatttatctgagacactgccttctgaggttcatcttgattaattatatatatgtatatagatccttaatgctttcaggatttatttttcataaactatccgaattgacctccttggctgcttacattgttttccaccccatttccttcctcataggcatgtatacatactgcaactcctagacattcaaatacatgttttatttttcaataacttgggcatttcatttcaccctggaaaatgtaatcaaactacataacagtgtcattcatttt

SEQ ID NO: 44495 - DNA, 1089 bp, Homo sapiens
tattgataaagaatttattttctgtcacctttaaggagagcagagggtggtacagcctttgtattattttttcttttttaaaaaaagttttgtttgaagcctccttcatgaaaacttcagctgtcaaatcttggcaaaaaatgtgtgttcatctatatgatagttcttaggagaatcaatagctatatttttctttctttttttctaccagagaagaaacttcagaaacagcattaagaaagttttgtgtgcagtcttttagcagcaactttttggagtcacagaacatgtatacgttattgtatgtattgcctgaattgaatcgagatttataggcagttttagaaaatagctcctcttgcctttgtactgttactcatatggtatataccctgcgtgccaagttttctcttttccctccaaatgcacacaaacctgttgaccagttctcaagcacttcatagctggacatacgcatctacgtacgtacattttgaagaaacttgttcgagaaggactttgtaattaatttcgattgtgatatttttctttatagaatatctattatcattgtaaccctttttaaatggaaattttttgtttgttttttgtttttttttgagatggagtctcgctctgtcacccaggctggagtacagtggtgtgatctcagctcactgcaacctccacctctggggttcaagcaattctcctgcctcagcctcccgagtagctgggattacaggcgcccgccaccacacccggctgatttttttgtatttttagtagagacggggtttcaccatattggccaggctggtcttgaacttctgaccttgtgatccacctgccttagcctcccaaagtgctgggattacaggcatgagccaccgtgcctggcatttaaatggaaattttaaagctccatgaaaaatatagtatagtgaatccccatatcccatgacacagttgtaacaattcttgtttcatccacatatctagtcactctacatatgtggtgagtggtgaggaaaagtagtacaattttaaacaggttggtgaattttatggcagggaaatattccaaaa

SEQ ID NO: 44496 - DNA, 1032 bp, Homo sapiens
ctgattgttgccattattaatactactaacaacagctaaaagaatgttcattgaagtgtttttgtaacagtagaaaattggaagcaatccaaaccgaccatcctcgaggactggctgaattaattatggtacatgcctgcaatggaacactagaccatcagttatagccctgtgtgctgattcaaaaagatgttgacgagctatccactgaaaaaaacaccatgaaaggattttaaaaaagcattttttttaaatactactttttgaagttttagagtaggtacttattcataaaaagatgggaaaacattttaatctaagataaagtgcttcccatctgtactatttctggagtttgcacatagcttagagaattatgattacatgatcatgtgaatgtctttttactgtgagcaccaaacacatgcttgccactgagcaggtgcttagtttgtatttgttttgttttgaactgcccaactattttgcttgagagatctagaggtaaggaatctttgaattggattgtagtcctcactggccataggaccttcaccatataatttaacctctttgagccttaagtatttcatctttaaaatgagggttgtgaaaaattattatttaatatttcttttgacaaactaactcccaatttacacaaaatatacagaacagaatatgaattttagattaagactgctattttcttaggaaatagagaaggcttatgacttacaatttaaaaaatcaagatttaattagtactgccagaaaggtctctgtatatttccacagtttcccatgcagtgctttataattatttaattgggttaggttgatagactatataattagatagtgaagtttaaatattccaaaaaaattcagaatcaatttttaaaaaaagagaatcaatatgttatggtagaatttcttgtctttgaaattttgttatttttaattgagttttattttaataggggttttttggttagattctcatatttagtttgcttattatatttcaca

SEQ ID NO: 44497 - DNA, 1032 bp, Homo sapiens
aggtgttttttaaaaactgaaattatgcctcattatgcattgtttaaaaataacttttaaatgattatgaaagtaaaaatgtgttcttggtaaacactgcaacgaagtataaagagagaaaggaaaatgatccatttctcccaaatataaaggtaatcattagtatcattttggcatatgtatttatgtatgtatgtatttattttttctgagacagtctctcgctctgtcgccaggctggagtgcagtggcgtgttctcggctcactgcgacctctgcttcccgggtttgagcaattctcctgcctcagcctccctagtagctgagactacaggtgtgcaccaccacgcctggctaatttttgtacttttagtagaggtgtggtttcaccatgttggccaggccggtctcgaactcctgacctcaggtgatccgcctgcctcagcctccgaaagtgctgggattacaggtgtgagccactgtgctgggctatatgtatgtatttctttgtgatggtgtccttaggcttttttcagtactgtacatatagaaaacaaaatgaagaccaaatagtgtgttcagcctggtatcttttcacttgtgagaaatttttcgtggggtttaaagcatgttttttaatgttagcattgtattatttgaccatttcactgtttttggacatttaatttgcttctagtttttcattgttttatatataaaatgtatattgttctccctcattgtctaaatctttctctttgccacactacacttcatgtttcttaggaggaagatttaatagtcttttaagcttgtcatgaagatgaatttttagaaaatgcttgatcaacatcaattttactttaacctttggtctcgtcatcattcatcatattctattactttagcagcattcaaagataatgaaagagattcagataaattcttgttactctcagatcaaattcatttacaataaatatgtgaatcttgatgatcagaagctaaaatacttattgaacctggacatca

SEQ ID NO: 44498 - DNA, 1145 bp, Homo sapiens
actgggtccaaaactgaagccactgtctgacttttgggattatctgtatctctcctttcttcctttttacctccaatctctgaggattaaagattttttttgtctgcattagctgagatattagtttcataatgtagccaattcatttactatttttaattcagaatgacaaataaactggatttttttcacctgtaatttgatctgtgattgttgaaacacgtaaaacatatttgaacaaaaacattccaacacagtttataaatgtgttatcctctgtggtaaggacaaagtcatgagactcgtttttgctcaaggatataccacatttgcatcttaaatacaactgttaatattctcttcttgttaattcaggcagggtagcttttcctgagtgacagaaatgtagatgattatgtgaaataatgagttgattggttcatatctgggttgtcattttggctttttggattgtcttatgaaaattttctgagggcagtactcttttttgtagagttgggattataaaactgtgaaatgttctcttttacctttgtcttgcctctgaaacattttttgggttaaattctttaaaaaaaaagaagtcccattgactgtgtatgtgctattaactctagcatcgcttccatgatctggtgttgtctaacatttgattcgtccccttttgtacattagcatatcccagcagctcgtggaagcatttgtgaacgaagaaaccgaggctatgagagattaagtgatttactctagaccacaggtaacaatgtctgatgtaagtttgggtcttcactccaaacctgtacattctactggattaaaggttcttaacctgctttgtgccaagttgcactttggcattctggtgaagcctgtggatccattttacttttaaatacaaaaaatatggccgggtgcggtggctcacgcctgtaatcccagaactttgggaggccgagacgggcagatcacgaggtcaggagattgagaccatcctggctaacacggtgaaaccctgtctctactaaaaaacacaaaaaattagccgggtgtggtggcgggcgcctgtagtcccagctactcgggaggctgaggcgggagaatggcatgaacctgggaggctggag

SEQ ID NO: 44499 - DNA, 1120 bp, Homo sapiens
ttcactctatcttctcctgtgtggcttttctcgtgtctgatctcagcttctcacttgaggatcatgacttattttcttcttgaaagagtggtctttctgccatcattcatttcctcaagcctctgaggcctgctctttgaagtctagggactttggtgtctggaagcccaggaaggttgcggtttggtttggcttctgggtaggggttggaaggaaggtccaatgcttgggccagtcctcccagtgtggggacgactgggagatcagggagctagctcagggagctccccgtgtgctcaaacacacagaagcatctgaggagccctaactaataaagagctaagaaaacctctagaatttgctttagctcatatgggcttttacccagtgcttccttttcacctcatcaccgtgtgctacagtcacagggaatgcgtataatgatgtcggattggcttcatttggtagttacgctaaattcttcagatgcaatttgtttttttgttgacatagtggtcatctcatgactttaaacaataagataaaatattgattgctgtgtgtcagttttgagaatggatctgaggaatgaaatgaaaatcagttattaaaatcaggataaatttgatttaaatcaaaaatattaaagcagcatttaaggtcaacagctcccccaaaaacattgttttgttatgcaaccagctaggttacggattctgaatatcatccttataatcatttaaacaaattattttaacaaaatacctctggcagccctcaattcatttcccttcttgaaacttgtactttttggtgtgatggctcaggcctgtaatcccagcactttgggagaccaaggcaggaggatcccttgagcccaggagatcgagcttggaagtgtactatgtttgcatccctgcactccagcctgggtgacagagtgacaccccatctcaaagaaaaaaaaaaaaaagaaacttgtgcttttagcaagaagagatggctttaactgtgcatgcatacttacagtaaaaaataaggccaatcacctgtttctttttccttggtaggaaaaatgaggccagctaagcagcttttgtttaattttgtgggacagcaa

SEQ ID NO: 44500 - DNA, 1046 bp, Homo sapiens
gagggaaggagctaaggcccattaatgcatgaataagtgtgtaggattaggggaggaaagttgaagtttatatagcatacatttccccagagattacaattttgtgcatagtataaaatgaagagtgtagttatttataatgaacaattagcagtgcattagaaaaaataaaggagtagtgctgtggggtgcatctcgaaatcttaaaattattcttccttctggttttatggctgttagatttaacctaatttctttagggcattcgtcatatgtatggatatggatgactaaattacttggatgttattgcactggtttttgatcttgctgttttataattgattttattttgatgttgcttttccagctttcggaaaatgtgattgatcgaatgaaggaatcctctccatctggttcgaagtctcagcggtattctggtgcttatggtgcctcaggtattgctgaattttaattttagggtttttaggagataaattataagtggaaaaagttgactcaatagtcaagttctctagcattctgtctttcgttatttagatgtttagcttttaataaggaatattagaaatcagtattggggtttcttttaaaatgttttgtactaagaatgaaactattttcaaacagtctttgaaaattttgttttctcttcccactcttgaatcctctactaggctttggaaagttacttcatatctttttgtgtaaaatggattgcttatagggatattagagatttaggaataaatatttatttaaaaaatcgaacttagaaaatattgatttgctattttcaaattgtgaagtattccaaatgattttattttctaataaatttcttctaagtttataaaaggtttagtttgtcacagtcagtcttagttattgatggaaatgtggtggtaaataaaatccataaagaattattaagcctaattttatctgtaggtcctgctggataagagacttaatgctgtttcttctcccttttctctctcctgccacactcatctgtttatcca

SEQ ID NO: 44501 - DNA, 1054 bp, Homo sapiens
cagctggctctggcattttcaaatagaaagtcttcttgtcttccaagaagggagtcgtagttttttccttcaaagagcacacacagcatttgatctgtagcctttcccttttccatcttatttccattctggtttgggccctgagatacaagtaacagttgaggtatagactatttagttcactgatgtatcacagggccttgattagtgcctggcctgggagacatttgttgaatgaatgacttaatatataggagcttgcaatctagtggaaaggcagaaaggtgaatgtggaaaggctaattcctgttctttcattgagactgtattggaagtttgagaaaggaacagcaggcacaaggaatggtagctttaggtaggcagggttggaatggagtggacaactgttttggtcagtgaaggcttggatgtttagactgcgtcttgaaaggtgactccctcccaatggtacaggagagagggcaatgtaggcgtgtgtaaaggcaaggagatggacgtagaacaggatatgtaatattaaggaaaaaaactgtagaatttgaggttggagagttaggccatcaccaaatgatgaagtcttgaatgctgtacaaagaatttgaatttttctgtaaacagacagtagctattgaagaatttgaagtagggagttaccattatcacatttgcattttaagcggatggtacaggaattagggcaggagaaatgggatgagagaagagaggaattcattaaatatttagggattgatgaagtcagagctaagaatgagagagaaagaagagttaagaacaagccctatgtttgaatttaggaagctgggtgttggtggtgtcattaatgaggtaaggaaggcaggagaaagaggagatatgcggcaaacgtgagatcaattttggacactttgggtgtgaggtgcttctggtttgccagaaggaaggtgttcattaggcacttcagtgtggagaccgggcttctgagagataggtcttaagctcgagtgaatgcatttattaatggaatttattagtt

SEQ ID NO: 44502 - DNA, 1484 bp, Homo sapiens
actcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcagaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacattcataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattg

SEQ ID NO: 44503 - DNA, 1026 bp, Homo sapiens
caggatttgaatatcaaatttatattcaccttacccatgcctttattattatttttggcctcagttgtaaacctcttcagcgtgatctttgcagactgaagaggttcattattttttaccgtacctccgctcgtacctgcttcctccccaaccgctctctagcgtggtcctcttggcccttttagtccctttctctgcccattagctagttctgctggccttttatgaggtactgtgaccaggacaatactatgtatttgagtagaaaacctgggatggttcatcttcttaatttcttttaatccttgcctgaggccttttgcttgatcaccaaaaatctgagagggtgctaatgatactagctaatgtgaaatgctactgttattacagcccatagttctataatctgaatatcctcccccttatccaactatgccaacattttaaaacaatgttaagtcattcagagatttaaaaaaaacaagcctcccccagagaatggatgattggattattttctgagcattgaatcctgctgcttgcacctgatagcctgtttttccactcgcacagtgtgtcttaggacacagatttggtccccctaaagacaggaaaagcaacagatcctagtaaggactgggtcagcctttcatctggactcttgagagcagaatgcaacatcacatctggtctatttctgtttttgtctcctgatgaaataatcgattggtcagcaaattgttggagacagactaaacagtactaaggaaaagtgttggttagaaactagtcagtatcctgattcattcatatgcatacttctgtggactctgctggaaagtaatcctgtctgtcatactttagtgatttgtactttcatgcaccatctgactgtaaatatcactgggaaattcatatctgtgctttcctaaggtgtttttcttcttttttttcttttttgcagatacagtatattcaaatatacctccattgccctggtgtctgtggggatatttatttgcactt

SEQ ID NO: 44504 - DNA, 1095 bp, Homo sapiens
gctggttagtttcttcagcttgaagactcttatattttagaacatttgcatccattccaaagcttgaagaagcagtctcccacttgctgctgagaggttttatgtcttcattctttatggcccagatttgagaatgtttattcttcttggggcctttgagaggtgataaactttccaatgacctgtggggcttagactggacccattctgaagagtttgccataacatccccttggattacaaaagggtgatttctgggtgctgtccaagatgtgctgtatttctttatatttctgcaagtagccggatttagtctagaaaagaaatgaaatacgtgaatttttgtccatcatggacctactttgtagtcctaggtatgttgtcatagtataaataatatttttccttttagtaagttcataacttcttaaagtttaagaattttaccatcatttagaagtcttcatctctgatcatgattttttttttagcactattccaatcctgtatttctaaatgcctagaggatatgtttatttggatacctactctaacctcagccttcctaatataatagccactctgggccccagctccttacctatatatctagttaaagtagatggtcactaaaaagtaaagtagttgtttgctctaaaaatctattctgtttattctattagaatggattcagtatatatgctatgagatttttttctataaccagtaaaaaaatcaacgtgagtctaagagagggaagttttcctcgggggagcttttgtaaactaataattgcagccacttaaaatctctgtttttttagcattccattttttaaccatagaatttcagctatactttcaattaaacttttaaattttgagataactgtagacttaactgcatttgagagaagtaatacagagagatcccatgaactcttcacccaatttccccaaaatagcttgcaaaaccatagaacaatatcacaatcaggatattgacattgatgtagtcaagatagagaacactgcccccatgttgccctcttgtagtacctgcttccctcctttcccatcccctccttaattcctg

SEQ ID NO: 44505 - DNA, 1026 bp, Homo sapiens
gcagtgctctgggaactcattactgggtcaagacaagatgtcacctggtgatgaaatcccatcatatactcattactttaaaaactaatacatattttttcctgacaatggtagtatgaattatagaaaacttagacgtttttgtttgtttgtttgtttttgagatggagcctcactctgtcacccaggctggagtgcagtggtgcgatcttggctcactgcaatctctgcctcccggggtcaagcaagtctcctgcctcagcctcccgagtagctgggactacaggcacccgccaccatgcctggctaatttttgtatttttggtagagatgggtttcaccatgttggccaggctggtcttgattgaactcctgacctcaaatgatccacccaccttggcctcccaaagtgctgggattacaggcatgagccaccatgcctggccagaagatattttaaaaataataataaaaaagataaccttttatcccatcatacacataaaaccactgttaatattctaccaatattttcttcctgtactgatgtatttttacataatcatgatgttgaatgtaatgttttttcactagatttagtaaacatttttcaaagctgttaaatattcttcaaaaacatgatcaatggctgtgcaatagttcatgtgggatcatccattacactattactagacaaattgtttccacttttcaccattataagtgaagacgctgtgtgaatcgtgtttggaatctgatttttctcaggtgatctacctataagtgcaatcattggatcaagggtagaaatatcttttagtgatcttgctaaatactgcctaactggcctacagaaaatttgctaatcatagtccctctaattgtatataaaagtgcccactttgttatactcttttaaaaaattcttttcactccgttttaaatcagaagggctttgtccagttggtctctgaaacagtggtctgcacactgtattttacatatgtgtattttccagtatgggat

SEQ ID NO: 44506 - DNA, 1049 bp, Homo sapiens
catcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgtgcagccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctgga

SEQ ID NO: 44507 - DNA, 1065 bp, Homo sapiens
tcagcagggcctgtgtggagcaaagtctccaggaaggggctgtcaggagggcaggccctgcactctcccagggtgagctgagcactaccctcgcaggtcagagctctcctctccactctgtaattaccgagaaccccgcaaaatgctgcagcctaggcctagaccccctgcggtgtacaccctggtgtgggggaccctttcctggctgacttgtccccaccctgcttgtgacagtgtgcagagaagaaaccagaagccagtggcccagaggctgagccctgcccagagctccacacggagccagtggagccactgactcgggcatcctcggcaggccctgagggtggaggagtccgccccgagcagccctttattgtgctgggacaggaggagtacggggaacaccactcatccatcatgcactgcaggtgggttgggcctggggccaaggaaaccctgggaagctcagattttcaggcagtacacgtggaggtgtggccagcaggagatggcggagaatgggggcttggacgagggccacagtcatggcagtagagtcatgggagtcggttggagctgccagtggactggtcagcctgtctgcccttttttttttttccttattgagacagagtcttgctctgtcacctaggctggagtgcagtggcacgatcttggctcactgcaaccttgccctcccaggctcaagcgattctcgtgcctcagcctcccaagtagctggaattacagatgcctgccaccacacccatctgatttttatatttgtagtagagacggggtttcaccatgttggccaggctggtcttgaactcctggcttcaagtgatctgcccatctcagcctcccacagtgctgggattacaggcgtaagccaccgcaccgggcctctctgccctttctaattgtgtttctctcagttttaggaacaagttacactttattttagccccccaaactcactcaattttaatttgctttatgatggtacttttaggtaaatacctgatttgtaatttaccatttgtaagtttttacttaagcaca

SEQ ID NO: 44508 - DNA, 1064 bp, Homo sapiens
caaaggagagaagtctctctccatcagtctactgagtgttttctcagtctttttactcaattaccagagacagcagaccctctatctgcccaataactactcttactcacctgtcagcttattccaaactgcctttgatcctaaacgagtatattcttgtttttttttttttccttctctctatttttattttgtttgagacactctcgcccaggctggagggcagtggtgcgacgtcggctcactgcagcctctgcctcccaggttcaagtgagtctcctgcctcagcctcccaaatagctgggattacaggcatatgccaccatgcctggctaatttttgtatttttagtacagacagggtttcacattgttggccaggctggtctcgagctcctgacctcagatgatccacctgccttggcctcccaaagtgctgggattacaggcgtgacccactgcgcccagccttctctctcttttaaatcaaaacaacacatttaaacagaaatcattgtctggattttggagcagattggggaacgactaatgcactgtaaaattttgaatcaataaagatttttgacattgtaaaacttgggcattactcagttcccccaacttctaaggcaattctagctcctataaaaagtcacttaacacttctcaacaatatgactaaaattcagagttttacaaatgtgtttttaaataaatttttttcagtaaaacagttctagttcagtatacagcactagcatatctgaagtaagaatattgctgtttctgatttgtatttgaaaatattttcatctagtcttcttttttgccttccttcttttgaaataagattcaatattgactgagaattggttctgtcaagattgtctctggcaatctgtccctaattcaactataaattattgctaaggatgaacacttaaataactatatattttaaatgatttttaaactacggccccttagtaatgtgatgagcatataaatttttgaattcagggtcttttgaaactctggagtatcatatgtatgtataggtctgga

SEQ ID NO: 44509 - DNA, 1029 bp, Homo sapiens
gttttaaaaaaatattctgccaagttgtttttattccatgatgttaaaaattatttggaaaacataagtcagtaagcattgttgtttcaagatatacctcaaaaaatatttgaaactgtttaggattggatttttttttcatgtttttgttaatttaaactttacttttgagagggcatttttctttaaattttctttgtttctatatgaactgttttaacagtgacttgattgaattttgagtcatgtgtgaaacaagtcacttgtagtcaaataattttcagttataatcaggagaaccgatctcattcatctataattctctgacctagaagtagtcatctcattttcagtcaattggatcattgtactgttaacattttactatttttcaattacttcaaaggtaaacttgaattttcagatgctgtatgttaatttactagttaatatttatagctttcatttttttctagtacataatttatgctttcaaaacatggatttgtaatttttctcttttaaaaatcagttttcacttctgtaaatcaaggtttaattttttcacaaaatactattaatatttaccatttactaggagtatctataagggtccaattggcttggaaaagaatggctttcctggtctttttttttttttttttttttggtagtatgtttataatctaaatctattgtatttgttcttatctctgaaacaatattactcaggatatatttagaatataactactttccaagtacttgataagtttatattttaaaattcatgtcttgtttcacacctggattccaaacattaagcatgtattttatatatgtatcagtattccaaatattgaaatcatttttaaagggactgttaacaaatctagtcacccataactagaccatgactgacttttccacaggggaagaagaggtgaaggtttcgaccatgccactgtcaacctcttcccattcattacaacaaggacagcagcctacaagtctccacactactgtggc

SEQ ID NO: 44510 - DNA, 1052 bp, Homo sapiens
ttatccctgttccctttgggaccgacaatatttcatgttttagacgagtagctaggttaagagaatatagtttgtggctgttgacatagtgaaatttaccgttgatacagtgaagttaatttacataagcctggtagcacgtaatgtagttatttgcacagtgttgggactcttatttgttcatttaattatggtagttagtaggtaaccagagtgacatttttcagtcctcttcttctacatgatacttacttgtgaaacaatgtgttcagttccaaatactccttttatttccttccattcaagatagcatattagaatgtaattttctttgattttactttgctttaatcattgagaaatgtggcattttaattactagtagtgtatctcataattgattataacattcattaaaagttaaagttaagttctcccaaatcatcaaaacatttaaagattagaccaattacagtgaatatgagggtttctatttgcccatcaatgaattaggacatgtgggacatattaaagaagtttaagatatggataaaatttccacatacttaaagtatagttgaagagactaaaataatgtgtgaaagtggtaactatatgtctgatactggaatctgagagacatcaatgtaccctgtaattcttggggaggcttcattgaataagtaggaattgatccctactatcatatcttagatttgggttagcagcaggggaagagaaaaggccttttatgttgatggaaacctcctgagtaaaggcatagaggcaggaattagtatgtcattacactgagaagtaatacagctacctcctataacaggaggtgcttcttaaattgtatagatataatggatgagaagatgagaaactctgacaatgaggcaaaatggcatggacttggtatgataggaagtaggatgcctttatgggattctagttattagctgtcttctttttgtgcttttatttgacttattacatgacgatctttgattttcttccaatttcatagtcatcatattatcccttaa

SEQ ID NO: 44511 - DNA, 1043 bp, Homo sapiens
tgtttacctttctgtccttaccttccattattattccagctatcccatttgttagctaaactaaatacttagctctgccaacactgtctccgacattttgacccttgacacaggaggtattcctacctttaatgctgttctttcccctttccccctttcttctcctgctgagtaaatctttttaaggacctacttaaatttgaactcccctaggaaactttccctaattgccccacttgtagtagctttgctttcttcttaagatttatggcattgtttttgtttgtttgtttaaacaattcatttgatagcaagcactggctgatgtttgtttgtacttaccttatttgtgcacttatcttctttcccccaaatacttctaaacttagtgggctcaggtctatatctttaaactgtttgcattacccatattacttaatattcattgatttattgctattttatgaataataagtaaaaatgctcttcaagtaaatttcaaatctgtttgcttataatcaagaacatctggcaatgtctgcagaagatgcacctgggattcagattgggtactaacccttgttagatattttttttagagcaattaaatatggtatcagtaagttatctgtttgaaaggggactttgtgtatattttcagggaataaaataattttaagaaatttggaatcttaatttttttcctataacacagtatcagaacaatacatttgagtaacgatagtcatgtaccacatatcaatgttttgttttggtcaacaatggctggaccacatatacaatggtggttctatataattagaaataacttttttactgtaccttttctatttttagatatatttagatacacaaatgcttacccttatgttacattgcctacagtattcaaaacagtaacatgctgtacaggtttgcagcgtaggagcactaggcactatatagcctcagtgtgtagtaaaccatgccatctaggtttatgtgagtgcacactttaatgtttccacaatgacaaaatcacc

SEQ ID NO: 44512 - DNA, 1072 bp, Homo sapiens
cttatagattgaggctctaagcttaaaatgtgattttctcttattttcaattaagccagagtacaaatcttaagattaccatagctattaatcctcactgaaccctgacatggtccccgatgcacatatatgttagtaagtgaatttttctataatatattttactcttatttcacctagtgagcagaaaattctaaaaaaggaatttgtcatctgctccccttcattattatgaattcgagagtatatcagtcttaatgagttttgaactatatatgtgctatgaataagttgctttgaaatgatgaatacaagtaatgagagtgggaagtgatgaagccttgcagtaatgatgcttaaggactggctattttattatttttaagtttggggctttgaaatatcttcatttagattgagatgctatttaagtaccaactgtgaaaggaatagtaactaggtaggctgctgtgcccaagacagtgagcaggcctagttacaagaattgtggggtatgcagatcactcggtgtaaatggttatgacttgatattgtggctgaaacaagccatcattgaggaaatggagatgttcggctttagatttaggtggagcgagggtggaataaaagttttgagtcttctgtgttcatttaatatcctcagtaggcctgtgtggtatatattgttttcttactacgggtaaaaaaacttaagtctcagagagtttaaacagtttaccagtatcccacacaaataagcagtagataagattctgaccaaagtctctgtgactttaaagcccaagctcatccctcattctcccactcttcagtctagaagaggtaaaattcttaagagcagctcttaggaaaaactttttaaaacataaatcaaatttgcttaaatgaaactgtgccataactatatgtagtttgatcttgaaaatatctggtgcttgaggcttgttatctgaagacagatgtagtggatggattgtaaattccaaggaattgatgttatttttagcaaactttccctgagccacagattggtggcagtaatggattagct

SEQ ID NO: 44513 - DNA, 1036 bp, Homo sapiens
catcccaaagctgtgcacgttaagtgaattgacatgtccaaattgtcccattgtgagtgagtgtgagtgtttatgtgtgtgaggggaccctgccaaggttggttcctgccttgccctctgatttgctaggatgagctctggccacctgcaaccctgaaccccagtaagtaggttggaagatgaatgcatgaataaatacaaattattgtaaaatgtaaatttgtaaagtgttagtgtattttcttatacactaattccttgcattgtgtattttcttagtcttttttcttcttgcgaatgcctataaaccattatacacagagtaccttggtttgttacatttgaaaacctaatacatattattatgaataatttccccatgtcactaaaacataattttttatggctatgtagtatttcactatatgttcatattttaaatttattaagccaaccttctgctattgtatgttatgttgactttgttgatattattgataacactgtgatatgaacatctttacatataaatgttatatggttgtaacatataaatggttatagctttgattgttcctacaagtagaactgctgagtcagaatatgagagtacctatttccttgaattgggtatttttttttgccttctgcatacttgccaatttgataaacaaaaaaagctgtctcattttaacttgtatttgattaacagagtgaactttttatgcactgtgagtttatgtttcccatgttttatttgtgtgtttaaaagttttatatgagttacagagatctgaacttccccaatcagttgatcaattatttgtgtttcaaaatacattgaatttgtaaatcagtattggaagaatttatattctgtgacactgaggccgggcctggtggcacatgcctgtaatcccagaacttcatgaggctgagacaggcggatcacttcaggccaggagttcgagagcagcctgggcaacaaagcaagacccctgcctctacaaaaaacaaaaacaaacattgactcctc

SEQ ID NO: 44514 - DNA, 1023 bp, Homo sapiens
ccagtagactctcccagtcactttaacagtctctcccaataaaagtttccacaaatttccagactgccccttgagtgcttccctcattgagaactactgccttaaacctatgatgctgatgcaggacaacctgtgaccggcctgactgaaccctttggagcaggtatcttagctatgacgctggttgctgagttggtatgcatccagctggaatattgaatgcagttccaaactccactagccagaaagctttttcaaactctgctcttctctctttatcaaccctgagactttgctacggatgacttaagggtcattgtgttagccactgttactatcatatccctcaggggttttgggtggaaaagagattgaaactcagtgtaattacctcaccttctaatccattagaattggctacagcaaacataacagttaccttatacttacaagcacctaaaataaaatataagattaattactttctattaattaggtagaagactaagaattaatgatacacccgccgtagatttattcatgaagctttgattctatcaaatgcagaacataatagctaaattataagtctgtaagaatattatcaaatatgaatgggaagaaatactttacacacacttgaatagttacatgcagaaagctttcatttgcagagagcttgctatttggagagattgtaggaacagtaggtctaaagatacattctaggaaaacagaattttgaggtagttgcaaattatgtgagatgtctttttatcaagttacataccggtcaaattagccaaggttaagtttgtaagagaagctgaaagaatgcatatagtgttcacaaagtaaaggagatgaggtacgtaggtaccaccaagaagtaaccaggtaataaagaaagaaacgtgtaaatttgtttccgaaatgttacgtaccaggaaaagtaggggaaaaagcctcatgagacagatgagaaatggtaaaactgattgacataggaaactgtatgcacaa

SEQ ID NO: 44515 - DNA, 1024 bp, Homo sapiens
aatctagagtgttcaagttaatatggaaagtttaaattcattgtttttcccttgcctgggcagcctatttcttatcaaccgcttgccatttgctaatactttgaggcccactattgttacaaatccgtgtaattctttttgtttaatgctaagatagttcagtttttcagtaagcatttattgagtacctgcaatatgccaggcattatttaagacactgagcatatactgataaacaagtagtagtagataaataagtagtaccttcctttttacgaaagtaacaatatgagaagtgttgtgtgctgtaaaggcacaagggatagcattccaccttgggagggaggtacgtacccctctgctgtctttggggtaaagtgcttctggcacagcaactatacaaatgcttctggatgagaaagacctcaatctgcaagtgatttgtttggctggaagattagattgcagtggtgagaaagaaggtgccaaggtaagtggtaatggatcatgaagggctttctaaccacgctaaggagtttgcactttatcctaaaggcagtggaaaacttttgaatgttcttaagaacagagtgacacggttagatttgtgctttgacagtaccattctggctgcagtgtgaacatgtcatcataattacataccaatctcatgttgttataaaggtgttacacccaaacgttggccagaaaacatttccataaaccagtggccttcaaccttatccgactcagtgtccactttttaaaaacgaatgtaacaccccttgactttcatgaaatgacttcttgataatataatttgtctacacacataatttgaaaaagtatatataaacaaggaataaaaggaaagtaattataaaaagactatttgtacatataaatgcttgtacattcctactctagaaccttgctattcaaggtgtggcctctgggcccataacattaatatcactggagagcttattaggcaaactcttcagccctgcctcagatctgctgg

SEQ ID NO: 44516 - DNA, 1048 bp, Homo sapiens
ttgagcccggagttcaagaccagcctttgcaacacagggagaccccatctatatagatatttaaaaaattagctgggtgtggtggtgcacacctgtggttccagctactcaggtggctgaggtgggaggatttgctttataaagcccagcattttgaggctgcagtgagctatgatcccaccactcactgcactgtagcctgggtgagagagtgagactgtgtctcaaaaacaagaaaccaaaagtgaaaacataaaatatttgtcctcttgttactggcttatttcacttaaagcatagtgttttcagggttcattcatgttgtagcatgtatcagaatttgattccttttgtgactgaatatagtctttttttattattatacaacattttatttaaaaaaattattttcatagaatacattttcacattagagattcccattgtgcgaaaataacaatttattacttatagttttatatttgtggacagattgttttagaacaagtagaacacatttgagaaataaatctaagtttacaattggtaatattttgatacgtctacaaggggaaacttgcccttaaatggaacttctctatattcagaagcactccaagcatttctccctaggatttagaaatttataatgtgagatatcagcacttcctaattttaaaatttccctggtatatgtaaccatcagtaggtggtatctactgactagagagggaagttttcgaaaattaatcactgtctaattttctacaaagtttttattcatgaattaagagtatttccctttgtccattattcccagggcaaatatggaagtttgatcatatactaatagtaataaagctggattctctttaagagattgataaattaaaaggcaaaagctcatatatcatgtttagctatactgtgagtcttataagaagctgggaggcaaccccattaactcaccagaatacagaactcagtctcacaatttcttagatatagttcctctcaaaccttttcctcaaagattaaattctgaaaa

SEQ ID NO: 44517 - DNA, 1040 bp, Homo sapiens
ctaggcataggaacactgctcaaggtgccaatatattggctagcggagtgccaagatttacgtgtataacgtaagacacttatggaataatacaagtcattgtatatacaggagctgtagagttcagagaacggaagagtgtatgggtcaatagtttactttttattatctccgaccagctgataaaagacaataattaaatacatacatatatacataaaatagataatttactttcaaggctgctattctgcctataattttatgtcttgataatcttgcttcccaaaacataattttatcagatttctttaaacttagtctttaacttgattcttttatgcatacttattaccattttagttaggaagatgctacttttaggcatgtgtcacaactcataataattgcaaaatattctacagtttaatggtttttttgaggaccctcagattttataagtttataataaagtgtcttaagtttcttaaaagtatcaactgttttcgtttgtttgagtggtctctgaatgaattggcatgcttagagactttttttttttaatcagaatctcttatctctgtttccatactgtctcccagtcttctcactgaaggtttactatgtaatttagcataactgttctgagtataccagagtttagagttgcaaggtatgttctaaaagactaccttttctccctcaacccactgttgggtgcttccctccaagtcttcaccaccagccgaatagtggaatgaaattacatatagtaggcttaactgtaagggttctgcagacatggaattaagtcgagattttgttcatggcttaaaaatctgttttaagtttgaggtcaattatatacaatgaaatacataatcttaaataagtgttagatgagttttgacaaatgcatgcacctgtgtaacccacatctttatcaagatatagaacatttccatcactccagaagcttctctcatactccttcctactcaatacctgtctcccagattcaacctttgttctgattctgt

SEQ ID NO: 44518 - DNA, 1024 bp, Homo sapiens
ctttatgagtgtcatagtgggttgctgtgggtgaggagaggagaaaacgactccctgtttgaaaaatcttttccaaactgttcgaaaatttgagattaaattgaattaatctcaaattattaatagtttatgttttttttttaattcatacagtgcttgggaagaaattggttttctgtgagtggccttgggggtgctttgggtgctttccttacccaggaaaagggaggagaggcagaaaataaagtggggaatagtagctgctgtggatttttgcctatggcattgatggcattgtttttttggctgcctttatctacataccttttcttttctagttaggctgtcattactagttggagaggctacatacagtctagccttttccaaatcaaactagcatccctgtcctggtttgtttgttttaatctctccgtctcaaaacctgacaaatttatgtcttttctctgcctgaagagcaggggaaactggaaagagaagaaaatgataatgttgtagttaggcactccctatcttttaatatgtcaggattgttttatgaaaaaaacctctgcctttggattttaattttatgtaatcagttataaaataattgaattctctatgagtccttagaaaccctttaaaagatcctttagccgtaaagttggtgataggttgaagagtacctatatgagttaaatgctttggggattttttttgcttctcctaaatttttttctgtcatacaggacctagtcctacatgtgaattttgcttccaaaaagtaaagctggcagtcttttaatcccagcactttgggaggccgaggcaggtggatcacgaagtcaggagttcgagaccagcctggccaacatggtgaaaccctgtctctactaaaaatagaaaaattagccgggcatggtggcatgtgcctgtaatcccagctactcaggaggctgaggcaggagaatcacttgaacctaggaggcggaggttgcagtgagccaagaccatgccattg

SEQ ID NO: 44519 - DNA, 1035 bp, Homo sapiens
tttctagctaccaactccctttaaggatgaataaaggtaggtccgcaggctgaggaagtatacagggagattgtgaaatgaaaacttatcctttcatttacttcgatatctttgttttgcacaggtaatattaaaaaacaggtctggttaaacatcagccgtatatgttttggttggaattttttttttaagttctgtgaactttgaagtttttttaaaattctttgttttggtttgtagaccctgcattaagccaactttctggatctgttgtgtatttctggatagcatactttgttttgtgaaggaaaattttacattttattttaaagctgggggaaaaaagtaggtttcttgtttctcgctttgtaaatgaggtagatgaataatactgtattgccacttattatcttcatgcttccttcaatgtctcaggtattcctctactgtatgtagcatgtggatctcaaagtttcccacagttgagtctgaaaacatctcaactgtgcttataattttaaaattaaacttaattttaccattttctttattgttattataaaatataggacctatcataatgccatgaaccttttagtgacttgggaaatagtgattaagatgatgcaacatagtacattattgggaaataatctgtttttcgttggcatcgcctctatccttagacctctttcattctagtaatatgacagaaatatttttgacattttaaaacttcctcatttagctgatcgtgtgtgctgttgaaaatgaacactagaatagaaagccattgccttctccttggggggtttgttttaacaggggttttcatgttttaattttggatttgagatttgagttgagatatccattgtgtagagaatcttgagaaggattatccatctttcttgctgtcaccagtgtatgtgggagggaagaaaatatcaaatatagggtatacaggagaaccttagtatttgggaatatcttcagtgatagctgccaaatccagtgttttccccaggaaatttg

SEQ ID NO: 44520 - DNA, 1048 bp, Homo sapiens
ccgatttgcagtctttccttccaccacatctgtcatcttaaagctgccccttaagtatctagattatgctcctcctgctaacccacctgtttctcagccttcttgagaattgtccgttccttccctctttcctgtacagatcctttcaatatacacttccagaaaaagggaagccccgtggtggcccttgaaaagtaaaaggaagttgggaagtgaatgaagtgaggtaggatactattaaacgttatgagtgaagatcttttattcaggctactccggagaggaccgttttcgttttgctttctgtgatctatttgtcgcttattcgctctgttgtgttaggacttggctttttttcttttttttcgttttggaccggttttatcatgctactaagcgttctttggattgcctctccccaggacacttagtgtgggccctgatttataccaataaatattaaccccagcattacaaaataagataaatctggcgcacatacagaattcatctgtgaactccgctagcaaatataagtgatattttgattacatgtgggttatgtgtgggttctgtattgaggcttgatttttgactgagttttattgatgttcagcttaattgatgacattttatttatgatttgagtggaaatttcctctccagttaatatcagattttcttcttatttttggatttgggaagttctcttgacatttctaggatgatagttatcagaataaattgtcttgtcttgaaaatccattagttatgtatgcaaaagaaaaatcgacatttttatataaacctaagttcctcgtatttttctcatagaaaagaagggggctgggaaaagaatgacaaagctgtgcacatacatgcatttggtggaactcactgtcattgttatctacagtaaaaagcagaaaactggaagcaagaggtggcttatgatgtccatgttttggtgaaagcaaaattaagatgtactgactaatggtaaaatgggaagaagcagccctggctataatcagaccactgtgagata

SEQ ID NO: 44521 - DNA, 1039 bp, Homo sapiens
ctttaaaaatgagtttcaaaggtatattctggccaaaagaagtcagggtgaaatgtaacaatggttccaaaggtgtaatactggtgaaaatgacccttagttattcttaggaggtttttccgccttatgtccccaaagctggattcctgagactcaagccttacccttaccttacctttccttgaattccaaagtaaagtggaaggtggaagccaggcacagtggctcacgcctgtaatcccagcactatgggaggccaaggtgggcagatcacttcaggtcaggagtttgagaccagcctggccaacatgggaaaaccccatctctaccaataatacaaaaattagttgggtgtgatggcgcacgcagctccttgggagggtgaggcacaagaatcgcttgaacccaggaggcagaggttgcagtgagccgagatcgcaccactgcactccagcctgggcaacagaatgaaactgtctcagaaaaaaaaaaaagtggagggctgggagagacatgtaaagaattcttgggacctatgacatgaactgcagtctcatgctttttatatgcaggtcattgtggggtgcaggactggcaggcagagccactctgggaggaagtcaaaggctgctttctcagcccaatgccccgtttgctgtcacagtgtgctgtgaagatggattccccactgcagtgggtgtgctgctggcttggaaacagcagccttggggtggccaggttccctggagtggagtgtcccaatttctctgcacagtggagtggcttttgccctccgtttttctttatgggtggccactcatcctatccaactaactaggtcctgtgtcaggtcaacgatcttacccagataccagccagatcatcacacatcagccatgggatatttttctccaaggcttttacttccttaaaatatgattgctgattgagaagagagaatttaacaacagctttaatagcacctggccctcaatagacatttcactgtgtttgttctgaatgatgacgtaaaaccatt

SEQ ID NO: 44522 - DNA, 1039 bp, Homo sapiens; identical to SEQ ID NO: 44521

SEQ ID NO: 44523 - DNA, 1063 bp, Homo sapiens
agactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctacagctaatgtgtcagcagcatttttctcagttattatcaccttccttttgtagtcatctctacaactataccagaagcttgattgactcaaacatttagttaatcttatcccacttctagaaaaaaatgagtggagggaaaataaaacataaagatttaattgaaataaaccttaccagtctttgaaaggatttgcttttgtgtcagtctcctgacattgttttactgtaacttcagtaacgctcctggttgacggggagcagggtgtagccagcacatcccagatcgtcaggatcttcagggggcttgaagaaaatggagtcgtggttaaacctctgatcctttcattgctcatctaagttgctccacatttcttggagatctgcatttcccaaactcaactacgagcacttttttagagtgtaattttcaggatgagtgatcactttgaaccttaaaactgaacaa

SEQ ID NO: 44524 - DNA, 1619 bp, Homo sapiens
aagtgtttcaaataagaaaaaaataatttgtcacaggaatactttagcaaagtgatttactttttccccgtttcatactgcacatagggatattatttttaaagcctaattagataaatatatctaacttgctcaacgtgctcttcctaatcatctcatccatgatagtataaataaaagccagtgattgcctgggttacaattcttagtgcctgaaaaataatgtggcatttttataattaatccataatgttgccaacttgtttgtttttctgcagtagaatagactccactagtaaaggaatttttaattcttgatgtaaacattaacctgtgccatgtgagctagtcttacattcccttcccccagttgtgggctcatttaatgagccctttcctctcttttccagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacc

SEQ ID NO: 44525 - DNA, 1086 bp, Homo sapiens
acacacttttaagcaaccaggtctcatgagaactctactctatcacaagacagcacaagggggtgaggggtggtgccaaaccattagcacccgtgatccagtcacctcccaccaggccccacctccaacattgggaattatagtttgacttgagatttgggtggggacacagagccaaaccattttaattcattagtttgtgggactggggaaaactcaggctgttactgtaagtgttaccttctgattcagtcatttgtgaggattgcatagggttgcaatattggaacaacagagagaaaatgactagtcatattagtctgctaggtgccaccaagagcagtatttacctagaaataatttgaacatcacttacttaactataagaattgataaaaacacagtttttacagaccagaatataaaagttaatcttgacaaaatagaaaagctggcaaattaggaggtggagggagtgatgggaaggttgagaaagtatcttataaaattacttcatgagaattgatggaacaagaaatacaggtttaaataaatatcgtttacatttataaagaacaaaatattttaagtataagaaattgagaaggtctggggaagggtggtagtggtgagctaaaggcctatgtatgtagcaggaagtcgaaagataaaatctaaagttatagctcaaatatcagcatgagtatattatttaaagctatgcaaataattaaaaacaattaaaaaatggtttcttcaaggaagggatagggccaaatatacttaaattcttcagttacttcaaaactggttcatcttttttttttttttttttttttttgaggctgagtgagtcttgctcagttgcccaagctggagtgcagcatcacgatctcatctcagctcactgcaacctccgcctcctgggttcaagtgattctcatgccttagcctccgaagtagctaggattacaggcgtgtgccatcacatgaggctaatttttatgtttttagtagagatggggttttgccatgttggccgggctggtctctaactcctggcctcaggtgatccacctgcctagg

SEQ ID NO: 44526 - DNA, 1086 bp, Homo sapiens; identical to SEQ ID NO: 44525

SEQ ID NO: 44527 - DNA, 1091 bp, Homo sapiens
tcccagcattttgggacgctaaggtgggcggatcacaaggtcaggagatcgaggccagcctggctaacacagtgaaaccctatctctactaaaaatacaaaaaaatttagtcaggcatggtggtatgcacctgtaatcccagctactcgggaggctgaggcaggagaattgcttgaacccaagaggcggaggttgcagtgagccgaggttgtgccactgcactccagcctgggtgacagagcgagactccatctcaaaaaaaaaaaaagaaagaaatcattgcatccaaatgtttatacctgaactaaaaaagtgatggtagcaatggagaaccaaggacagatgggaaatcttaatagtatggtctgaagacttaagtaaacaagaactgcatactgtctccacatcttctggaagatggtagtgttcttcaccttgttggagaatattgaaaaaggagcaaggtttataggaaaagattacagattcattttgggagaggttgaattcaaggtatttatggaacttaaagtaggtaagtctgaaagccagtcctcagaatgaggacaataaaggttggacatggatgagatgattaggaagagcacgttgagcaagttataaagagtgttaaagacctgaatcctgtataaaggacagccagagaaagtaaaggaaggcaggggagagtagaaggagttggtgtgggagggagaggcaggctagacaggagaatgtggagataatactgtcttgagagttaggaccataatgagttaggaatatcactgttcagatactatatatgttgactagacttggcatttacaggacgttagtgacttatttcaaagtgttttcagaacagtataggtcaggttgcaaattgtctgtcatgtctgatttttccttgtgctttagaaagaaaaccctaggttgtagttgtccacatggcagcctaggtaatccttgtgtctcagctttccttgcagtaattatggctgtgtgtctaactaacttttaggctactgggatatgcacaaatgatgtgtgtcacttccaaatcattacaaaatatgaagccacttgct

SEQ ID NO: 44528 - DNA, 1091 bp, Homo sapiens; identical to SEQ ID NO: 44527

SEQ ID NO: 44529 - DNA, 1045 bp, Homo sapiens
tttaatgctttgtagtgtcagcttcagtaagatacgaagaaaattgggaaagaagatagcacatttatctcttaacactttattgacaactttgtaaagatatggttctaaaagcagttaatttgggtcctctaaatagagctagggttttttctatccatagcttcatgttaaccacaattactggatttctttaaatatgtttgttgttgtttgggtttgggttatatatcaagagcaatttttataccttactgataagaatgatgcatttgtccaaaagccaaaataaatggaaatattactctttgccgctagtggatccagcatctgtgatagggtgtgctcgcaaagatttccagtcactgtctttctctttactgttcatccctccccaagatctgcgaaaggattacaaagtacctttgaatactgctagataatttcatccctgggaaatatttttgcttactgtatcaaaaacagatttgctgtttatgaaagatttatataatttcaatattgtattagttaggactctgtcttgcaagtaactgaacccagctcagacaggcttaaacagtaaagagatcttattaatttatataactgtacagttgaggcacagcttgaccctggatttaagacacatgaccatgatctgatttttttatttttatttttggcctgtcccaggtctcttcctcagcattggctttatttccatggcttcagcctatctgctagctctcaaaagaaatggaggactccctccttacccttcgttcccgccttttccctgaccttttttttacccagccaagggttttgttctctgaaaataaaaacctccatgggatcattttttgcttaggtcccttgtcatttactaaatgagctgccctaaatgtactctttccttctaaccatatctcaaactgtagatcagaacaatttttctttgtgttagacctctctgtcctcctaggaaaaacaaaacaggatatattttttattctatagagaacccaaaccattgttctgt

SEQ ID NO: 44530 - DNA, 1045 bp, Homo sapiens; identical to SEQ ID NO: 44529

SEQ ID NO: 44531 - DNA, 1045 bp, Homo sapiens; identical to SEQ ID NO: 44529

SEQ ID NO: 44532 - DNA, 1047 bp, Homo sapiens
ttactaaatgaagtaacctaagtaattaggatcagaggaacatgttttttaactctcggcctggtgtgaagttgaagaattcattgaccgtgaaaagagtaccgaaaatagaaatagttaaaattctgaaactgagtatcacttcactgtggtgtcttaactttgggtgtggcctttttcctttcccccaccacaacaaatacatatttgcttcaagtggtaaggttgtcaactggcatctgggaatgtttaaggtatctgaatagtttttaaacaagcatgttaacttcagttattccattcttctccctgatttcacctgaaatgcttacatgtgtagtaaatagcaatgcagtttagtggcagtgtatttggggggtaaaatcatgatgaagaaagacaaactcaaacctcagccccaaatataaaactgaatcgacattgtggcagagtgggaaacttaaaattccaagctagcctgtctttccatcctgaaactgtgcctttgtaattatgagagaacttaacatgtgattttaatttagtgataatctaaaatgaatcttccaaaacaagtataattttatgacaaccacggatggcatcttgctcaccttctaaaagtgtgagaacccagtctagattttaactcttcaaagaataggacctgacctgggtttttgcttcagaggctgtgttaggaagcaagtaagcgaagcagtttcttaaaacttacaggattgtgcaaggcaaactgctgaaggtttttactttatttaatgccattacaatttagactttttggatgctgcttacctgcttagttttttgcagtggagttttaggacaggctgtcttctcgtcactgccttctcagctggtagccaactgaaacttgacttattggctatttcaatataaagctaaaaggtagaaattatttggtacacttaccagtggtgggacactgcaatactctggaagtaagtgggcttttgttttcctgtcatggtggaacctaggttgtttgatatacttgaaatacaa

SEQ ID NO: 44533 - DNA, 1047 bp, Homo sapiens; identical to SEQ ID NO: 44532

SEQ ID NO: 44534 - DNA, 1047 bp, Homo sapiens; identical to SEQ ID NO: 44532

SEQ ID NO: 44535 - DNA, 1058 bp, Homo sapiens
tatctctgcctgcattaaatcttttatatggaaactaattcatttttctactcctggaaagcaggattgtttccattgcatggctgtagcaagttttagggttacactcatttcttaacaatgcctctggtcaaatgtaaaaggagccatcaggggggtgataatgatttcattcaaccaccctgtcctctcactggagctgaatttaaggaactcagaaagtccaaattgattatacagtctaacaaaagaacagcaagtgagtccagatgaaaaagccagcaacagctgtagaagctccaatatacagtaaggccttatatgagtctcccttcaccctttcctatagcctttcggtggggaatgggaagtagagtatggcataagaacccagccctagctcttctcaaatttcttgctgagcttctccccatatctccctaaatctgttctgcatatctgcagaggttatgactttctctgtgttcccatataccttcctgatctgtaagcagttgccatagaataagtgtctggctgtaagtattgaccctgcatgcaagtgccattgttgtatttttgctgagacaggtctcttttccctggctactggcaccctttttattgtttgcaatatggtttggctgtgtcctcacccaaatctcatcttgaattgtactcccataatttccacgtgttgtgggagggaccctgtgggagacaattgaatcacaggggcagtttcccccatactgttctcatggtagtgaataagtctcacgagatctcatggttttatcaggagtttccacttttgtgtcttcctcattctctttttgcctgctgtcatccgtataagacgggacttgctcctccttgccttctactatgattgtgaggcttccccagacacgtggaactgttaagtccaattaaaccttcttcttgcccagtctcgggtatgtctttatcagcagtgtgacaacagactaataaaatttgtttgtttggttttaccctgaggctaatctactattctggaatttccaaatgatcct

SEQ ID NO: 44536 - DNA, 1033 bp, Homo sapiens
ttttatggaactcatccaggccttcttcatagagtgtttactgagtgtaagtgtggatactgagcaataaatagagaaaggaagagacatagaaacacaaaaatgtcacataaaatgtggaatcatatatcctatatatggatgtatactctttctcattacaagaaaataacttgaattatcaaaaagatatgaattttgagtaatataagagcattatctttttcatgtatgaaatacaaacaatgtaaaaagcatcgctatttttgtgcactcatttctgaacttgtgcaagttggaataaggcggagactggctggactgatttaaattgggaaggacacagtaactatagaagaaatgaccttaaggggagaagggagtgatgagggaaaccaaagtctgtgtggtggacttgaaattgagggatcatttgagaaagagatgaagtgctttctagggcaggtgataatcgagctctaatgtggtaaacttactttggggagatagatgagtaaaaagagaagttatgaagtattggcctgtgtatgaatgaaatgaaactctggagaggatgaatgaaactctggagaggactttcatataaacttcaattaaaatttaaatagctgttcaatcatttttgaatattattagactgtcatttcttttaaattgaatgtcaagctgagacaggttagtagattaaagacatcatttctttcttttctgatcaatgaaaatatttataaaagagaacaaacaatttgtaaaaatctagtagaaagagcacttagttgggaattacaagatatgagttctagcacgggttcagaaggaacaattttttttctacctctaacctgctaagattccattttattttagttgtaaaacaaaaataaaagcatacaaaattatctatcatcaggttggcctgatgctcttaccatgcccaaactcaaattgttcacaagggaatactgagtgaggaaatgtgcaagatatttctaaataagtagtgggtcttgat

SEQ ID NO: 44537 - DNA, 1027 bp, Homo sapiens
ggttgaatgggcttacaatttagtcaatgatcatccagctggagattactacattccacctagaaaaaatccttcagagcgaggaaaacaatgtcgccccagatacactggaagatttcgtttaatgctgttctagacccctgggaattcaggaaaacagtatttactctaacctttcacagtccattgagaaatcagaaatttgtgggacagggcttttctttgtaacagaaaactgatactgactttccaaatgcctctgatgaacttcatctcaaagatttttcaaaggttatctactcctaccccctcattttcagatgaggagactggagcgcagatgaatgggatgctctctctgaacaagtctactattgttattattttcttttagaaaaaaaagtaaaggcaattgttcacattgttcaaatgctttcatttcctttttgcattatatgcaaataaaatttaaaaacaagtctgtataacactaccgaagcccttgactactagaagcttaaaatatttaacgtaaatagtatattcaaaaacacgaacacagaaatgtgtttagaaggtctccccaatccagcacacaccaaatatatcccaagctcccaggcagaggagatgatcaatgtatcaaattcattgatcttgctgatggtctgaagcatcaaattttacatacctagaagccgagctttgtatttctaaactttctgaaatcaaatccttattttctatgatggtaactatactgacaacaaagcgattggccaaaagaatcattttagaagcgaggagtagggtgaggagggtttagtagcaagaaagtttaaatgctgtaaatcttgccattgcaaccaaaaaagagagaggagatggataagctaagactgaaatcccaattggttgctactaatgaattaatacatttagttttggataaaccatgctaagaaatataaactgagtcatagaaacagcatggccaaaagagcagaaacaccaaaaaaggttcata

SEQ ID NO: 44538 - DNA, 1033 bp, Homo sapiens
ggaaagttagaacaatattctccctacaaacagtgcatagtccagctgaaatgtggggaattatatagtaatggttcctgtgaatggggcctgcaccatggggttagattattcttttccctatgaattcaacaacaatatataagtacccacaatgggacaggcttggaaattgacagaatttatacaaagatgaataggataatataagctcctaatttatgtaagaaaataagattctccaatacgcactttcactatttcaaagaaccaaaaaaaaaaaaaaatgtttcttttcaaaatgcttcctgatttggaaaacataacttgtgcttgccatattttttattgtttggagtcattatatactgaattcactgaggttggcgcattggcagtgtggacaagagttctgtcacaaagaataatagtagacatttttctgttagccttcctttctcagtattgctaccaacataaccctctctctcaatttagtaattgtgagtaggcattggaactagttgatatatgtaagtctagagaagaaattctagttgagaggttataagattcttcaatctccctataaactagaacatgttccaatacttcaaaattcttgatttcttaataatatatataaaacataaaatgggattaatatacccacattactgatcacttcaattaaaacctatcagtcaattcaaggaaggtaaattagtcacatcaatgattcattatagtctcaggaattggaaattaaatagacttttctcagtgagtaaattatgcagtaacaatctgatggtgtgcatgcacagccttaattaattagttcagttgaacccaagattgataatgtaagactgtactttataactttaagaaaattatttaactttactaaatcatttcccctaatagttgcctttcccttaagtatcaaaatgagacttgccgtagctacacatttctcttcctaaatatatccctttaatcctgaagtacatttcttaaccagaatgat

SEQ ID NO: 44539 - DNA, 1055 bp, Homo sapiens
catcccctgggagcttcactacattgcattttctaatcctataagcatttttgaagtagtatgaaatcctagttattgagaaacattgaggaatacagggaaaaaaaagaccacgtcaccatgagataaatatctagagaaataaacaatccgaaggtcaatgaccactttgactgaagtatacataagaacccaatagagctgaaagggccaaaataataaaagttaaggtgggtaacaagtcagaagaagcttagtgcaggatgtgaaacaaatagaatcatgaaagttgagtgggtgattgcccctagaaatggagagaaagggctttctggaaaagtagaacaccagagacatagacctgtacaacaccacggtacattgggggaactatacatgggtttatagggtcacagaattaagcatggtagggagagagagaataaactggagtggtaagtagaaacatgattttgaaggacttattagaatatggacttatcctataggtaacagaggttattgaagaattctaaacaggagaacaacttgactaggtttgcaagttagtaagagcatattcgcttccttataactatgaatgtgagatttcaagtaatttgaatactaattaatattctaatatttattttaattatcaaattaaggtaaaccatattcactagagctttagaatgtatgataatatctaacatgtaaagaagtacttctatctgattgaaaagtttagtaaaagcatcttgaccttagtatggtcgtatttaagaaattttaaatttaaaagtgcataccaccactttttggaaattcacttctatactgtgaatgtcatttcttccccagtaatgccagacaaatgattgtcttcgtacagtgtcttgaaccaagaacaagaaagataaaatattataacatgtcttaggggtctccaaaagttgtctattcaggataatatagagaaaaatggccgattcttttctgccacgttgcactttagaaatagctagctacacaaaagttccaaatattaattg

SEQ ID NO: 44540 - DNA, 1130 bp, Homo sapiens
cccccactcctctgaactgaagacaggtatcatgggaggttccatggaagcctgtcattgcctcaactaccctgatccccactcccacccccatcccgcagggacaggagcatcctggagggggatccatccccattatgatttgtatctctattgtcctacagggaccttttgcctcccagaacccacacttgtcctgatgaggaacgagggcacttcgtcttcttgatgcaaactctacatttaatgagatgatcttaataaaaagaacaatcaccccaatagaaaaatgagcaaaaatccccacaaacaggagagaaaatatttatgaccaataaaaaagagatgtttagtttaattagtaatcagattattagtcagaaaaatgcaagtgaagaccaccatgaggtatcattttactcccactagagaggcaataacaacaaaatattataataccagatgatggaaagaatgtgaataaatgtgatcctgtctacattgctggagaaattttcccctgtggaaaacagtttggtcttatctcatgaaggtgaatagttataattttgtacctactaattccttagagcgcaggcttatgctatagaaaaaccattatgtttgaatctaataaataagtaaggtggagcttgcagtgagccgagatcgcgccactgcactccagcctgggcaacacagcaagactctgtctccaaaaaaaaaaaaaatcaaatactgttttaaaaagttgatgttattgctactttttcaagataaagaaatataaattatttgactcatatagagcaagtatacctccagagccagatgggaattcttttcaatacaggatcttgttctatcacccaggctggaatgcagtggcacaatcataacttatttcatccttgaactcctaggctccagcaatcctcccacctcagcctccaaagtagctaggactgcaagtgcacaccaccatgcctggctgatttttttttttttttttttagttttgcagagacagggtcttgttatgttgcccaatctggtcttgaactcctggcctcaagtgatcctcccacctcagcttcccaaagtactgggattacaggtgtgaatcatag

SEQ ID NO: 44541 - DNA, 1115 bp, Homo sapiens
aaagtcttctggagagggcatgtttcagacatgctacaactatttgccaagggtaaggaagagtattctgacaatttccactggaagcctgaaatctaaacaaaattccaaagatcagacaagaataaattctttcttgtacagtattatgttttgtgttgcagagcagaattcattgccaatgacaggtgcattgagtctcaaagatgctgtatctttctttttaatttaaaaaacacatgagattgatcttccatatgtatttgctctgctttgaaaccttcatctgcgtttggacattaaaaagtaaaaattatttctttttctgattttcaaattagaacatttagagaagtaaaccgaagaaaaaatattctcgatcatttatatttgactcacaagggccatccactttacctgattattcaagagataagtttcttctagccaacttcaggggataaaacagtgaagagtatcaatatattttccattgtcaaagactgtgtagcatggttggaagcaactgtgaacttttactgcttttgaaatcttgtttatcttcctacacacatacatgagcatgcaatacactcatacacatatacatgtactattttaaagttttagattacattgtatatatcaatgcattatttcactggggccaggcaagggattgaagagcaaaggaaggaagctggcataagttaacatatgcacactgtacagctggtagtccttggagggggagaatcagaaaagctgtcaactactccactgttgagatacagctgggtgagaatgtggacacagagttgtcacatatttagaattataaagaaacactgaaaatctggatttttatacttaactcttcaaatttttaaatcttggctcaaagtcataaaatactgagaagccagcaaaacatgtttgtggacagctttggcctgtaggctcacactctatgacctttgctgttagtactgggtaataacgttttcaaataaagataatcacagacattttcctatgacattcgaaaacatctaatgcatcatttttatgggtacatgatatttagttttgtggcatactataatttcattaaa

SEQ ID NO: 44542 - DNA, 1031 bp, Homo sapiens
gcatggcaacagccacctacctccttctgtcagattctgtaagctcgtttggcctctatttagttagccactacatttctgtcacaaagattactataattctattgataagagaattttgaagttaaataatgttagggagaattgacaatttgaggaatatggaatatgtaattgtttcagtaatagtttttaaaatatcgttttttcccctttcatggggtcataggataattgcagacatcctcacttggttataatttgaatatcatcctttagcaggcattggatagaaggttctattctctagggactggcccagaaatcactggtgctatgtgagtatgttaatcctgtttaggattccaaataaataaaacagcattcctttctgctgagaaagtcaggagttcattttctataagttaacatttcatacatgggtcaggcaaattcaggttgaaatagaaagtcctaaacttctattttttaatcttaaaattcacctgactttaataaacttggtccaactagatagtccattatttaatttgatgaaacctcaactttacagtgacgatggtttcttaaacaggtttatgttttaggtaggatattctgttgatataaaaggctatttaggagaaaatcagattggtttaaacatttcgcatataggattataagtgcactaaatccttatagaccttgatatccccaacgaatgcaaaggacacagtgaggaggggtgaaacgtccattttcatggctgtctctggctagctttagtgaaagtcctgtaggttttccctataaacaatatagaacagggatgtacaaaatagtggcataacaagaagaaaaatggtgtgacctagttggggtttctgtttgtttgctttctcttcatggtgggaaaaagaaaggcaaaaaataagcatttattacattccaatcctctaaataggaccgtaacaaaagaataaaatatgcttaacactccggagacaatttctgcatccttctttgat

SEQ ID NO: 44543 - DNA, 1044 bp, Homo sapiens
gcaatactgaaggcaagaaagaaacagaaagagaaaacaaaacaaaaaatcaaaaacacacacacagaaagtgaggtgatagaaagaaatcctaatataccagttatttacaataaatacaggtggactaaattccttttcttcatttcactttacacattacatttctgtaaagagtggggattatgggagctacaactcaagatgagatttatttggggacacagccaaaccatatcaatattgaaaaagaaaaagtaaaaaatacctctattcccagctgacatgatttttttttctttcaaatttttattttaggtttagggtacatgtacagctttgttacaggaataaattgcaagtcacaggggtttggtgtacagattatttcattacccaggtgattaacataatacctgataggtagtttttcaatccttactgttctcccatcatctaccctcaagtaggtcctggtggtttttgttcccttttttgtgtctgtgtactcaatatttagctctcattgataagtgacaatgtgtagtatttgattttgtgttcctgtgttaattcacttaggataatagactccagctccgcccatgcttctgcaaaggacgtgattttattcttttttattgctgtgtagtattgcatgttgtgtatgtaccacagtgtccttatcctctccactgttattgaatatttaggttgattccatgtctttgctgttgcgaatagtgctgtgataaacataggagtgcatgtgactttatgataaaatgacttgtattcctttgggcatatacccagtataccatattgctgggtcaaatgatagttttattttaattctttgagatatccctacactaaaactttccacaatggctgagctaatttacattctgactggtagtgtataagtattcccttttccctgcaacaccaccagcgtctgttattttttgacattttaataacagccattgtgaatggtgtgagatgatatcttattttggttttgatttgcatttctct

SEQ ID NO: 44544 - DNA, 1057 bp, Homo sapiens
gagttagcatggcatagtctttacattcatttacttattttatttttgtcttatatttgaagtgcattgtttttttgcagaaagaatataattgggtcttgctttttgttccattcgaaagttactgcctttgaattggcagttacaccatttatatttaatgtaattatttataagattagatttttaaagagtatgatctcactatttgttttctgtttattccatctgatctttgtttacttttcgtttttttcttgactttgagtggattatatgaatgtttgtattattccattttatctctttaatttgtttattagctataatttattttgcatgtttagtgtccatagtttgtatctatgatttaacacaatctattttcaaataatattcatgtgttgtgtaagaatattacagtaatacattgcaatttctcccttcctgatgtttgtgctcttctagtcatatactaaaccaaacactgcattgtcattctttttttccccattttttgactgttattttaggcttaggagatatatgttcagatttgttacatgggtaaattgcttgatgctgttacaaattatcccatcaccaagttagtgagcacagtacttgataggtagtttttcaacccatgcccctctcataccccctcctcaagtcatttccagtgtctctcgtacccatctttatgtccatttgcactcaatgtttagctcctgctggtaagtgaaaacgtggtatttggttttcgttctggcattagtttactgtggacaatagcttccagctgcagccatgttgctgcaagggaggtgttttttttttatttaatggctgtgtagtatcccatggtgtatgtaccacattttatttatccagttcactcttgatgggcatctaggtggattccatgtctttgctattgtgaacagtgttgcaaggaacatatgagtgcatatgtctttttggtagaaaaatttattttcctttgagtatatactcagtggtggtattgcggggtcaaatggtagttctgttttaa

SEQ ID NO: 44545 - DNA, 1062 bp, Homo sapiens
ttttatatggcaatcaaagcagactaaggcaggaagcatttctttcatttaaattttcttcaagagttggtgtataatgggtattatttatttgaaatgtttggttttcttctccagtgaagctatctgtatctggagtttttcttgtgagaagttttttttttttcctacaaatctaacttaataaattgatatcaatatattaacattatttatgtattcagttatcagtgagcacttatactttgtgactttcaagaaatttatttgttcattttatctaggtaactgaatgtatggtgttaagactataaaaatatattttcttatcattcttttaatgtctgtagactcttcaatgatgtcacttctaattcatgatatttctaacttatgttttctcccattttttccctagtaagtatgactgaatgtttatcacatttattactcattctaagaacgaatttttggcttcatttattttttcttttgtcttttctattttattgattgtcactccagtacttactctttcctttctaccacaaattcgagctcttctttttctagtttcttaaaataaaggtgaagtcattaatttggtacctttatagtatttaatgccctaaattctcctcttattaataagtactgctttagtggcatcttataaattttggtacattgtattttaatttttattttggtaaatatttttgacccactctcaatttcttcttttatctatgaattatttagtttccaaaatttgaggattttttaaatatttgactgttattgatttctaatttaattttcttgttatcagatgtcattgtatacattaaccctttaaactttatggatagaatatagtccatctttgtaaatgttctctgtgctttcagaaagaatgtgtattcttccgtttctggttctgtgtgttttataactcaattaggttaagtcagttggtagcactgttcaagttctgtagatgcttaataattttctgtgtgcatttaatgtcaattatagggggatactgaaatatctgac

SEQ ID NO: 44546 - DNA, 1030 bp, Homo sapiens
gctcttggccacttgaatagccactgaagctattcaaaggtgtctcagttaagagcttgcaggggatttctgctgttagttggaggtttgaggatatatatgacaatatttatgaccagtaatttcaatgaggaagttgcacaaccaagagacaagcaggtgacccgcctctgagtctctgagtctaatgaaaatagacacacaccttcaaacaattacattaccatgtgttaaggaataagcatggagcactaaaacagaacaaaggaagagcacctgcgatatccacagtttacctgtctgataggatttctttagctccattgctcatttttgttcttatttggaatgtcaccctttagaatgaaaacaacagaaaaccttcaaagtatttattgtcctgcaacacattctcttctcccaaatcttattctggcattccgtacatttctttctcccacaaacccttcctgggctcttcctctttaagtctccccacctcatattcataaagaagtagaaggaaaaacaaaaatgcaaaaactaacctacatcctgttttctctcaaggccttcattttttcttaatagaccaaatgtcattgtttgcttaggagtaggaaacagccattttgggcctataatggagatctaaaatctcttttgccaacagctttttctagttatgtgacgttaatatagttttattttccccgctgatttctgagcttacattttgactggacttgaatgttctacagctgctttgcttctttggaaaaaacacaaccagttttctagctttattcccaggttgtatgggtatccagtcctatcctgtctctcggactgctactcctctaggtgttcagtcataggggccacaccataacattccattttggaagggacagagggaaattatctgtttctcttaacgtaaccatttaatttattgttttggggggatatttgtgaagagggtgacttggctgctgatatctctctctgtaaaaaacatatttctagc

SEQ ID NO: 44547 - DNA, 1046 bp, Homo sapiens
tttcttctgctctgtcctttgtacttagatgatggttccctcatcagtgctcaggtacctggagccaagctcctgctgttgtctgaagccataccttgtcctctaccttcaccctggacagtggcgtccctaacttcccttgctgtgttttgaggacccatggcaataagtcaaaatcaagacctgccagcacctctaaaacgttgctcctaggaactaccaagagcaaggagacttgctcccttatcaccaactagttctagaagctgaaggccttgctttctgttcttattatttctcatcatttaaaatttctgagcacaattcaccagcattaataatactgtcataatagctgatacttattgagtgctttctatacagtggacagttcaatactagaactttacattcagtgctgggttaaatgctcccaacagccctatggggtaaagactatttttcttcctaaatgagggaaatgtatctcagaagtaacttgtccaagatcaaaagctagtaaaaaatagaactgagggtgtagtccaaatatttctaaccacaaaattcttaaacgtcatactcttctacctccattcccctattcaatgtcaagggtccagtgagtatttgaagatattctggttcatgattcctttcttccctctagccagtatccaggaatatttcttcatattatgtcacttatttctacctccttatgatcaagagattaccgtgtcttggataaggaatgttgctgttagattaccctccttgattgcatatgattgcccattgtttaattcccattgttttctcaaacaccagttggcctggcatggtgtttcaacatgcctgcgctgaggaaagggaccgctgggagtacaagcaggagggtgtctaggagctgctcaatctgtttctccagcctgccatcacctgactaaattgtttgttggattgctgtgttctatcccttggggaggccacagtgccgggtttgtttgtgttgagagtctctggctttgattagcagctagctc

SEQ ID NO: 44548 - DNA, 1029 bp, Homo sapiens
caagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggaga

SEQ ID NO: 44549 - DNA, 1046 bp, Homo sapiens
acagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaat

SEQ ID NO: 44550 - DNA, 1021 bp, Homo sapiens
agagaggccacattcatgtaacttttattagaagatatggttagaattgttctattttattattattgttaatttcttactgggcctaatttctaaatcaaactttatcataagtacatatgtataggaaaaggcatatgaaccctacatgctatatgcccatatataaaccctgtatggtttttcccatacatatataccttataccatatatatagggttcagttctatcttcggtttcagccgtccactgggggtcttgaaatgtattccccatggataagggaggactactgtactggatttgggatagggaaaattttgccatcttgaaacgtctgtggtcttcaccaggcaggtgtgtctctgccaggtatgacagaagtgctagcattccaattaaataatttcagtggcctgttgagaatttttccccccaaggaactatctctctaaatttaattggaagcatagtttctatgtcatggaaaattgctacagagccatctagctgtgtgactgtcctacaaaacaaaggagattgtctctatcctttgatttatggctttggctttgtgtctcctcttccctttctaaatgagatgccctgtacctcatccccctgccagacctactcactgggaatgctgcttcttttagctgggtctggacatctccaagtattccactcccattctccatgaatcattttccctagatggttatgggtggtaaggggggagttttatattttcaaagcagtgggggtggtagtttgccttgtgtttatttgcttttctattgttcttccagcactgtataattggtataatttttcaatgcacaaactccgaagctctaaagtctttatagaaagccaaattctgttggcacccatggttctgggcaacgagaacacacacattgtcatctgccaccagccctgagcacctggagtgagggaatgtgttggacccctgtggtcttttgctaacaccttattattctgctctgtcctcag

SEQ ID NO: 44551 - DNA, 1033 bp, Homo sapiens
ccgggagagtagatgaggaagtctttttcatctttcttcagtttttctctgggagactctgggaacagagctgaagtggtgcgaaagcaccttcacacttcctttgctgaggtgatccgctaattgcatgctatcaggaaatgtgtaagatgggagtgagatggtttcccagggggcccttcttcctgtgctccatcaagaaatacattttcacttgctggtgtctgagcagtgcctgtgtggctgctagagaatccttctggcttttctaagtgaatgcacctctctaagctgcaagctttctggatggccccaccctggtctcatccctgagaaatcttgtcattttttcccactggtatagttttcttctgcatgagtgatgcacatacactgcccggcccattagttgtaggcgtttgtggctcagtttgctccatttatttcttattttgttctcaggcatctttagggctgtgagctacagcttttctccttgagcatggatttgtagaatcataggagcttagacttgagatacaccttagatatcattgtattgaactgctaatcaccttattttacagaaggagaaactgaggcctggtggggttaaagtcatcttaacatttagaggtagaatggggacgagaacttggtcacttaacttttgaactggtccttactttggtttctcttgctgctatacctcttgctccttcaaggaccttgccccagcaagagccaactttagacttggacacaagggcccttgatttggactcagtgttttagagggccctgtgctggctctccttcagccatgtccccctccatgggatgtgtagttggcaggaccaaggggatgcatccatctggagctctcaccctagccctctagaacttactccagtacctaggatcctggaattccctgtccaaaggtcttagctcatttccagggcctatgtggacttctaccccaaatctgttctccgaagggcaaacctggtgaccagtgggcacccctgaa

SEQ ID NO: 44552 - DNA, 1033 bp, Homo sapiens
gacctatgtcataggaaataccttttatattttaaagaagcaatttttggtgaacttaaaaattactctgagattaatttctttgatgcctaaaggtcaaaaacagtttaagccttttctgtgtgtcatatgactcttaacccagaaactcagatcagacatcaagacccctcgttcatccctcccatacatgaggacaccataataaagaagaatagatcgttaactccttattgttctaggagtgaattgatttctatgaaattttaaaaattataatcagctattttgaattcacaatctcacaactagaaaatttaaatgaaatgagatgttttaaaattctgtaagtaccatccgtccattaattaacataactttgaaaatttgtattgattctgtccctgaaagttctagatctgcaaccacattcttaaatttcatcgttactgaggacaagggaattcacccttccactctttcttcaccttttcaccttgaacctgacttcactccttggattactagaatagcttgtatcctatatacctgtgtgtactactatgatctgtccattctacatgtttatggaggaactcttccccatgtcggatgcttgcccaacaactatgttgtatttccctgttacttgttggtaccaagccctgacacctttactcattatcaggtatccaaccctccgctgcttcaagaactccttacccacactaggcagtggcttcttcagtgacttttcaaaatactgccttttgcttagaatgcactcctctctcttatgtaaatcatcccctttctttcaggaggcccaattcaaatctcatctcctgccctaaacgtttcctgatcacacaactcatagtagtgttctcttacttcaaatttttagtacacctttagctaatgtattagtccattttcatgctgctgataaagacatacccgagattgggcaatttacaagagaaagaggtttaattggacttacagttccacgtggctagggaaacctcac

SEQ ID NO: 44553 - DNA, 1050 bp, Homo sapiens
gcataccccccacctcattgtgcagccccatccccctggagcattccagagaagctctgctccctcttgctgctgggcactaattagaccctgactgctggcaggtgagcttactgcccaagaactaaagagagagagctcttcccccaaaagctgccctgtgcctctgtactcgaaacctaaccctttgttgacttcttttactttttatttttggagcaaactctatttttggagaatacatgaaacgagtggctgtcttacatcataaaccagaaaaaccactgtgcttattaaaggcatttcggagtattctcaagattcggactcaaagcagacaatagtagaagctggcttttctgcctctaaatggagggctctggcccccacattcattcatccctccttgagctaaaccactgcctgcctggctaactgatctcaagagcaaggctgggactcatgggtatatatttttggtctgtgacttttttcctagttaatttctgtggggtctggactgttttctagccccatacttattattttttcttgttctctacttcctggttctcccacatgactaatccttctctacacccatgttgaattttatttgacctcatttgatatgttttctctaagtcacttcagtcctttttaaaacttggtaaacatgaatccattttaaaagcacaggccctcatagaatctgggtttatcctcaggctaggtcactgctacccctgaccagtccccaaagaatgctggaggcctttgccatgctccaccttcctattctccacccaggctcccttttcctcctctcctttctctccttctctttccctttttgtctcctttgctctcctctttctttcattcacgcaggccttcccctcctcctctgggctttaactctgccggttttcctagagctttgctcagtcctgacaggtgtgaggacctgaactcagggcttgggatcttatctcaggttctcctgctttattgcaaggactcggggtcctcagcagatcttggcattct

SEQ ID NO: 44554 - DNA, 1032 bp, Homo sapiens
accagctccacggaagacctccagcctggccactcctcggcctctctcatcaaagcaatccgcgaggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtattttggccaaaagccagcagcacttcacaaaaacaaaacacaaacctaagctaacaaaatgactgcattcgtctcttttttaaaggtagagattaaactgtatagacagcatagggatgaaaggaaccaagcgtttctgtgggattgagactggtacgtgtacgatgaacctgctgctttgttttctgagaagaggtttgaagacattttattaacagcttaatttttctcttttactccataggaacttattttaatagtaacattaacaacaagaatactaagactgtttgggaattttaaaaagctactagtgagaaaccaaatgataggttgtagagcctgatgactccaaacaaagccatcacccgcattcttcctccttcttctggtgctacagctccaagggcccttcaccttcatgtctgaaatggaactttggctttttcagtggaagaatatgttgaaggtttcattttgttctagaaaaaaaaaatccctcccaaagtggggcaaaaagctttatatttatttgattatccaaaatacagatcaaagtttagatctacattcttcattgtatttgctgtttcttaattgggcacacacaactcctggtcatgtcccagttcagcaccgatcgctaaggccgatcctgtagaatgcggctttcaagaggtccta

SEQ ID NO: 44555 - DNA, 1027 bp, Homo sapiens
atagaaaagtcccttccctcagggagcaggagaaacatctcttccccttccaggagaggagatggctaagcaggtagacaaataagtgttaccttctgtaaggttgggggtggacctcatggaataccaaggccagggtgcagtggagtcctgatgtgctggtttgctttgccttcagaccaggttttggccccggtttgctgcagtctacagagctggtgccccctgaccctcagcagccacaggcctccgccgaagccccatttgctgccagagggatctactcggaggagatgccgtcggtggcccggcctcggcctgtcgggggtaccacaggtatatgtggctgtttagcttccatttctgagctacgggacatttacttgaaagaaactttattttaggtgtctcagagtgtcagtgtgcagaggcctctgccactgctgtttcagggctgtttcccctcatatcctgaccgagatggaggcggagagagaggcggagctcccaaagctgctgtctgctgattggctctggaaccaggcccttcatgtgaaattcacggcacgcttcctccaggaaaaacgtttccaaatccttactgtaaatggaaagatctaggtctgagcactttggatggcatgaaaacaagagttagttttcaagaaggtgcttttttcagcttgtaacgaacgactctcaaagtctgggtgacagagcaaaactcttatctcaaaacaaaacaaaagcaagtagtttaagccaattccaaatttgcaataattggtggatattttttcattatggtttttctaggaaattcttttattttgcattgtctattactcagcaaaaaaatagtgtgtcctggaatcctgtaggttttcctgaactttacaggtgctttgctttgcagtgaatcttgattcccctgctaattttaggtatttgaacctccctacatggcatgcgtactaagcaaaattcagatgtattaatttttagtttaaaatctgaacgaatatag

SEQ ID NO: 44556 - DNA, 1033 bp, Homo sapiens
ttttggagtactgtaccatttataaaatgattgagatcataaagtagaattcttatcttttcatgaaggcagattcctagagaccttttcaaggtaaaattttataaacatagtggagatgactgtagtcattgagtcatccgtttagcaaatgcttgctaagtgcctgtggtcaggtgctggtgatatacaatgaagatgagataaatgtgattgctgtctcacaggatgttaacgtgggttgcgcacattagtaaagatgtggttttccagcctgggctacgtagcgagactctgactctacaaaaaaaaaaacagaaaaaattagccaggcctggtggtgtgtgcctgtggtcccagctactgaagaggctgaggtgggaggatcgcttgagcctgggaggtcgaggctgcagtgatctgtgattgcatcaccacactccagtctgggtgacagagcgagaccctgtctcgggggacaaaaaaagtggtttgactgtgtttacttgtagataatgaaataatatttctttaaaaatgctctcttgctttgtcattttagtaattcaggctgaactattctctttcattctgctttgttgacattatcctgttctatacaatcccatatgctgtaattttttattttttatttttttgcttacccagtctcgagtgcagtggcacaatcacagctcactgcagccttgacctcctgggctcaagcagtcctctcacctcagcctcctgagtagctgggactacaggagcataccacgcccagctaactttttatttactttttgtagagacgaggtcttgccatgttgcccaggctggttttgaactcctgggctcaagcgatcctcctgccttagccttccaaagtgctgggattataggcatgagccactatgcccagcgtttttctttctttttaagatttttatttgtattttaactgatggtaagaaaacatataaatttatggtgtacaacatgatgtgttttttgcttttattatttttagttg

SEQ ID NO: 44557 - DNA, 1034 bp, Homo sapiens
ctatattgggtagccactgaatctggcagcttttcagttcaactggagtctagacaaatatttaccaagcccatagtaagtagtagtataacaatagaccttgcagagcagagcagaattgtcttactgggttgccatatcatcacaggacctcatttatcaaatagtagtttttaattaacaaaaatgtagcctgtttgatagaatggtcagtgttattgatagcatcatagcgataaatcattcaactggaagagaccataggagagcagatagagggagacgtgctgccctctgcttgagcatttcatcttctcggcttccatggtattatggagtcatcactttggttaacattttcaatttcattttaaaatttattttctgagcaaaatcgcctctctctagaaattacatagccaattagagaaattttgaaaaacacattaaaaaatgtgtaaagaataaagtgaacatcacctaaaattcaaccaaccaaagaagatcactgtaaacatttcagcatatttccttccattcttttttccccatgaattctctattaacctttggatgacactgcatacatccttttgtagcctctcttcacttgagcttttttctttctttcttttttcttgagacagagtctcgctctgtcgcccaggctggactgcagtggcatgatctcagctcactacaacatctgcctcccaggtgcaagcgactcttttgcctcagcctcctgagtagctggtactacaggtacccgccaccggagacacctggttgtctcatattatcctaaatcttctttacttggtaaactggcagacaggttacaaaagacagatttgtttgaattgaaatgcgacccatttaaaaatgcccatactcacagaaagttggaggttggggctgtcattaatttccatctccatatgaattatgtggatttttttctttaccaactgctgacttgttgaactatgaaaatgggatatttagagctatgacatttcagaaacaggaaa

SEQ ID NO: 44558 - DNA, 1030 bp, Homo sapiens
tttcctcttttatcacgtcctggatcatttccttgtggttttgataccatttttgctttgtgttgactatgctgtttttctgttgtttgtttctgacagccaagtgtgtggttgtcatacatctcctccgttaattaagttagtgtataccactggtttaaaatcaatttcttatttactttggaattttggtgggaggaagtcgatgccttaaaatgagtactttgttcaaaaactaactggtacagccggctgtcctacttcgtttgttttatatgccccttgagcctttttggttcttcataaaacacagtgtattaatgccttgagttcttgcctagatctggtataaagtttaaccttctgaatacttcccagaaatcctgaacctgcaactgttctattttgttcgttgtagtttatattgactttactcattgacagccttcaggttcctctactccctcttccaattgtgttcagttccccgagaggaaaacaagatatacctgtagaatgtgtaccctatcaggctgggtaaaccagcagtgctgtggaaagtttccaaatctcagtggctttccgcatgtgacttctgcctcccaccagcagatcttgcccttcatctctctcctgcaccttttgcatcttgtctggttctgggaagtgtgcttgcctgggtcctgtttttcattcttccatctttgttttgggtttgccagtgccagaaggcatgcctgcaggcaggccagttgtgtggtagttccatgcccacatgtctgcatgactcagccaacattgatggagcactcactgccatgtgctgagcaccgtgctggatgttgggatactaagagaaatacggcagtcagtcacagccctctagcaactccgtctacaaggggaagttgttctgtacgtaagtgactatccagtggcatgtgaagtgctattgtagaggactgcggtggtgatacaaagagggcagtaactgttggtggatgtaggaccgcagaactgtgggggatgt

SEQ ID NO: 44559 - DNA, 1034 bp, Homo sapiens
gtttgagaccagcctggccaacatggtgaaaacccgccattactaaaaatacaaaaattagccaggtgtggtggcgggtgcctgcaatcctagctattcggggggctgaggcatgagaatcacttgaatctgggaggcggatgttacagtgagctgagattgtgccactttactccagcctgggtgacagagcgacactctatctcaaaaacaaaacaaaacaaaacaaaagcagtggttgacaatttaaggaagtagaaggaaggacctcatggctaatttaccaaaagtgaggaggttcacctgggcaggcaggaccaccctaagaagagttaggaagaagtaatgttgggagaaggaatcggagggactggtggaaggttgggagtgaagtccaaggtaatgggggtatctgtggtgatgttagggaacccaccgtgtgatttttgtcctctagcacttgacgttccagtgtgtctgggaaaggtgagccattggcccgagtcagggatggggaatcacagggcaggtgtgaagagccaaaggggattgaaggagctggcaagaggtggtctggatgaggtaggaggtgaaccgtggctggagcagtgggaaagggactgggaggagggggtgcagctgagatcccagggcaggtgttgagagagaggtgggggagggcgggagggattggggtgtcattgtgccgagtttcagaagtgggtcatctctagttttggtcttgggtaatgaacagggtagggtgtagtggtgggaatgagttgttgaagtggaacatggaggaaggctttggggtgaataacttctgtggatgttgaacttgcctggagagaggaagaaaggactgtgagccaggcaccagcccctcagtgagtgaaagaaagttcccagaggactgtgaatgggaggggaggaagtccgtcttgaatgtttctgctgtaccatcgctgccaccactgccctcattcaagctcccatcctcttttctccaggtgactgtcacgacctctact

SEQ ID NO: 44560 - DNA, 1097 bp, Homo sapiens
aacttacctagaagtgtttggaggaaatgggaaatgtagtaaccatcttaagtgacatatgataggtgaaattaaaacccatcagtttcttacaggtctatcctatgttagaattcaaacaaatatttatcctaaaaaatgaaatgttaggctaggcactgtggctcattcctgtaatcccagcactttgggaggccgaggtgagtgaatcacctgaggtcaggagtttgagaccagcctgaccaacatggtgaaacccccccatctctaataaaaatacaaagttagctgggcgtggtggcacatgcctgtagtcctagctactcgagaggctgaggcatgagagttgattgatcacaagaaggggaggctgcagtgagctgagatcctgccactgcactccagcctcagtgacagaggaaaactctgtctcaaaaaagaaaaaaataaagcactcagaaatgtaggaatagaaatgaactttcttaacacaataaagggaattttaaaaaaagaaaatatagattccagattatataagtgtgatataaaaaaactgatgcaacaaaaacaaaaatggacaaatgagatagcatcaaactaaaaagcttctccacagtaaaggaaacaattaacaaagtgaacagacaaacccacagagtgggagaaaatatttgcaagccatacatctgatatgggattaatatccaaaatatgtaaggaacttaaacaattcaacagcaagagaacaaataactcaattttaaaatgtgcaagctgttcccataagtggcctgcggtgatctgtgaaaatggttcactattcacttgacccagaaaactccatgaaatcatgcaaataaagaggttcaaatcttcatgttcactctaaggacacccatgaaactgcccaggccatcaagagtacgcctatatgaaaagccagcaaatgtctgaaagatgtcactgtatggaaacaatgtgtaccattccaacgttacgagggtggagttggtaggagtgcccagaccaaacagtggggctgggcacgcagtttgtgaccccaaaagaattgaattcttgctgtacacacttaa

SEQ ID NO: 44561 - DNA, 1368 bp, Homo sapiens
tgtctggtgtagggaagcttgaaaggatggtgtcttgttatttggctgccccagctctcctcttttaccatccaacttggatttaaagatgagattaattcctgaatattcattcactcctttgctttgagccttctactaatggcagtgaaggatacaagtcttttactgtgagcaattctcatcccaaaggattttctctattcgtatacatacaggtcagtcttgaatatttgccgtgtaaatagcctctgcaaaataacaagaagtcattttctagggctgatcttgattctcactgcttttatttttttttctgtccaaagggatgattcagacaaacatagcttccaaaactcaaaaggatgtcatcagaagaccaacatttgtgcctcagtggtatgtgcagcagatgaagagagggccagagtaagtgttctgaagcagctgtttgctgacagatgcttgagatgttcatgccctgggctcatcaagtcactcgtgaatctggagcctgttttcctgaaaagttcctgtttgcattactctgcagtttccatttgcattatcgatgagtaagatgcttgttaagcagcatggtgtgactgaaaggatactagatcggaaaatgaattttctttctgaaagggaagtctgagcgagtctcctaaatactctgggctttagcttctccagctgtgaagagctggattgatgcagtacacctaaggaataatcatatatactgggtttttgttttgctgtggattcttttttttttttttttttttagagggggtctcactttgttgcccaggctggtcttgaactcctgagctcaagtgatcctcctacctcagtctcccaaagtgctgggattacaggcatgagccaccgtgcctggctttgctgtggattcttttgggtgtcttttgttttcctacacgatttatagaggatgaggggcggagaaagagatagaaaaaagggatgagctagctgttagagcaagggttttggtgagagataatattgattgaagggattttaaaggaaatgttgctgtgggggattcattgtaactctccttgtgaactgctcagtaaactctacattgttcatgaacatttttggagttggatattttttttctgggtgatgtgtgattacataaaacaggcttcaagagaagtataaaatcaaggtgttctaactaggttcttttggttgtaagaattcaagctatttgatgaaaaaggaagttactaaaaagataaataactatgaagtcatatggaaaacaactcgcaagaatctaagaatggaaactgagctatatcagggcctcaggaaggggagttgcttcct

SEQ ID NO: 44562 - DNA, 1050 bp, Homo sapiens
tacaatgagtctgtactcactgtcaccattttctagccagtggaaatgtagagaggaagtaaatggaaggcaagcagtttccttttttaaaagatgtgacatggacattgtatatggcacatctgctcaatcacattgaccagagattattacatgtcacacttagctgaaagggagtctgggaaatgtagtttctgtctgggtaaccatgtgtctacctaaaacttgggagcttctattactagaagaaagacggggacaatggtggataattaacagtttcatccactcaggaatatagacttaaggatcagagaatactgtttaagcctggtatctggctggataaaatccatgaatagagaagttagcctcacagttaaagagaggcatagaaacataatgggtgagtggaagggatggagaaaatgtaagtaaagttgaaattcagttgcactttttttttcttttttcttttttttttttttttttttttttgagacaggatcttgctctgtcacccgggctgtagtgcaatgacatgatcagggctcactgcagccttgacctcctgggctgaagttatcctcctgcctaagccccccaagtatctgggactacaggcatgcaccaccatagctggctaacttttttttaaattttagtagggacagggtctcactatgttgaccaggctggtctcgaactcctgagctcaagtgatcctcctgcctcagcctctcaaagtactgggattacaggtgcgagccactgcacccagctcagatgcacttttatacacaatgagatagctgttggggacttctggaggcttaaatactttttgactctgaactcagtgtgtttccctaagaacttaaaaatcttataacatgagaagtgattttgagttggccactgagctcaggagagatatgaatgcaagacacattataaagacttgttgggggttgggggaggaaaatatgtcccatttgctctccagccccgtgcattcttctatctagatacttgggtttgtttctctct

SEQ ID NO: 44563 - DNA, 1020 bp, Homo sapiens
aaaaaaaaaaaatctggaggtgatgtttttcagtgagcacagattactgtgtaaccaggaataacatttattttctaaatgttccacaaataatatatgctgtgaatgggggaatatgccagggcaccagtagcctgtgagggcaagaggagctcagtagggatcagtttctgctcagcgcctgggctgggccctgaggtgttggcgttgagatgggaatgggctgtgcaaagaaagcaccccaggctcctgtaccaaacgactcagactggttgtatctgcaaattgaaggcctgtaggaatgtaggtgggaccaaaggtggtctctagagtgcctagagttagggccaggagccaagcagggcggggatcatattgttgcagggacatagttcatcccattacttacttatggaatcccatcgcttaagactgatgaacatagcattttgtcctgagacagacagattgagcacagcaaatgccaacaggaagccagtaaaacgggcctcacatcagacaggttcacctcagatgagcttagaactccttgttgccaatggggggaggtgggtttaactatccaaattggaaacagaacctgagataaagaatttaacaaaaaaatgcatacagcatcaatcatttgaaacataagtaaatctgcagaaaacatatcatagtctgggtaaaccccttccctgcaaaaagaccaacgctaagattcaagatctaggcagttaaaatctggaatataatgattgtggaactctggaattttcctgagttctggacaaggaccggaagctcctgcaggtgctgaggcagggtggggaggacaggacacacacgcagaagcagcgcgcacaaaccccaggaacgcaccagggccagggtgcccagaggtacaggatagacgtggctcatcttcccagaagcctgttttgctcaggattagtgaaaagtaggaagttgtaagtgctcaccattagtttaataacaactttgctttgcagagtg

SEQ ID NO: 44564 - DNA, 1032 bp, Homo sapiens
ctgtgcctgcagcagctccacctcagcaagcctaagaaacgccacatcctgctgggactggggtttcccagccttctgacactctttttgtcttaaattatggtaaaatatacataatataaaattaccattttaagtggactactagcaacgttaaatacgttcacattattgtataggtgtcaccaccatttccagaattttttcatcatcccaaacacaagttctgtccccattaacaactccccatttctccctccacccggtgcctagcaaccacccttctactctgtctccatgaatctgcctatcctagatatttcatgtaagtagaatcatatatttgtccttttgtgtctggtctatctcacttagcataatgtctttagggttcattcatgttatggcatacatcagaattccattccttttcatggctgaataatattccattgtatggagagatcacatttggctgatccatttatctgttgatggacatttgagttgcttccaccttttggctgttgtgcaaatgctgctgtgaacattggtgtgcaaaagatctgttcaaatccctgctttcagttcttccgggagtgtacccacaagggaactgccggatcctacagcaattttaagattaaccctttggggtcccatcattctgttccccacagcagctgtaccgtttcacattcccaccagcaatgcacaaggtgtcctgtttctccacccagcactcatcctggcttccatttccaggattttcaagtctggggagctctgggttccaagccctcggtcttctgtgcctctgggttggccagactaaactccacagcccttccctccacccaccttttcccctacaccctcagctcacagccttttgcctctgccacaccccctcgcaatggctcagtgattctgctgtccacctctgctccgagggctgctggggaagaccaccaagccctgaaaacgaataacctccagcttcgccaggtcttctgttccagcagcaacttc

SEQ ID NO: 44565 - DNA, 1066 bp, Homo sapiens
ggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgtacacctgcctggcatgcttatttatcctggaaccagacctgtcataaaagcgaagaggttattgttacaagtaacatatttggggtttgtttgtttatttagatggagttttgctcttgttgcccaggctggagggcaatggcacgatcctggctcactgcaaactccgcctcccaggttcaagtgattctcttgcctcagcctcccgagtagctgggattacaggcatgcaccaccacgcccggctaattttgtatttttagtagagatggggtttctccattttttggtcaggctggtctcgaactcctgacctcagatgatccacctgcctcggcctcccaaagtgctgggattacaggcatgagcc

SEQ ID NO: 44566 - DNA, 1618 bp, Homo sapiens
tagttggaggttgtgtctcccccaaggcaagtgtgttgtcccagactcttctgtagtccagcatgcgcacttccctctggattattactttccacgtgaactcaagagaacatgaaaggcaatccagatggagggaaaaggtgtgagtccgcagcccgggccagatgcgaaggtctcatgcgtgtcgtctaaacacttgtcttcaaggccttctctctgacatcttggaagagtcattgagaacagataacctggttcattgatttttgtcttgatttgaatatttaacttattaatagatccactgatttccaggcaccaggcagtagaagagactgggattcaggtgaccatgaaggcacagctgctacttctgggccgggggtgatattttgatcagcgttttgtaggggaggaccatatacccctattcccatggtcgctggctgggttttccatatatctgctgtcatttattcgttttccccttaaaagcaaaatcaatgtaaaaggctatgtttacgttttactcattgtccagcttagactcaaagtctagttcggtgggagggggaccttagcatcctctcagagatggtcagggctgagcaggaggaggcagagacagaggggcagctcagcctggtccattgagacccactctaaacagacatcatatttggaacaagaagatgcttcgagacaggaatgggccccactgtcatgcagaaacagactgggggaatggcagtttccctgagtcttggtttcttttatgttttctcttgtgccaccaccaaactgcagaggacctgctgtgacctaaagggcattcctttagcagataagaccttgaaaactgcaaaacacctgggaccagggagcttttaaaaaatacaaaaaaataccacatttgctttttccctgtgaactgtattgacagcgtgttcttaggacagtcttttggtggaaatgttactgtaaaatagttttcatctcacccctcctaatcatactcccactttcctgtttgtgtggtggtgttgctgttttttcctttacatgaattaaccaaatgaattttgtgtcattgtttttggggcttatatttttaaaacatagaaattgccttttgttcatttgaaaagtaagtatgttgtatctgaaaaagggctctgcctctgctctccctcgcttccttgtaaccaatctccaaacgaatctctcctggcaccgcccccttccttatatagggtcactgtccccggggccacctctgcctccaccctgctgtcaccactgccctgggccaaggcacccaggactcccagaaagcgcgagagccagcaagaaggccccactcagccttgagactggtggtcacacctccctgtcagagtcgcctgctgggctgaaggggcaatggattgtcattgttgaaattgtttggctcaggttataaggaggaacttgggaagtagaaagtgacttgaccatgtgcatccttggtagcttcctgtaactaacaaatggaacagagagcacacccccgccccgccccaccccaagcagatgttcccgtcagcgctgccctgagtcagtcggtcccccgtttctg

SEQ ID NO: 44567 - DNA, 1035 bp, Homo sapiens
gccccacagctgggtcagcctggaaaatccatctattagggactttttggcagccagatggcagcaatagcccattaggtctcatcccgagttccaagtcttggctgcaaatgagcctcagttcgccttactggagagcacccccagattcctgggcacagttcatttccagccctttctagatctgatcttttagggggaaagacagcttaaaatgttcttttcattttaaagaaaattattctgtctgcttaagttggaggctacttactctttcacctgacattttctttccttttattcttccagatcaggaatgaaatttccatgctgctcataaagataatattattgtactaattatttttattaccattgtaattatgatcattatgttgatattttagtcagggttttaaatgcacatttattccaagtatctttgtgttttctctttaatatttaaacttattctctctgtgagtatataagtagactggagggacatccagatgtccagttttgtcaggcaaaaaaaaaaaggaaagacttaggaagtaggaaaattgtttctgtcatctctatcccaacaagagacgtcaagaaagatccaccacagaacaaaagtttaaagaagaatcaaagccttgattgggcttctgacaacatggtcaccatcaaggttgtcattttctagatcccagaggcctgggatgcgacgtcaggtggcatctcatgggctcggggaatgtcgagtcactgactgtccagcccttagccagcttctctcccacatcctcagagctctcctgtgcttctgaaatctgttaactaaatctttggcttgcctctggtatttaagcaagaaaattccctcccagaggtgaccccatccgcttccccacaatccatccttttgccatcggcgcacctggggcgtggcttaggttcttcaatgcagggacatttgccccctcccagaagctgctgggcacagtgaggtggcgtaagagtgactggcaggtggtaccttcc

SEQ ID NO: 44568 - DNA, 1120 bp, Homo sapiens
cgtctggagatggggacggcgggagttgagttgtggcagtagttgagttgtaatttgtgggcggaggcccagagagactccccacccttcacccctgccccactctgtccccagttccgccatttgtgaggccagaggtttccggactgttggcctcgccaggcagccgtctcccgccccaggcggcatcccccagtccctcccgcctccacgagagcctggagctctcagcctcgcccggggctccactctctcctccggctccctgggctgttttgctctaacgatcttgccagatccctccctctgtagacaaccaccaacctctgtttgctgttgaattctctcctcacattacccaggtctgctcaagacatgattttggttttggtttctgagggttctagtgggcagaaggttggagggacacttatgagggtggccgggggtctgacgctgcactttggaaaaactcacacagttgaatttccaaagaaatctgccctttgccctctttgcacctttgatacattctggaagttttctcaggctttggacacttctggggatggaggtgtggagaagtggggagttccctctcttcatagtaaataactctgaaatatgtgaatgtgaatggcaggagaatctggccaaggatggggccgaaaagggtggttctaattgtttgcttctgatgttgagtctttagctgaccccacaggcaggtttccaaggtgcaaagagatctttcccgagtcagcggccccatcctcatcctccctccctttacttcctcactgtgcagtctccctcaaggatctactgtgaaaggtgtgtttgtagtgatatccaacctaactcagtaacgaagtcgttacttagctcttagctgtgaaataactctggaaacttccccaccccaaccataaattcttacttataaagaaacaggtccccaaactggaaacagcttagtccaggcctcagcgagaaggaaggacaccatgactgctccatgctgggcacagccgggcagtcttgccaagtgcctgctggaggctgtgccggcaagaggcctgcagcaaggagattcccttccctcgggccattatcaata

SEQ ID NO: 44569 - DNA, 1044 bp, Homo sapiens
ccctgtagtaccccgcgtagatctccgagatatcatgagttttaattttctttgatttcaatcttctggtttattcataaactagaaaaaaggaaacttttccagcaagtccttaccctgatagaattctctttgcctaaataagttttttgcaaacctgttttcacatgttaactaaggtaacacaacttgtaagaagaagaagaatagcagctattatggaatacttaccatgtgttgtgtatcattgaaagcacttgtattttctcacttagttctcaaaacaagcctatgatataggtacaattattacctaccttttactgatgaggccactgaatcactgagaggttaaatagctgcccaccgccctgtcaccagcacatgccgaagttagacagctgactccaaggttcgtgttctcacccacgaacacggttaggcaccctgaaccagagaggacagtgtccagccactggaagaattatccagcctagatgtcaggagcgctgggcgttggggagcagggccagcgcctcctggggactgcaccccccagatcccccagccttctgtagctcagcagacaggctctgcttctgtccctcctgcctggctgctgtgggctctggaatttgcccacttccctgctgcctctagggtggtggagatccatcatgggaagagcctggcctggctgtgtggcctcaaacaagatacccgggaggtggctgtgactctatgaggctccgtaaataccagctgcttctctcatccaattagctggaaactgaccagttgcctaggcaatttttatttcttaaaaataaatgatcaatatataaaaatagatgcacattcattttaaagtcttaaataagcacacaataaacaataaatttcacatccatcatgccagcagcctctcactgagtttgaagacaaacagaagtagttcccaaagtaaccacactaacttaaatatctctgaacaaacatgccggccaagagctatccaaagccagtgcctccctattgtatgaa

SEQ ID NO: 44570 - DNA, 1007 bp, Homo sapiens
cattgttccagccactgagggaattcaaaagaacattaacacttcctaacaccagaagcatatggctcccaggcttcaaagtttgtttttcacgtaaagtataatttcttctttaataaaatggtattgctaagatatcctgcctacgtcacagagtggaataaaataacccattgaagacactgtgtaaattccgctttttcttcatttaaaaattttttttataaaattaaggtgaaactttttttttttttttgagacagtgtctcgctctgtcacccaggctggagtgcagtggcacaatctcggctcatgcaacctctgcctcccaggcttaagtgatcctgccacctcagcctcccgagtagctgggcccataggtgcaccccaccatgcccagctaattttttgtatttctggtagaaagggggttttgccatgttgcccaggctggtctcaaactcttgagctcaagccgtctgccctcctcggtctcccagagtgctgggattacaggtgtgagccaccatacctggcctgtaaattctaaaatagaatattgttcaggataaacacctaggtgctcagggactttaaaagttggagggaatatttatctccagtccctagaacttaaaaacttggagccggtgtacttggcattcttcccacttgaaagtcctctttctcactcacagccagttatgtttcacctactccttatgagtagaagaaacccacccgttgagcacacatggccaggctcatcccttcagcagctgcacagctagtgagataaccaactgcagtcagcgtttaattggggaggaagcttgatcttatagaggagctctacttttagaacacctctaaggcaccttgttgtcccggttgcctttcagaaatacgcatgctcacggaagccattataatcccatcatgcagcagcctgcactattgaccggtcatgtgacccttccagcagcacagcccttaaatgtgggtgt

SEQ ID NO: 44571 - DNA, 1048 bp, Homo sapiens
ctgagattgttggaagaaacttgaatgttcgtcagtaagggattggttaaataagttgatgcacacgtaaaatggaacaccatgtagccattaaaagaacatggtagacctttgtgtcttgacatgcagagatttctaagatatattaagtgaaaaaaatcctgccctatccagtatcgtgttgtgtctttttgtcagttgctttttatttttctctctgcttgtcacttaatccatgccaatatgttagcctgttgagatgggctctctcctagatatttttaaacattcccttcaaaggacaaaaataagttaatttataaaactcttatggtggctataaaaaagcacaattaagcatttaaactgaaggcttcgtttttctacagttaaatttctaggcaccaggcagaggcattccaaatcctattatttgacataaatgtattcaaaaagttgacattgttctttttctctaaatactgaaaatcttttaaaggattttacttatgaacacttagagatggagtctttgaatccactcctcatgttaatttcattttctttgcccttttcctccccacctcccagcagcatcacataaaactttcagggaaacaggcctctgtggggcacccagaggatgtgtgcatggcaggtggaaatggtaatcattctgcttatgttagtgatatgggagtgatctttgtggatcaccttgcaacaaaagcttttttggtactgcctaaaaggagctgtcaactccatcctcccaagccccatgccacagctagcatcttggccaccaacagaaattgtgaatgagtaggtaatagtggagagatgggaagcacagttcttgattgagacagtattgaatttatctgacttgtcaaatgtcaggatctaaaatctcctttgactagcagggttagagaaatcactgtagactccacccttccatgaagtgttttgtgttcttctagccaatcaaatcatatcacctgaacctctttattttttacttatttactttatttcttgggct

SEQ ID NO: 44572 - DNA, 1054 bp, Homo sapiens
acagcacacagtaggtgtcctgcctgatgcttcgtaccagggatcggcaaactttaaaggcccagacactaaatattttaggttttgcggccataaggtcttggtaacaactactcagctgtcactgtagctgaaagcagccacagatgcaatacataaacagatgagtgaggctgcattctaatgaaacatttatgaaagtgggcagggctgggcgtggtgtctcatgcctgtaatcctagcactttgggaggcccaggcaggtggatcacctgaggtcaggagttcgagaccagcctggccaatatggtgaaaccctgtctctactaaaaatacaaaaatcagctgggtgtggtggggcgcacctgtaatcccagctatttgggaggctgaagcaggagaattgcttgaacctgggaagcagaggttgcagtgagccgagatcgcgccattgcactccagcctgggcgacagagcgagactccatctcaaaaaaaaaaaaaggaaagaaaaaaagaaagaaagtgggcagtggctggactgggtccctggcctgcagttggcttcacactgaaaaggagggaagaggagagcacagagctggatgaacctgactctgggtatctgtgcaggaagagaggtgcccgaaacggtagtctctgtagcgcaaaactagtctcagggccaaagattgctcccagaaccttcccagagtggacccagtctagtttgggtttggatttgttcattcatttcttcagcgtgctgtgtgccggggtacagtggtgagcagagcagacggccctgcccactggagcttgcagtccgtaagagagagaatggtataaaacaagtgatgcccaaatcaccaggctgctatgaggacaagtatcaggtgtgatgagagcatacccacaggggagcctcattttggggcaaaccaggaagactcccaggaagtggcctgtgaaggatgaggaagaggatgggcatgagcaggcagggcattgcctgtatggacaggacactcccccatgggcaggaccatgcaccc

SEQ ID NO: 44573 - DNA, 1043 bp, Homo sapiens
gtattacatcaagctgcaaccacccagaagtttgggtgtcgtgtctgtccccccagctctccttttggagttggaaccctgttcccttgcagcagctctccaccttaatttcttcagcttataaccaggcaaaagtaccctgctgcagagtgcacagagatcttggggtccacggtgtttggcttggccattccaaggatggctccgtggaagccagcgcaatgggtgggccccttgtcaacctcccccatgttttgctcctagagcttcatctctgggtccctttttccttttgcttgtctgcctatcaccctaatcaaagacaaaactatttctctttgatctcctgtttgcctaggaagctgtgtgtctttttaagaatccaatcacaggttgacctgggattagctcacctcaatggccatctacatctccacttggaccttctggatccccctaggcatggtgtggattcatcctgtggggaggctgcccctgttttcccagcaggcttgcctgtggtcacagggcgtgttgtctctccatgcagctgccccgaggtgctttccagcccttgcctttctggctgtcttctgtgcagctctctcttacctctggctccaattcctctgaaatagcctcctcctcctccctgctcttcagatttctgccactgtttcttgggtcctgtgctgcttcactgtaatccctcgcctcccactcccggtcaccagctcaaacagcggctcagagctcaagacagcaatgcaagtctccttatttttgcagtggaaacataagatttaacaacccatctgaaatacagttttacattttgattgcttctgccccagccatactgaggttactttcaatctacatatatttgtgggaacggactttttctctgcagttcgagtacaccttataataccagtgattataaaataccatggactaatagagtgtcttgcttccaaggagtttaaactgttttataattctgccaaccataatttatcttcataagctgccgtagagac

SEQ ID NO: 44574 - DNA, 1043 bp, Homo sapiens
aacctcaggtcaaccccacccaatcggtcacatgctaacttcctctctggtgatctttgcacaaacatataactcacagcatggtgtctggttcttgctgacatcaactttgtaactgttttcagattattttttcttttctccacagtaactctcaggcttcttgaggtcagaaccatgcattcttgttttgctgccacctccccacctgcctgcccctcatgctgtgtcgagtccgcatgtgagaaataagatgagagtcactggcagcaaagtgagtgccgacatttaaatatggaagcaagtctggggccccagactccaagcgcctagtacctgtggccttgctcactgtttttcatatgctgtcctctggtcttgtttgtaaagtgacctgttgcacaacctgtcagtaccctgaaggtcagtgactgtgtccacacctctttgtgttctcggtggttagcataatatttttaacataacggactctttttaaatgtttggtgatgacacagtcactgagcaggatgtgctgtaagaagaaaacatactctccctcattctgtgaattagtcagaatatatcaggttaataacggtaagagcaagcttctgttggtctgatgcaccagcatctattggatcaagcaattaaacccatgtcagtcattttggtacaatagaactaaaattagacacagcataaatacaatcaagacgtgagcacgtttcccagcattagccttacgatgacaaaggcaaatgcagaagtgtgcgaacttccaggacaggtccggagatggctgttccagagaagagccagggtggatggcaggaagcggcagctgggatggaacctccagtccatatgtggcacctcttttacatcttcatcgtaagcgctaccaggagtttgaaatgcaaaagttttagaaatataaaccaggctttacttagtaatattcattaatgacctaaaccaagagagaatctcctacttaatgaagtgattaattagctctgggaattgaagtcgaaaac

SEQ ID NO: 44575 - DNA, 1155 bp, Homo sapiens
ctcatttcctatgcgcagaaaggtctccacaggcctgtgctttcaccaccaggccccgtgcggacagacgggtctactgctgcccctccacttgctctccactccctcgtcctgaccaggccatccactctgtgccccgctggccccagagccaatggcagggagaagtaagcccagggcaggagcctccaaggaagacaagaagcctctccttgtctccagaggagaaggatgggcaatggttgagtgaatctggagggttgggtgcccggtaccgacagcacatattctctgtagagagtgcctgggcctctgaaagccagctctggtggccgtcccgggtaccagccccattgggggctagctggtgctgtgctggctctgggaggctgctgtgccacttcgtatttaggttggtaaattcagcatgccaaaggctggctctttctagttcttggcctgaattcagggtgaacagcccctgacttggctgctagggcttttatgtagttcatctgaattgctgcatcatgaacacgtaccagtgttattaacattcactgaaagctagcatggcgacttgtaaaaagacttcgacaaactctgtttaaaaggcagcacatccttagagcgaaacttggtgaatcgagtaagctgaattggggattcttaagacccccttgtcatcttgccttctggtgcccatgtgacgcttcctggagccctccctgcccatccccttggactctgcgagtttttctttgctttcctgcctggtgctggtgcccctagtgctgaggagacaggtcgcaaaatcggggatcctagctcaggaagcctgcggcagcagtaaaagtttgcctgtgagggttggggagggctgactccttcacctggactcacagcgatcctctcctgcccccctctgtgggtgagatcaggccttttggacgcctctggtgggtgtggtaggctggtttgctggcggttcctgggccctcaggagccctcttttccccacttcgtgacaggcacagtcacatctggcccctgtgtccccacatccctctgaaggaccctccgtttagttgtgatagtaccctcttttcacccctgaaatcaccattgcctaaaattctgagcaagaaggcctct

SEQ ID NO: 44576 - DNA, 1054 bp, Homo sapiens
aactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacaggtaagaccgtccacaaggagacaggagctgctgaatgcc

SEQ ID NO: 44577 - DNA, 1052 bp, Homo sapiens
acagactgtttatcgtgaagccatccatttctgtctccactgccatcccttgtctgggggttggcaaactttttctgtaaaggtccacgtggtgcatatttgaggctttgcaggccatctggtctctgccgccgttactgaagttgtagagtgaaagctgcacagacaatacatacacgagtcacgtggtgggaggggcgtgtgggggggggggcgtgttccggcaaaatcttactcctaaaagcagacttgggtttgaatttggtgtccagtctgtagtttggatccctgtagctagcctaagccaccataatgtctcatctggactggcttcctgacttgtccctccatgcctgttcttgaccttccccagccagtttcccatagtgatattaagtgcacattagattctgtcactgccgtacttcagatgtccaactgctttccatcacacttggaagaaaatcctgaatcctgaacagcatggatcacagcacagtcccggcttgcttctctgatctccctggacaccagtcttcccctctgtttgccccatcctggcctctttcagttctgtgactgttcccagctgtttcctgcttcagcaccctttcccacacaacagtcttcccttcctggaatgttctcctgcctggcagcctggttaattcatgctcactctgtggtcacacctcaaatgtcacttcctccaggaggctttccctgatcctccagtgtaaatcatattcccctcttctcatctcagagcaccctcttcttttccttcatgacacttaacaattttcatgaacccacttatttgggcatatttgttttccacctgccttccccattaggctgcaagctccatgaagatagaaacccatctgtggttgtctctgtgttctctaccccgttaccatcacgcacattatagacacttctgaaaacttggcaaatcagtgaatgattgtacaacatgcttttgttcatacagatttttgtatgaaactgcaatcgaggaaattgccacccttttagagtgtatagta

SEQ ID NO: 44578 - DNA, 1031 bp, Homo sapiens
ctgtgccattttcccaggaaagttatttgtgggagttctttgaggcttaggatgaaggtatatgtttcatgccagcagaaacagaaggtagatctatttagaaagaacagtgtattctgaaacttaataggaatgatttgtaattatagtttcacagtccttgttcctgaacccttgatccatatgtcttttgaactgcttttatttaatttttagaaagataatgtgatgcttgtatcacgtgacactctgtattttagcacattaatatttctgcagtaaacaatatgcatagtcagtttaagaaggatagatacagatcacagtggcctcttactaacttcagtcaaatttctactgccaaatgacttttgatgtcacttttatgtttttcaaaaaatgttttatttcatattttctcctgcttttcctgagctgtataaaaagttttaaaatgtcaattatacctcatcgaggccttaaaaaaatgtctttagagctcttagaatttcagaattgtggataaaggtttatggctgtgtgtgtgctcctttaaccatgtactccatcccttttatcccttttgtgtggtagttgggacacaggcgagaaatagatctctcaggactgtttggagtttggctacataggcaaagataaaagtgctctcatgttgtgaatatcgtgctaacattcttccttgccttctacctgctcttgaaatatgatgtgctgagactcaagactggtgatattggctagcagagaccacctatggtatatttgctttgtgtaagaataaaatgtctacgtgtttttgtttacatttttgtagcaataccaagtttccaggcccgaagagcatcccagactattgggactcctctgccctgccagacccaggctttcaggtaggggacgcatgcgcctggggctggacaggaaggtgttctgtagaagtgggtgtgtgtgaacagactgtgccattcctcaacactgaagaagctgtaaggctggggctaattggggca

SEQ ID NO: 44579 - DNA, 1031 bp, Homo sapiens
cagagacgctcctcacttcccagacggggtggcggctgggcagaggctgcaatctcggcactttgggaggccaaggcaggcggctgggaggtggaggttgtagcgagccgagatcacgccactgcactccagcctgggcaacattgagcactgagtgaacgagactccgtctgcaatcccggcacctcgggaggccaaggctggcagatcactcgcggttaggagctggagaccagcccggccaacacagcgaaaccccgtctccaccaaaaaaatacgaaaaccaatcaggcgtggtggcgcgcgcctgcaatcccaggcactcggcaggctgaggcaggagaatcaagcagggaggttgcagtgagccgagatggcggcagtacagtccagcttccgcttggcatcagagggagaccgtggaaaggggaggggaagggggaggggcgttttctatattttcaatactatgttattgagtacaaattctaagtggttacatacgtctttctggtgaattgaatccttggtcattatgaaataaccctttattagtgacagttacaccccctttcttttggaagcttggtatctttttcccatccttttatttgaaacctttctatattttttaatatggtatgtgtgcatatttaacttattttaaaatctggccagatacagtggctcatgcctataatcccagcactttggaaggccagggctggaggactgcttgaagccaggagtttgagaccagcctgggcaacatactgagaccccatctctacacaaaaaaattaaatccaatgaaatggcctttcttttaactggagtatttagtaaattacattgaatgtaattctgtttctttattgtctttttgaattgtttcatatttcactttttatatttttattaatttggaagttatatagttttatatttggtggctactcaaaatctgaagttaatccctttaactttagaacattttaactatttttttttctcaccccatttccattcct

SEQ ID NO: 44580 - DNA, 1638 bp, Homo sapiens
ccattggttgacaattctcattgattattgtttcactgaggaaatctaactaagtattgtaacttcacattcagctaaatttgaatatttgacaagtgagaggatggggctaaggattaacctgaacctatttgcgtagatagcatctgcaaaacaaatagctagtgtaatacatgtgcaggaaaaaaatgctcaaactgcttgatagctaactttttggtactgcagagcacttcagttaaatactatgagcagaaccgtgttgcctcctgatgataaagaagtctataaggcaagactttcttaacctatatgaagttgcattaaagtaagaaaatggcatttatttgttttctatttcagattggttaagtattgccatattttgaattctaccttatcccatagtccattgtcaaactaattatgcttcctagtgtagcagtgcagtggtctgtaaacaccacttcatgggtttatacgaaaactgtaaattaatcacaatttggaactcaggccttcggacactggtactaatgtgaactgatttttgcttcccaatcactaattttttcttaaaggagaatattagaagacagtatcaggagggcagaaattatcctggtcaacttgcatgctaattccccaatgagtgatgtgtttttttttgaaatgatagccttagaatattttaggtgttacaaaagtgaaagggaaaagtcagtctcctcattttatgcctgagaaaactgaaatccagacagtgttgcacaatttctacatgccaatataatgtatttttttgtcattatgagctgtacaccaagatatcattagtatacagaaagctttgtaagccatatacacttttatattcagtgtaaattgtgcagctctgtcttactgctttccttttcctctgaaaaatgtcccttttttcctgaaaggtccagttgaacttgagaaattaagagtatagggaaaatatttgtctagactacatagttttatagttggtttaattatcataccaagttaaaatattttttgattagagcatctgctgatgtaactcttaagtccaataataagactgtaatttttctctgcaggtggtgacaaagtgatagatgtcattgatgtggcgaggcaggcagacagcaaaatgacacttcacaattatgttaaatacttcatgaatcctaacagaccaaaagtgttaaatgtgatcagccttgaattttcagatacaaagtgagtagttctgggtattttggtttagcattctgagtgttagctaaatgtagtgtaatgatgtatttattttaggaagaaacatagttgtgacttctaaagttgtccagtggtagcaatgttataaattttgcattgggacactcagagatacttagaaataagatgtattttaaacttttggctgggcacagtggcttatgccttaatcccagcattttgggaggccaaggcgagtggatcgcttgaggccaggagttcaaaaccagcctggccaacatggcgtaaccccctctctactaaaaatacaaaaatcagctgggcatggtggcacatgcctgtaatcccagctactcagagaggctgaggcacgagatctctcga

SEQ ID NO: 44581 - DNA, 1056 bp, Homo sapiens
taatcggaaaatctgaaatgctccagtgagctcttcaattctcaaaacattttggattttggagcattttagagtttgtatttttggattagggatactcaacttgtacatattttactataaactggttggttttttctttttgcatttagaccagtttatatatatttctaattatatgtattgaattgtgtatattacattatctataaattttagtttaggatagcaaaaggagatttacaaaacatttgtcattaaaagaatgagaagtgataggttaagaaccactgatatagataatccagtatatgaattaacccatcactaccgtattttttttaaactgaccttaccaataaaaatgacatttttattcttatgtttttccttagtgccgatgaaataattataaagatgcatggcagccagctgacacaaagatatctggagaaacatggatttgatgtccctattatggtcccaaaattagatgatctaggactcaggctcccttcacctacattttctgtgatggatgtggaacgttatgtaggtacgaactttatttctttaagtacctgggaaaacatggtaaaagtaaaaatgatagtcctggtaatattaatggttaaatgaagaaatgtcaatttagttttctgctcagaaaagtgaggctcagtatcatctatattgaaaactagtttttctcagcagacctacaactgtcagaaaaacagaatgacaatttacttgattttatttactcagcttcatcctgctgctttcttttgtgccattaagttctctgatacttgcttagggaaaatcattactgagggatagatatagataccaggaagaagatattggaaagttggattggttgtaggcatctgtagaatacaggtgcaaaattcccagatcccagtacaccagctgcacagttagtcctctggagtctgctttgtgacctgctgctgcttagaggaaaggtggtaaaaagagcagatcattttcaaatctgtttttataataatgacttggtgaatattg

SEQ ID NO: 44582 - DNA, 1987 bp, Homo sapiens
atatagttagcttcttgaatatttcagaaatgtaaagcacctcctccttctttagaacattctaataaaaattattaccttcatgaaataatgatttgtgcttatttgtaaggatgcattcaccatttgcattgccagttactctgtgtccaagatgtcaggcagtaaagagcaaaataacaagcatttatgtacttgaagcaaataatgtatcaccatacaaatcatattgatgtgcatatttcacatattcattgtgggacagatttaattagaagcttgtcaacaggatttttagctttttggggagtatgttttgtaccactgagtgcacatcttggctcttcaacctaattttcctctcatgttgtttgatcagttcctttttatactgtctttctcccttcacccttattatcatagattcttttaatcagctggttggaaataactctggaagccctgggacagttggaagcatgagccctgctgttggaggtaggaaaagtgaaccataagtgaaccttaagagatgattgtgaaccaaaggaatttggttcagagtatgcatttacttcagaccccttaagcatatagtatgccactaaacagctttaatgtgtcaattatataatcttcacaaaagtggaaacataccatattcaatttatgaagaaaccatttaattttgtgaaaacagttttatgtcagcaagaaaataatagaagttgggtttttctgagccacaaatttaatcatacattaccagtttgatttttcactggaaataattcatacaaattataaatttttaccttagctgatatctggtaataaagtgatctgtctcagggttaaaacattgtataaaacgattaacaatttaaaagtgaaaatgcctattggcatcctagtatttttagtaagaatgtcaacttattaagccaattaataagccttatttttactggctagcaacgtaagatttttggacaacaaaaccattgttctacagtttcattctaagcattttatgtatattaattttcttaaaaatcctttgagggggttactgttactatttcccatctttacagatgagaccaaaaaacaaaaaacaaaacaaaacaaaacaaaaaacaggtaaagtaagttacccgaagtcatacagcttactaagcggggtagctgggattctaacacaggcagactgactcgagagagagagatttttctcaactccaccatctaaaattaattaaaaatagaaaacaaattctctcttttttttttttttcttgaagcatagccatttgagtgcctggtgtgtgctctgaagagaccttattgaagaaaaaaatactaagcccaatcataaaagcctagttcctatttgggctcaaacctcgtagctaatacgctgttgattagggcagtgttggctgactggaacctggtagagacatgataataatattaatagctgctgtttatgacttagtatgtttactgtgccattgcttactataggcttagtcccatgctttacatactgacatacattgtcctgcttaatctcaggggaacgcctgctcctcaggcagattgagaaacctgctccaagtcaaaacaagtagagctggaaatcaaatcaagtctttctaattctacaatctatgcatcccattgaagccagttgatatgtgtttatccggtgtcatggaggtagtagactgaggataccttgcctctcctatagctgtctctagacctaaactgaccccagaatcaagataggaaaggaaacatgcagagcaagctgtcagctatcctctgtattcccggagttaatttacctcaaaggccactccccatcctcctttgttagtgtgggactttaggggtacacaatgactcagtcctctgattatgtcacatgtcacagtgaagaaaatgagtagttgggtgctttggatgagaaggtgaa

SEQ ID NO: 44583 - DNA, 1250 bp, Homo sapiens
tgtccaaatccattattatgttcaaaacatgacactctaacagaagtaaactgttgctgcatatttaatactattttctctttacagacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaacttaggatcctctaggaagctaatctgcttagtctatttttagaggattgatctctggcacaagcagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccct

SEQ ID NO: 44584 - DNA, 1069 bp, Homo sapiens
aataggaacagagtttctatttggatgatgaaaaagtttggaaatagatggtagtgttggttgtacagcattatgaatgtaactgataccactggattgtacacttaaaaatggttaaaatgggccgggcgcagtacgcctgtaatcccagcactttgggaggccgaggtggacggatcacaaggtcaggagattgagaccatcctggctaatgtggtgaaaacccatctctactaaaaatacaaaaaattggccgggtgaggtggcaggcgcctgtagtcccagctgctcgggaggctgaggcaggagaatgatgtgaacctgggaggcagagcttgcagtgagccgagattgcgccactgcactccagcctgagcgacagagcgagactccatctcaaaaaaaaaaaaaaagttaaaatggcaaattttatgtaagctatatcttaccataataagagaaaaaaagaaaatgggttaaataagtgcaattagatccttttcagtaattgaaagtaaaataaaagaatatgctgtaggatgcaaaggtagtactgcaacactgtgagcaaacagcctaattggaaaatgagtggcatacttaaagacaaactatttttgaggcatcaattatagtacctttcattggaagaaagaatgattaaatgggagtggcttgcggatgttcatcttcctctctaaatagcaaagtgaataaaaataaaccttctgaactgacaacttctattatacggtttttccatttggactctgcatgcttaaatgggccattaatcacagcaggcacatgtatgtggaagagctttgtaaactgcaaaacatacaaatcctgttcccttcttattttctaaaatagccatgtttaatctactttttagctgcttccttttatgaattataaagaattatattgtaatttttttttcctccctttcagtatttagtgtctctgatccgggacaagctaggatggatgtgggttttctactttttcattctcatggtaagtgtgtgcccctttaaaaaaaaaaaagtcatttttctgttaa

SEQ ID NO: 44585 - DNA, 1028 bp, Homo sapiens
taccactacagattgtagagtactaattttgtagaaagatggatctgagagtcatctgtatggataaaaatagttgaacctgtggaagtgaatgaaacatttaatagggaaagagaatgttggccgagtctcagggaatgcccagtggtcaaagaaagaggaaggcagcagagtaacctgtagtcaagggaactgcgtttgagaaggcgttagtaaggtcatggatgtagagaggtcaggagaaagagaactgaaggatttgtcttttaggctcttagttttgacatctaggaggtcattaataaccttgaagattattgttacttgcttgatgggggtgaattgctgatgtctgattgctagtggttaatgagagataagtattgaggtaaagtaagccatgttaatactttgactacctagccgtattttaatagtctatatgcacttgttaatgtctgtctctcccactgtaacataagcttcctgagcgcagcattttgttgtatgttcttctgtcaccttagtacctagaacagtgcctggcacacagtagacattacttgtggaatgaatgactgatatgcttggcatatttgattataagactaaagggcaaaaaaccccaaagaaacaaaaaccttagcaaagccttgaaaaatacgcttacctgatcatgccctggagcgggaatcgaaaaatgctcccagccatcagttcagacgtcttcacctatggggtagagagtggctgcattgggcatccttttctgacattatattattttaagttatccttccttacgaatgttttcttcactaactaaatgggtgcattataatgagtatttcagagaatttgcttttattcagattgcctcacctgccagtatccagatccctcactgtgaacttgggtcctagactgaccttcatggttggggaagcacgtctggagtaaatcactgttagctttactcattcctcttccatgttgagttttgaatgatttcccattgcctaaggggt

SEQ ID NO: 44586 - DNA, 1053 bp, Homo sapiens
ttctggtgacggcgtctgtgcagtttgctggtgggatcgttatcttctttggactcctggtgtcaccagaagaaattggtgaggagaagccgccccttctattccgaatgtcttactattatggccgaaaggaaatctgaggccaagaaatcgaatctcttttttcctaggaaaactctgagctccttttagtgagtgaaaggagaacagtactgccgtttgagtcctgtcgacattgtagccagcccctggcacagctggacgtgtttgaggggagtgatgcacgtcttttatagatacaggaaaatcttcgcatttgcaaattatttttataattgagacactggcaaggaatgaacatagatgtatttctgatttcacttcttgaaacatttcttttcatccataaaaatgatgcacaaaaaagatacttaacctgtagttaaatacagattacatacaaatgaaaccacagaagcaaacagatgtacaattcttctatcttttgagtatttttagatagactgtgtgactttaattgaccttagttgacctcggtctctggaccttcgttgctgcttctgtaaaatggaaataaaaataacatcacctcataagtagggatgtatgcagagcccttcacacgtggtaggcactccataaacagtggctgtcgctgttattttaggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccggtaaggaccgcttacatcttaccacagccagggaggtatgagagcccgtgacatctcctctgcctgagataaagcttccttaagtattgagcctctgttggatactttattttaggaatatacgtgctgaggaatgttgtctagtgcccctcagcttatctgatctctaatgcaggggttgacaaa

SEQ ID NO: 44587 - DNA, 1104 bp, Homo sapiens
ctcggcctcccaaagtgctgggattataggtatgagccaccgtgcccagcttgactgtacctcttattcctctgttgcttgaatcatgtgaatatattacctactcaaaaacctaaattattaaaggtaagttcgctcttttaaaaggtagatacatttttaaacagctcaccaagaattttggtgtagttagggtcagtgagaagtccttcattcccttcattcatggccacctttattctaggcttcttagcctcacacctggattgtatagttggttcagatgaaaatttcagttcaccttctgagctgctctcagatttgacttctggaaacactaattttgtcactcatcggtttaaaaattcagtgtccacatcaggttccattctctgttaaataaaaattcagctgtgcagcctgggggttgagagtctttaatctagctgtcacctttccaaatcagttttcttcctgattatcccctagcagaagccctctccttgagtcgtgcagtaagctttctatctccttccaccctgtgtctttgcttaccgtgtgcctggaaagatgggcaattgactttgattttccattcttccctaagacattgtcttactgcttcaacctcttcagctctttccttcatctggattcccgtatatgtttctcagtaggattgggccttctcatctattcagcttcttggtgctttataatattgtttcatgtatttaatcccctcaactgtatgtaatatctttgagggcagatactgtcttttatgagaggctatgtgatacaaagacctagatttttggagctagtctaatttcacaatcataacagtaccacttagtatccaggggagcttcattctcctctctgagcctcatacaatcaccaggaagaattaaatgagaaaacacgagtagaacactttgcatggcgcccggcccagtagaagctctgggtgctcccttgcttcccggtctcccttcccacctctcccccacccccaccttcccccacacacctttaatgaatgtgcttgtgatgactgtccccagatatgtaaggaccacctttcacccctctcctcca

SEQ ID NO: 44588 - DNA, 1911 bp, Homo sapiens
agaaataatgattatttatttatttatttgagatgggatctcaccctgtcgcccagactggagtgcagtggtgtgatcacggttcactgcagcctcgaactcccgggatcaaatgatctacccgcctcagcctcttgagtagctgggaccacaaccatgagccaccatgcctggcttattattattttttattattattatttgtagagatgaagtcttcttatgttgcctaggctggtcttgaactcctgggctcaagcaatcctcccacctcagcctcccaaagtgctgggactataggcgtgagccaccgtgcttggctcatcctttttttttttttaaagagaagaattcttggccaggcacggtggctcatgcctgtaatcccagcactttgggaggccgaggtgggtggatcacctgaggtcaggagttcgagaccaacctggccaacatggtgaaaccccgtctctcctaaaaatacaaaaatcagctgggcgtgatggcacgtgcctgtgatcccagctactcgggaggctgaggcaggagaattggcttgaatccaggaggctgagtttgcagtgagctgagatcacagcactgcactccagcctgggcaacagagcgagactctgtctcaaaaaaaaaaaaaaaaagaagaagaagaattctaaaattgttcagtgtcatgcttataatcctggcaatttgggaagccaagtggtgggaggatcgcttgagcccaggagtttgagaccatcctgggcaacatagcaagactctgtcgctgcaaaaaatacagaaatttttgtagcctgagtagcctaagtagctaagatgacaggtgcactgggcgtggtagagtgcccctgtaatcccagctactcaggctgggctgggaggctggcttgagcccaggaggtgaagcctagtgagctatgatcataactgcactctagcttgagtgacagagcgagatcctgtctcaaaaaataaaaagaaataaaattgagagagcctctctgaatctattttggttcaggtggctgcccaccaaataaaataaaataaaattgaataaaagaaatgggcctatacctgtgattttattgaatgctgtttctctttgctattcattcatctgtattctctctattttgtagttattcgttgctccatgcttcacgaaaaacatttagcaatgtcaaagtcagtatctctgagcagtggaccccaagtgcttttaacacgtcagttgagctgcctgtggaggtaagcagaacagagtgctgggatggatcgaagtaggagaccgtgcccacccctagattgttcttaagctcttttttgcatcttttacttgcctagactctgaaatggctcactgtttcctatcacataagagccaaactattctaatttcaaagcctgctctgactcagtcccattttacctctccagccggcttgtttctaactgttgagaaatcacaccttttgacaaggctgttttttcactggctttcgttagtgctgtgctcgtttctgtctttgagattttgcacattatcttttatgtgctcttttgcccttttccacctatttaaagtttgcctttctctttgtgtcaagataaaatatcacttttttttttttttttaaacagagtatcattctgttgcccaggctggagtggaacgatctctcagaaaacatctctgcaacctccaccttctgggctcaagcgatcctcccacctcagccccctgagtagctgggactacagtcgcgcaccaccatgcccagctaatctttttttttttttgtagagatggggtttcaccacgttgcccaggctggtcttgaactcctgagctcaagcaatccacccgccttggcctcccaaagggtt

SEQ ID NO: 44589 - DNA, 1033 bp, Homo sapiens
ctactatattccctatttatttgtaagtattatgtgaacacagttaattagatttataaccggctcccactttttttcacttgacattttctcatgtcattaaaaagtcttcgtgacaaatgattataaatgattcagccattcagacataccataatttatttaattattcccctattgttgtatatttggattggttctgcagactcataactggagacattaagtttagctgcttactttatgcgtaattgttcttggatatcagagcatgggtgcagcttttagagagtacagtcaaatgaaaaggcattggggccaggcacagtgccttatgcctgtaatcccagcacttttggaggtcaaggtgggcagatcactttgagctcaggagttcgagaccagcctgggcaacatgatgaaaccatgtttccacaaaaaatataaacattagccaggcatggcggctcatgcttatagtcccagctacttgggaggctgaagctggagaatcgcttgagcctgggaagcggaggttgcagtgagtcgagatcgtgccactgtatgccagcctgggtgacagagtgagaccctgtctcaaaaattaaaaaaaaagccactggaagtagtggaaggagatggcaaggggtggcctgacctctttctctgtttctttgacacaaattttttcattttggggagatactggggggcagacaggggttaggcagcttgcccagagtcttgcagtgggacctcacctcaaggcaatagaagatcatttagaacattgtatttaatcattttgttttgttttgcttagagtcaggggtctcactttgttgcccagggttgactgcagtggcgtgatcatagctcactgtaacctcgaactcctggactcaagggatcttcctgtctcagcctctccagtagctggggtactacaggtgtgagccattgtgcccagctccttctttcttttaatattaaaaatctcctccaacactttgtgaaaaatacttttgtttat

SEQ ID NO: 44590 - DNA, 1047 bp, Homo sapiens
tgagccactgcgcccggcctcagactctgtcaaaaaaaaaaaaacaaaaaaaaaaacagaaattgagattcagagaagctacttttaagtggagggtcttagattccatacctggcttgtctcttgaatgacaccattcttctattagtgtttgatttcgagtctctgcctaagaaggtgacccggaaacaatacttttataaaagttaagtcaacagtatcttgctgctttctagctgtcaggatcaactgccttgttcattgtttaaggttctgatttgtgctctgttcatcagtgttaatgtcatgtcactgcagtgaccattaacttgattataaatcctttggtagaagagggaaagatttttatcttgaaaactagttgtctttggaacatgtccaaaaacagggaggaagaatgtggttttggaaaccctggaataaaatgagagatatttacagataaatgccaagtattttatgcctgtggtaatgagataatttaagaagagataaaaattacaggaagacggatgaattaatgaataaaaaggatttatgaggttcaagtaaatggcttcgtatgagataatgtgggataaaaaagatacttgtggctgggtgcagtggctcatgcccataatcctagggctttgggaggctgaggcaggaggatctatctcttaaggccaggaatttaagaccagactggttaacatagcaagaccctgtttctacaaaaactaagaaaattagccaggtgtgatggtgcccacctgtagtcccagcaactttggaggctgaggcaggaggatcgcttaaacctaggaaggagattgaggctgcagtgaactatgatcacgccactgcactccagcctgggtaacagagtgagaccctgtctctgaaaaaaaaaaaaagatagttgtatgagtgtgagcattgagacgctaaactgcaacatatacaatactgtaaaaatggtgaactcaactatacatttaataatttcccacattcttctttacactttgaaaacacataatc

SEQ ID NO: 44591 - DNA, 1066 bp, Homo sapiens
aggcaggagagtggcgtgagccaagatctcgccactgcactctagcctgggcgaaagagcaagactccaactcaaaaaatgctatcggaaaatgtttaaacatctaggaatcatttctgagtgggcttatactgtggtcatgataacaactggggatccactgagtagtctggtctgtttctgtaagcttgtagcccagcagctaactcccaggggagttaagtccaccctcaggtgtaccagtcaggctatgctggggacatgcagagggatggggaagagcctgagaatgggttgggagtgctggagctaggaggtggagagagccttgagcaattctggaaagtaggaagaagcatcgtttgcatatctgaatctgcaacagggagagggggatagcaaggtccagggagtggcagttggtcacttctgggatggagagaagtgtatgtttagagcaactcttttgtatcttggaaaaggcagtggaagcttctgtactagtccgagtagtctgtaatgtggattgctaccctcaatggctgcattgagagcgagttctcttctttccccaagtgttaattgcctgttgcaaaagaagctgaggtgtaaacattgatgggtggaacgtctcaccttctcatttgcacaaaactacaatttcagcctcttccctgccactgtacacaataagtgatttcacatcatgccagtgatttgggggagagaaggggcttgatattaataaaggtagttgataaaggaggagaaagaggcttgatattgataaaggtagatattgaaatggtagtcatagtactggcaacagatttccaaccctgctttgtggcttcgtggttcaattgcaaggcccagctgacttacctaggctgaaatgtgagaagtgtcattgccagatgaaagtttaagatcccatacgtgatcctctttccaggcaattggtaaattttgcaaagtggctgttctaccagcctgggtcaccatgctggtacacttagttaacccatgagggacatggaatatgagcaacccataaacctttggg

SEQ ID NO: 44592 - DNA, 1112 bp, Homo sapiens
gtttttacaagcatgcgtaccctgatggccgtagagaggagccacagagacagaaagtgggaacatcaagcagataccgggtaactctcactgtttttttaaaggaggggaaattccaaggtatcagttgagtcctgcacatattggggtaggggaaggagaaggttaacgctcaggtctgggagcgaaagtgtagagtattaaaggaggaaacaaacctcagaaaactgggagggataggaaaggaagaaaaaatgtgtgttaaagctctagcctaaacgatttccatgaagtaaccagaggggaggaagtggtaaatggaaaccctaactaagaagtctggttcgtcatgccctctggtgtgctggacgttttgccttataaacaacaggatagaagatactgctcgacagtgccatccctatcatggccttgttttttacaggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggttt

SEQ ID NO: 44593 - DNA, 1030 bp, Homo sapiens
gagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaagaaaaaggagtctgtgtgaaatgtcttcttttgtttttgttttttacctaagttatatttttcaaaaaaaaaaaaaaagaactggctagcccttgagttggatttataaaggaggttgccttgcttgaaagaaatggtcagttgtgtgacagtatgtggaaccctttcaggaaatgcccacgtgcctttcagttaagtctttaagtctggaggcgacacaccagggtgtgtccttgaagagtgggcctgtaaaaggggaatttgcattgcagcctgttcattgtttcccaggtcctgcccagaatgccggatcacatctaactttgtcattccaagtgagtactgggtggaggagaaagaagagaagcagaaactcattctgaaatacaaggaggcaatgaggtatgagcactgcagccttttctcaagcgaagagcccaacagagcttgggttcactttgaaaagaatggtgctgcattatacactcctacctccttcctacccttctttgacttcccaggacagtttattttgtc

SEQ ID NO: 44594 - DNA, 1073 bp, Homo sapiens
gttgctactcattttgccctttgctaatttgtcattgcattattgctgaaaaagggggaaaatgacacaatgacattattctcaaactctccaccaggcatgtcttttttttttttttttttttttttgtgagacagagtctcagtctgtcgccaggttggagtgctgtggcatgatctcaactcactgcaacctccgactccctggttcaagcaattctcctgcctcaacctccggagtagctgggattacaggcatgtgccaccacacccagctaatttttgcatttttagtagagttagggtttcaccatgttggccaggctggtctcaaactcctgacctcaggtgatccacctgcctcggcctcccaaagtgctgggattacaggcgtgagccaccgcacctggcctctccaccaggcatgtcttttgcagtcccaatataaaaggcagagtcatgagaacttcacactgcaatggtgaatggacgaatctttgtagtggtatagtctctgcaggtattgaggctaattgtaagggagctgtgttccttgaactgggttctagtcttttgagagttactgccaactgtgactggggcaggaggagttgaatattgatgagagtgaagaatccaacctcccaagcagagggatgagaatagactgtgagatagaatcagaaagctatagataattagcagttggtccttatttcagaagaagtgctcatctgaatggactgtgtagatggagtgaatgaaaaaaatgaaggttaaattgaagaaatctgtgctaagcctctgcatttttttttttttttttttgagacagaatttcgctcttgttgcccaggctggagtgcaatggcatgatctcggctcaccgcaacctccacctcccgggttcaagtgattgtcctgcctcagcctcccaagtagctgggattacaggcatgtgccaccatgcccagctaattttgtatttttagtagaggcggggtttctccgtgttggtcaggctggtcttgaactcctggcttcaggtgatccgcccgcctcagcctcccagag

SEQ ID NO: 44595 - DNA, 1049 bp, Homo sapiens
gctggaggaggaggatggaagtcagcgcgtggcatccttgatttctaacccagctggatgatgttttaaatggtcgctaggtgccaggctagccaagctttttttttttttaaacagggtcttgctctgtctcccaggccggagtgcagtggtgcaatctcaactcactgcaacctccgcctcctgggccaagtgattctcctgcctccgcctccggagtagttgcgaccacaggcacatgccaccacacccagctaatttttgtattttttgtagaggcagggttttgctatgttgcccaggctggtcttgaactcctggactcaagccatctgcctgcctcagcctaccaaagtgctaggattataggcgtgagccaccacacctggcctgtagccaagcttttttaatccatagaggaaaataatcctgggggaaatggattcaaaacaatttactaaaaattaactcaataatacagctgctttttttttttaaatcttgaagtagggataaattataaacagtaaatgtagcacttaaaaccagcttttaaaatattcattcacggggccaggcatggtggctcatgcctgtaatcccaggactttgggaggccgaggtgggcagatcacttgaggtcaggagtttgagaccagcctggctaacatggggaaactctgtctctactaaaaacacaaaaattagccaggcatggtggcacacacctgcaattccagctcctcgggaggctgaggcaggagaatcacatgaatccaggaagtggaggttgcaatgagccgaaatcctgccactgcattctagcctgggcacagagcaagactccatctcaaaaaacaaaatggtccagcaaggtggctcacgcctgtaatcccagcactttgggaggctgaggcaggcggatgacaaggtcaagagatcgagaccttcctggccaacatggtgcaaccccatctctactaaaaatacaaaatttagctgggcatggtggcacgcacttgtagtcccagctacttgagaggctgagg

SEQ ID NO: 44596 - DNA, 1029 bp, Homo sapiens
cagcactttgggaggccgaggcaggcggatcatttgaggtcaggagttcgagaccagcctgaccaacatggtgaaaccccgtctctactaaaaatacaaaaaaattggccgggcgtggtggcgcatgcctgtagttccagctactagggaggctgaggcaggagaatgccttgaacctgggaggcagaggttaccgtgagctgagatcgcgccactgcactccagcctgggtgacagagcaagactccacctcaaaaaaaaaaaaaaaaaaaaagaaagaaattttaggccaaaggggatttcccgtatcttgaaagttagctaaataaaaatgagcacatttccaggcattgcacaacttctgagtacaaaacaccaggcacagataggaaacaaacagaagtagggtctcaggtcaggcagagcaagctgcgctggtctgagggcgacctccgccttactttcacagttggcaccatagccagtgcaactgaggactaacaggtcactgtgcaccctgacttctgctgcaaagggaaggggatcaggtcaccttctaattccaaaaccagcttttacagattataacagcacttgtatgttggagagtagtttagagcttacccacacttgcaaacaaatgaggctgtgtaagcagccctgcaggtgagttgaggacatggtactgttattactaattcattaagaattaatgtatgctggccaggcacagtggcttacacctgtaatcccagcactttgggaggccgaagctgtcagatcacttgaggtcaagttcgagacaagcctggccaacatggtgaaaccccatctctactaaaaatacaaaaattagttgggcatggtggtacacgcctgtagttccagctactcaggaggccaaggcaggaaaattgcttgaaccactccagcctggaggacaagagtgaaactctgtcttaaaaaaaaaaaagaattaatgtatgctgggcatggtggcttacagctgtaatcccagcagtttgggat

SEQ ID NO: 44597 - DNA, 1033 bp, Homo sapiens
tagacaaccttccaggatatcagaaggggaccagtgccctctgtttaccctccagctgactgatgcatctaatagggtggaaaaatgtcagagaagagagagcttcttaatccctctcaaaacaatcagacttgaagattccagcaccacagagagccaagagagcctcttattccaggctcttctttcccttgaatataggacagccaagattcctggtctggtacagaactgagagagatgggtaaaggggctaagaggctgcttctgggtacacacacaaccccgaggttcaggctgccaatttgtcagagaaaacgagaaagagaatgctccttttgggaccaagaaagaagcagaacaaatgcaagagtcccacgaggcagatccacatgttccttccccacacccccgaaatctggcttctattcctatccatctgctgaaaccatatcttaggttactaatggttcgtctgtggccagttccctgttctcatgcttcttgatctcactaatgcacttgacacacccctgacccttccttcttgaaacacaagtcaaggtggatgtaaaatgggtgcagtgatgaatctgcgccacttgtcaaaatactgaaatacttctattctggttggtaaatagggtgtcccacactcccaggaccactaactctccccctgccaagatctggccattaaagtgttaacaataaggccattctgcttgttgggctcctgcacacctttgttataattttgttgtgtgtttttgtttttgttttttgagacggagtctcactctgttgcccaggctggagcgcagtggcatgatcctggctaactgcaacctccgcctcccaggtttaagtgtttctccttcctcagcctcccgagtagctgaaattacaggtgtgtgccaccatgcctggctaattttttgtattttattttattttatttttagtagaaacaggctttcaccgtgttggtcagtttggtctcgaactcctgacctcaaatgatccgcccgcc

SEQ ID NO: 44598 - DNA, 1044 bp, Homo sapiens
gcactccagcctgggcaacaaaagcaaaattccatctcaaaaaaaaaaaaaaagaaaaaaataatggcatgaagcccccaaattcattaagctaaaggagcatgatatcacaaaggtactttgtggtttaaagaattctttatgctgataattatgttcagtgatgtgcctatatttaattttttgttagattgaaggtgaaattaactagaaaataggcagtctggattttctttctctgtcaaacgtgtggtgtgaacaaatcagttgacctcttaattgtatctttagcaaaatgaggataactactgcctctctcttcctaatagtggcattataataatatgataggtgaaaatgagttgataattcagaggtggaagtattctacaaattgacattactactttacattcagtttctgagaaattttgttcattggaactgttttcagcttgatcagaaccatgatacataaaacccaactggaaaattctgcagacttgctatttaattgatagagctgaaccatattctgtatactatatatgttgtgttcttccatgggtttcagccgtttttgcttttaaattagcaatgctgttgctagacttgaaatatataactagttacttttcagtgaagctcaaatgaggcttttctgtgtctctaggttatttgagatgacttttttaaaattagctcttgtcctccctctacaggagaatttgcagccttcaagtagccaccatcatggcagcatctgctcttatttcttaagtcttgtgttcgtacaatttgttaacatcaaaacacagttctgttcctcaaatctttttttaaagatacaaaatttccaatgcataagctgatgtggaacagaatggaatttcccatccaacaaaagaggaaagaatgttttaggaaccagaattctctgctgccagtgtttcttcaacaaaaataccacgagcatacaagtctgcccagtcccaggaagaaagaggagagaccctgaattctgaccttttgatggtcaggcat

SEQ ID NO: 44599 - DNA, 1050 bp, Homo sapiens
cttgtaaaataatgacagtaaaaaaggcaaatgatatcttattgttattacaaaaatagttttgacctcgtggatcccctggtggtccacggaccacattttgtgaaccactgctttatttcttcttggtggtaaacagattcaagctttcctttaatactgggtctttttgaggggcatttctgcctgatgcagaaaaaggaaaaggcagtaaggcatttgtcagctcagcctgcctttacctaattcttgataactcactgcttttttttttttttttccatattggaaggataaagccttaagttaacaaatttcaaaaagaactgtaactaaggccaggtgtcgtggcttacaaatctcaacactttgggaggccaaggcaggcagatcagttgaggtcaggagttcgagaccagcctggccaacatggtgaaaaccgtctctactaaaaatacaaaaattagctgggcatagtggcaggagcctgtaatcccagccactcaggaggctgagacatgagaatcgcttgaacccaggaggtggagattgtaatgagctgagatgacaccactgcattccagccagggcaacagaatgagactctgtttaaaacaaaacaaaacaaaaatatctaaatacctcaactagcttacagagtttagctgtagtagatattataatataaatgcaatgttttctgatacttagggagctcctgatagcactggataaatatgccttgatgaatcagtacagtttcaagtgggaagtgctatttcccatagtaaccctgctaccataattactggagtgttcatgtatgaactcttaggcctttgaatgcccagtcctagctgagtaactcagacagaagtcaatgttacaggaattagattcactcatcctttatttttaaatctaaaaaatgttattcttctctaaagaatgaaagaagataaaattgatggttttaacaagtctgtcagggtgttgcctaagaaaagaaagggaaagctaagtggttggctgggtagatataagtttcat

SEQ ID NO: 44600 - DNA, 1057 bp, Homo sapiens
agatgacaaaggcaggagttttgttataatcacatgcagagtttagtagtccccaagaccagcttcaggtttgttaaaaggacttgctgaaaactcactgaaagctgctcaagactcactgacaactgttacattcacagttacagtttattacaatgaaagaatacagatcaaaattaacaagggaagagactcataggacagaattcagaagcgttcttgttggagcttcctgtcaccctctcccaatggagttgtggacagagcttccagtagcaatgtgtgacaacacacatggattattgccaaccagggaagctcacctgagccttggagtctagagtttttattggggttcagtcatatgattaaccacctgcggggctgaccttagtttccagctcctgcagaggtcaagctgatgccacatgacccagagccctctataaatcacattgttagcacagtctgtctggcatggcccatggcccccagataaacagacactctgatcaggcaggacatttcaaggacttagtgattacctcccaggagccaagagcaaaggctagctctctctttgggcaaggttaattctttaccacatactatatatcactcaatcatctgagctcattcctataatgtaccaaaatttacatagtaacttgtcattaaaaatgttttaaaagctcagctgacatttcaattaatatttttgaaagtaaagaattggaaaccaacagactcgttacccattcgttggagcccagtttgacaccagtatttagaaatgtctctttgttgccccagaggtttttacaccctgggacaatgtatactatagttaggttacatatgggtaaaaggtgtgcctttttttttttaattaaagttttagggtacatgtacacaatgtgcaggttagttacatatgtatacatgtgccatgctggtgtgctgcacccattaactcatcatttagcattaggtatatctcctaatgctatccctccccactccacccaccccacaacagtccccagagtgtgatgtt

SEQ ID NO: 44601 - DNA, 1051 bp, Homo sapiens
atcagacgtagatttggtcttttcacatagtcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacatagttctcgagccttggctttcagccccatcagctcctttaagcacttctctacactggttattctagttatacattcgtctaaattttttattattttcattaaaaaaaacttttggggtccctcccttaatcctgcttctctcttcagttattacctcattcctcttcttccttcgacagtaaaacttctcaaaagacttgttggtattcactgtccagttgctctccttcctttttatcttggaccccactcaaaccaggcttttgcccctgctgctccagaaaacatcttttttttttttttttttctctctctcaaggaagagtctcactctgtccctcaggctggagtacaatggcatgatctcagctcactacaacctctgtctccagggttcaagtgattctcctgccttagtctcccaagtagctgggattacaggtgcacaccaccacacccagctaatttttgtatgtttagtagagacagggtttcactatgttggccaggctggtctggaactcctgacctcaagtggtctgcccatctcggcatcccaaagtgctggaattacaggcatgatccactgtgcctagccaggaaacagcgtcttaatatgatagttactggtggcctccatgttgctagatccagcagtaaaattctcagtccacagtttatttgacctgtcagaaacatctgatacagttgatcacacacttcttcatgaaacaggttcttaatcccttgtttaattgtgttcttagtttcttgctgctcagaatgtggtctgagtagcatctgtaccacctgggagccttttagaaatgctaagttttagataccaccccagacctgaatcaaag

SEQ ID NO: 44602 - DNA, 1095 bp, Homo sapiens
tcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttaatattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatgttgaaccagccttgcatcccagggatgaagcccacttgatcatggtgaataagctttttgatgtgctgctggattcggtttgccagtactttattgaggatttttgcatcaatgttcatcaaggatatcggtctaaaattctcttttttggttgtgtctctgcctggctttggtatcaggatgattctggcctcataaaatgagttagggaggattccctctttttctattgattggaatagtttcagaaggaatggtaccagttcctccttgtatctctggtagaattcagctttgaatccgtctggtcctggactctttttggttggtaagctattgattactgccacaatttgagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggattggtggtgatatcccctttatcatttttttattgcatctatttgattcttctctcttttcttctttattagtcttgctagtggtctatcaattttgttgatcctttcaaaaaaccagctcctgggccagccgccccgtccgggaaggaggtgggggggtcagccccccgcccagccagctgcctcgtcc

SEQ ID NO: 44603 - DNA, 1032 bp, Homo sapiens
agccagaggtgaaagttgtaagaaaatgattttgtctcaacacttggaaactttataataccagaaccacttaaataaagatatgagagtcagctacaactgagtgatgaacttcccatagttgaaggtatttaagcaacctctagttgcctgtcagatatatttaaaaagatatctctgcataaagtaggaggttagacttggcaattgccagtctcttctaaatgtatccttttgttgccttttttaaaaaaaaaaaagctttttctgacaacattttaccgacagactactttggttctcttttgtaagaattgctaaagtttgtcgacatttaatgtttactgtcacatttctttgtacaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggagtaagttccattcgttaaatgtcttgtaaattatttttgaagaccattgaggatgttttaaaggttttggctgctattcttttggattgcattttaaattactgtccaggaacataaggatgctaactaatggctggtaaataatatgatactaaaaaataaatgtctctgtctagtgcagccttcagaacatatatcaagtatttgataataaatacatgactgcaaacttaggcttagcactcagtgattgagctaagcaagagaggttcagaagatagaaacagcaaaaacctgctaaaaagttgttagcagttgtgcaagtaaacagaatggttgttagttactttttcaaatcagtttctctgagtgcccgtatttttggttgcaaaatggtcagttaataaagttaaagtgaaaaatctgcattctgaccctttttgaggatttcagagtgagttcctatctgttgaattttgctatgcaattt

SEQ ID NO: 44604 - DNA, 1023 bp, Homo sapiens
acagacacagagaaaaatgtgtagagaaacccaaaatttttttgtttttctgtagtgtttgtcatttacctctaataaaatgttaactagtttataacatgagtagaaaagatgactggacataaaaggaagtcttttttttttttttttttttttttgagacggagtctcgctctgtcgcccaggttggagtgcagtggcgcgatctcggctcactgcaagctccgcctcccgggttcacgccattctcctgcctcagcctcccgagtagctgggactacaggcgcctgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaaaaggaagtcttaaaatgtattatctacagttttaaaatttcttccaggatcagacaagatcggacacgttcaggatggtatggccgtagactacagttttaaaatatcttaccaaggaaagatccttaatttttatacccgctttattaatttctaaccatcttgaaagctattgttgataaatttcctttgtggggctccactgatacttaaagattgaccttagaatcagataaaacttaactttgctaaatcattctgaagagggggtttgtcagacattatcaaccacttccttcaactttctggaagtgttttaaatgtacattttatagaacagacccataatggcaaagcccatttgtcctcttcttaggtcagtaaatacacaaatgagaaactgaattgagatttccaactgaattttcatctagtattcactctagcacataagacaacattgcttaagaaaatactttttgtaagcattaccctatataatgttttataagaggtgatatttgagactgtcttgaagtgttcttccaggaggtcctttacacttaccttccctgttgtctt

SEQ ID NO: 44605 - DNA, 1047 bp, Homo sapiens
agtgtcatctttgtatcttgccttttcatcctctctcgtaaccagtcacagggtatcaccttttcatgtgcatctcaaactggtttttacttattaccgctgccatttgggcccatattttttcacttgaattatatactacattaatctcctaaatagattttctgccattgatttctctctatctatttccattccttctgcaactgtcagaatttttttacacttctagcatcatctgttctcttgttccaaaacttttagtgacttactgttgattacaaggtaaagtgcaaactctttagcatttttattcatgttcaagcacttatgattccattaaaaagatttactaataactgtgggctatgcattgtgttaggcaattgggaattatttatgaattagcacatggcctttgccctcaaggaagtcacagtctaataggtgaatcaaacatttaaatagataattacaaaatatataatggtagtttagagaagggggtaataaactccatctggttggatctaggaacattgagcagagaagggacaacctttaagccagattatggtgaataagtaggagtacactacataagggggttaggaaagtcatttgttaaggaaatgaaaggcatagaagtgcctttacatggaatgtaattaatagttgatattgaagtttagggtccaggagaaggcttggggaatggtggaaggtgaaactaggcaggtaatatctacagtgaaaggctttgtgtattactctgaaatctaaagcagtgctagggaatctgaagaattttgattgggagaggaagtcatcagctctatattttagaaaaatctttgatggtagagtggaggatagatgaaatgggaaacacatagaggcaggactgtcaataatgtggtttttacagtatttcagacaagaaatgatatttaaactcaagtaatagcattggtgctgagaaagagtgtgttttggggagggagactatgaattagtgaattagtggtaagagtcttaggaatcatg

SEQ ID NO: 44606 - DNA, 1026 bp, Homo sapiens
actttttttttccctttccctttccctccttctctgtctctctcttcccatgtcatctttgctgcttcgtatgttagcttcattctataacagattttctcagtgtggtggagaatatggccattgagggctccagatttgtatcttctgcaaatctacagaactacagtagaaacaaggacttttctctgtcagtgtccatgtgtcaatttagggaagaactcaggtactgtttgggtcatatatatagccctggaccagttgctcttgccgggggtatgggaaactgattagccagcttctgtcatctgtagtgacataaaagtagtgacccttgatagcttttctagtaccatgtggatttctagagaagggaatattcccagaggaaacaggggcaccaaacaacaaatatcaagtatacatgttaagacaggtttttttcttcccgctatgtttagggccagtaagaggtctcttaaggacagtcagtgtgattgaagggttatacagttttcagctttgaacagtattggatcaaaattgattttgcttttaatattgacatctattattgctcagtgatggatatactgcgttggtgggtatattgtagcagatactgttacttcttctttttatatgtttaaagtatttcataattttaataaaatagaaaattaactttgctttgatttaagttggtgaataataacaaatatttgggttataatttccctttagtattaagttagctgtagaaatggtgttgtatctgacctagtaacccatttgactttttaaagatgaattactaaatttttttaatgatatgaaaaaatgtaatttgctccctttacctcttatcaatatatttatgataccataggtacctgcaaggtgtggagttacagtccgagacagtctaaagaaagcactgatgatgagaggtctaatcccagagtgctgtgctgtttacagaattcaggatgggtatggtttgtatgtgacgtgaaattttgttta

SEQ ID NO: 44607 - DNA, 1060 bp, Homo sapiens
ggatcacttgaggtcaggagttcgagaccagcctggccaacatggtgaaacctcatctctactaaaaatacaaaaaaaaaaattagccagccatggtggtgcacacctgtaatcccagttacttggagctgaggcaggagaattgcttgaccctgggaggcacaggttgcaatgagctgagatcccaccactgcactccagcctgggtgacagagcgagactctgtctcaaaaaaaaaaaaaaaaaaaaaaatgtaattcagacgctgggtgtagtggcttgcgcctgtaatcccaacactttgggaggccaaggcagaaggattgcttgagcccaggagttcaagaccagcctgggcaatgtaaccagaccctgtctctacaaaaaattagccaggtgtgctagcatgagtttgtagccccagctacttgggagactgaggcgggataatccaggattttgaggcttcagtaaggtatgattgtgctgctgcactccagcctgagcaactgagtgagtccctgtcttaaaaaaagactttctagatcctggagtatgtgcaataactaaaaagaataagcatatatgttccttgagatttttatttttaattttattttttgagagtgagtcttgcccagaatggagtgcagtggtataatcacagctaactgcagccttgacttctcaggctcaggtgatcctcccatctcaccctccaagtagctgagaccacaggcgtgtgccatgcctaatttttaaatttttttgtagaggtagggccttgctatgttgcccaggctggtctcaaactcttgggctcaagcaatcctccctctgtggcctcccatagtgctgggattataggcatgaaccactgcacctggccctgagatatatttgaataattgtaaaaatctgttaattggggttattggagggatggggatattccctgggacaagaaaaagggactgaccttttacttttatacttgatacccttatttcacataatgccaaggtgtctgttttttatgattgttcagggtgattatata

SEQ ID NO: 44608 - DNA, 1890 bp, Homo sapiens
aaaaatacaaaaagattagcggggcgtggtggtgggtgcctgtagtcccagctaatttggaggctgaggcaggatagtgctgtgaacccgggaggcggagcttgcagtgagccgagatcgcgccactgcactccagcctgggcaacagagcgagactccatctcaaaaaaaaaaaaaaaaggtttaactagcctcctcatatttatgagagaggccaagagaaatttacaggtatcactaaagcttataatttcccttttaaaaagaaataaaaacaactgagactcttcaaagatgtaaaatgataaatgaataactattaggcaattgactaggcttaccttaattatcctggctaggcttagattaaataagtaacttgttcttgtccgtcatactcccagtttaacaattcgtattcaatactcagaaaaactgtatatcgtgaacttaaaaggccttatgaatcatcagtaaatgggtttgtggtattaaactctttcaagaacgttattttgccattctctcttttatctgaatctgttaacccttttcttaactacctcttttcctctccttttcttctctcaattcttattaacattaacagttactatttgagcatttgccatgctgtgttccaagttctgtgctaaggactttacatacatcttctcagccaggataattcacattctaagtaaaattgtttgtggtagtgaatgacagttcctctatcaaaatacatgtttctgtttgtcctgaacactcaggaacaaagggcagtagaacctactagcagcaaatgaaatcaagtaccaagaatgagattatgttttttaaagtggacttagatttgtagtccaagatagcacgctaaacacttgcctttatatctttgttcctttccagaaatttcattgaaatgatagtaaagatatgtaaaaagaataataaaacaggataggattctgtcagagaactagaaatttttaagaattcctggaagatggaaaatatatgaatggttacgtaaataagccaaaatagaaaaccaaacaaaatactaggagctagattcttacatgaagggagccattcttagcaaaatcctgatgaagcagatagcatagtcagcagattacaaagaagtggatttgcctcttgggtagtcgtcagagtaattagtcgaaggtcttgctctggcaggaagacaaagtcatgtgtcttcataaatcgagctggtgatataaatatgaatattttgaaggtgtgtgttagttgtgagtcctgtggagaaccaaaacaaacctcaactaaaaacattgaaattctgaattcaaaaaaaattttttaaaggtcatggcctgatatttttagacatctgataatgggttgctgagtcctgagtccccagtatagccttacattgcacatgtccatagagatgtgaatgttgcctcctggagttgtacaacaaggggatcctgttagttcctcttctgtatatatggaacaaataatttgtagcatttattccatgaaaaagctctaaaagtcgttttctaaacaaaatttctgcctggagagttctatgtgactgctgtgtgtgtttaaatggtggaactgaacatcagatgtccctgaacctcagagaaatccagtggggtaaaaagtaaacgttaatctaccgaggagtaaaataatactctgcttccatctggaatataccagacttcttctcacgtctgtacccattagtaatctgtttggaaaacaaactgctttcccctactatactgtcaacacaacaaatttttgtgactagatgtgtgggggtgtttttccccaccaagcaatctccagttctctgtagataatcaactgggt

SEQ ID NO: 44609 - DNA, 1022 bp, Homo sapiens
aaaaaaaaaaaaaagatactttgataaagaaataatagttatttctcattttatttctcatttgagatgaactcaaagttggctaaagtgacacacagttttggacctataacttgcttacattttaaatattaggttggtgcaaaagtaattgtggtttttgccacccaatagaaaggattgtagacatttttttatttgacaactgtaaagcattgcaggaattatatgtggaattataggcttactttgttttattgtgtttcattttattgtactacacagataatgtggttttttttacaaattgaaggttggtggcagccttacatcaagcaagtctgttagcgccatttttccaacagcacatgctcactttgtgtctctgtgtcacattttagtaattcttgcaatatttcaaactttgtctgttttggtgttctgtgatcttgcatgttactattgtaattgttttggggtgccacaaaccacacccataataaggcagtgaacttaatcagtaaatattgtgtgtgatctaactgctccactgactggctgttcccccaactcttctccagcctccgcatgccctgagacacaacaatattgaagttaggccaattaataactctacaatggcctctaagtattcaagtgaaaccaagagtcacatgtctcttgaaatcaaaagctagaaatgattaagcttagtgaagaaggcatgtcaaaaagctatgccttttgtgccagacagctaggttgtgaatgtaaaggcaaaattttggaaggaaactacaagtgctactccagtgaatacacgaatgataagaaagcaaaacaggctcatgcctgtaatcccagcacttttaagaggccaaggtgggaggatcacttgaggctaggagttcgagaccagcctggccatcatagtgagacgtcgtctccattcatttttaaaaagcaggcaagcaaaacagcctaattgctgagatggagaaagttttagtgatctggataga

SEQ ID NO: 44610 - DNA, 1047 bp, Homo sapiens
attacccaaaagggaaaagtaattttagctctctgaactgacctccacctaaccaactcatcaggttaactgatgttctccatttcaaaaaatatttgcggtcagattaggtgtgaatcatatttaaaggaagattgttggtcctatatcaaagattagagaatgaatgttcattttacagttttaagttaaaatgtttaaggacagtgtttaccattgcacatgattccctgatttaactgaccttttcagttaactagccactagacataattacattgactataggggcttcttttgtgccacaccagtgttggaattgtgttgatttacttgtggagttggaactacagtttctctcagcagcctgcttatctggttgtttaaacttgtagctgaattattatacaaagttttcaaactttctgttttggaatggtcagttactcaaaactgtggcttcctccttgctaccttacagggtagttgtgagagtattcctcaacaatagttcagactctcattacttcttgtctataattgtagcatgcttttaatgggattccctgcctccagtacctctctggcttgttggttaacataaacattattgccagattaaacatcctaaagtataatgtgtaatcagatcaaaagccatttataacaataaaaactacattaaaaaattacttatgtcctgggcttagatgtggtctctgcaatcagatgttcattaaacaaattatttaaaaaatacatacatacacacacacgcaaattctgaattgtgatatgtgccaaaagaaaaaatggggggtgatgtgagagctcagtgaggatcaaatatagattgggaagaagggtgatgaggaaagacttctttgagaaagtgagatttaaactatctgaagaagctgtgcttagtttagaaaagtgctaggcaaagagtgttccaggaagaaggaatagcatgtgtgaaggctctgctctgctgctgaaattgtggttcagtttattgagtatggcatagaatgaatagtgcct

SEQ ID NO: 44611 - DNA, 2030 bp, Homo sapiens
aggtcagggtaggcctcacttgagaagggggtatttgaacaaaaatttgagaaaggaggaggaggcatttcagataaaccaattagttcaaagattctgtgtcgggaatgtgccttgcctatttaagaaacagcaggaggccaaagttgctggggcaaggtagagactaggggattagggaaggatctctttcagttatctaggccatattggtgatagcagaaatactgagaagtagtcagattttggatgttttgaaagtagattcatcggggcttggtggctcacgcctgtaatcccagcactttgggaggccgaggcgggcagatcacccgaggtgaggagttcgagaccagcctgaccaacatggtgaaaccctgtctctactaaaaatacaaaaattaggtgaaatattgaaggagatgttttgattgaagtgattttaagagagaagaggaggggaagtaaagatggtgaggaattatcctgtaaaggggaacagagaaatggggccagagctagtgaggaaagtggggtcaataaatttttaatgataagaaaaagaagagcgtatgatgataggaatgagccattagagagtaaaacgtttcaggagggagagagaagaattgctgaagcactgtcttagaagaggtaagagggaaagggatttagtgtataaataggaaggattggctttctataggagcatctatactttatgataataggccattaagcagagtatgtggttagaaatgctgctaggaaggtcgacgtgattggtggagtctgtacacgttctgttgcagttgctttggtttttttcagtgaagtaagacttgaggttatcagccgagaatgaggattggggatatgtgaaagtagctccgcagcagtatgggagcataaatgaactggagacaaatagtaaaattaatgggcaattttttttcctttaagagatgggggtctcactctgctacccaggctggggtgcagtggcacagtcatagctcactgcagcctccaactcctgggctcaagtgattttctcacctcagcttcccgagtagccaggactataggctaatggcaatattaagttattttatgagttgtctagacagcattatgagtctcctaactttttggtactgatcttcagatcagagttaaatgtaacttgcccaggcaatttaaacactcaatatgagtcattttcatttggactcaaacatggaatcattgggaaatagaacatgaatttattactccttaatgaagtacctgccactatcctgccatgaatgtaggctaaatttggagtggtctggtaactgcttttcttttaaaaaaattttcttcatcttttctgtatcaaatacttactggtttttctatgtagaataacataatctcatcattactttctttcaaacactctccaaatttgacttgtctttgctcatgtttttcctaccacctgaaatacagatttcctcccccatcccaccctccaaaccttccagacttacctcacctaccgtttattgtaggaagcttttcttaacctctttccaagtcctagtttgatgcctctgctttgtgcttttgtagaatcccagagtttaccttgttttactcactatatcgtattgtggggtttttttgttaataggtatttctttttcctctagacctgcactgttcagtcatactttctgtgatgatggaaatgttcagtgtcgtcttaatatggtagacagtagccgtatctatgtggctactgtgcacttcaaatttgcatagcaggactgaggaactaaattttatttcattttaattaatttaaaaataactagcctgatggctagtggctgctttaatcagtgcagttctagaccccttcaaagtcaagagtgtgtgggattcatacttattctctcgttgcttaacaataatactgtctaatacttaaatgactgaattctttttcggtactcttagtctgcatagttataactcac

SEQ ID NO: 44612 - DNA, 1088 bp, Homo sapiens
gagaatgtcagaggaaaaagataaagagcccaggtcctcaatgacatcacggaaccaaatggttgtactatgtctggagtttgcccaaactctgggacatcctattatgtgaaataataaattcccttattgtttaggggggagtcagggttttctgttccctggagccatgagccccaacttgataaactgcaagccataggctatattggtggataggaaacacaacgaggacagtgatttaaaagaaaaaaaaaaatgatggcaaggtttttttgtgtgatttttgttgttgttgttgttgtttatggagtcttgctctgtcgcccagcctggagtgcagtggcatgatctctgctcactgcaacctccacctcccgggttcaagtgattctcctgcctcagcctcctgagcagctgggactacaggcatgggccaccaagtccagctaatttttgtattttagtagagactggtttcaccatattggccaggctgctctcgaactcccgaccttgtgattcatctgccccagcctcccaaagtgctgggattacaggtgtgagccacaacactggcctatggcaaggttttaagggtgaaaatcgatgacagaagaaagcaagttgacatcaatgggatgcttaacctttggtttttcctaaaatcatcctccagtcatttccctggaccttggaccagtgctatgctctttttctgtagattcattaacactaaaatagagttaaaagttcaaaaaaagatatagtgtccttatgaccattagtaaccttactatgtagcatcgccaatgaaacctgcttgtgggaacagatgcttcccagggtgagtactttgatcatggaaaattatgtacaaattcttttaagacttatcttggtttatttgctcattttttgcatgtagatacttctttagactactttgtttcccctaaggaaaaaaatatgaaatggtgttcttgtggtatttatgcttaaaatcctttccttattatgacctttaatatccactgaatctattgctaccagattggaaacatgtaaatgaggcctttcaagaaacc

SEQ ID NO: 44613 - DNA, 1053 bp, Homo sapiens
aaatggtgctaatgactggctggcaaagccatggtaaatcaggtggatttcagttctctgctttcaacagactaaaggagaatctaatcaagttgtttgttagttgatagatcatcattaataattcttgatgatagagcactgtgatctttgtcaaaatgccaaaggaatccaaagaactgtaaaaacattgttaacgtaattctattccatcgaatttatgtgcttacatctatacagaaacaaggaatacagctgaggttgaaccccatctcagctgtaaatcacattcatgtattcttggataaatgaactaattaggataaagaacattctaataaaaaaacttttaatcatccaagaattaataccgttttcattatataccaataattaattacgataatattggttctggactgagataacaaacaaacacttaaagcaagagctaaaaaaaaaatttccatttatattttttgttgacaagaagtaatggggtgaatgattaaaagatgtcgggcataatagattacattatgataggattcttggctgaaaagtggtatggaaatacagaaggagaaaagccaatttgaaatgtttaactactaaagaactagctcatttatttttataaatgaatgaagggtgtcaaattgttgtgatatttaaattgtactggatatgtttaaaatagtgatgtaacagtttttattttaaaataccaatatttacacgacaccagcaaatacatactttgtcaactatttaacttcccatgaaaaattttagataccaacttagataaaattttagatatcaacttagatgggtgagggtatacatgatttttcaaaatacttttgggggcacatgagcagaatactttgtggactactgctttaaaacacgatttctccaagtacagttgagggacaacttacagaatcacctgggaagggcagatgactttttaaaaatgcatattcctgggccccatccccaaatttgggttattaggtttggggtagaccccaaataagttttcaa

SEQ ID NO: 44614 - DNA, 1088 bp, Homo sapiens
gatctccctgttagtaaatggcagggccaggattggaattcagctcttcctgggatcagagcttatgctcttaacccctatgatactccttggctcagtgttcctagaaggcaattcaggggttgccagttagtgacagaaggaagagtggggccagtcgtggtggctcacgcctgtaatcccagcactttgggaggccaaggtgggcgaatcagttgaggtcaggagttcaaagccagcctggccaacatggtgaaaccctgtctgtactaaaaatacaaaaattagccgggcatggtggtgcatgcctgtaattccagctacttgggaggctgaggtaggaaaatcaaacccaggaggtagaggttgcagtgagccaagatcacgccacagcactccaacctgggtgacagagtgagtcagactccatctcaaaaaaagaaggaagagtggtcagaggtgaagtgcagcaggggttatgccaggggctccttcctacctgtgacttctgcagacacctcactttgcacagtagcagcccccatagatttgggatctgactggggactgtttgctcatcatgttattacttaacagtgcttagtaatgttttcgagttgagttttcttattgaagcagatgcttttattctggtttttttaaatttaaatttagctttgtttcctttgcattgttctcctgagtaaaataatgatcactcaactcaaacatcagtgtatcagggagctgttgtattatagaaatccagtttaaaggtaagacttttaaagtgaaaaacatcattgtgtgtggaaataagcatcctttaatgtatctgtttggatggactttagaatttcagagaaggagattagataccttttgctatatttctaagaagctgttcctcactctttctcctccctattcccctcaattttttcagatcacacacccagctggctgcatgtctcagtttataaagttctttggagaacagatcctcatcctctggaaatttgccttacttcgaaagcgcattttgatattttctcccccacctgtgggcgtggtgtgctatagaggta

SEQ ID NO: 44615 - DNA, 1037 bp, Homo sapiens
cccctgagtgttacagccccttgaggtgggcggagggtaggagtggtagcagagctgtgaccagggctgttctcactgtgtgtgtgtgtgtgtgtgtgtgtgtgtttttctgcaggcaccagttggagatgccaggacattactctcatctggctgccttctatgaggacaaaaagggggtgctccatgctggtcccggcagaggcagcagcctgccccctgtctactggctgccttccatccaccgatacatgtaccctgagatgaaggtgaggttagccctgcttttcttacactatactggatctgtatctgggaatagtagctgttgattactttttaatgaataaaaaatttatgtctttggatcatacaaaatgtctacttttgatagaacagagttgcaacataagcatttggtttttttaaaacataaggcaagttatcttaaacaatatgctttctagacacttctgtaatcatagtataaaggcgtgtgtgataggccagttgtgaaaagatagatttaattctgttgattgcttctgatattttaacactagacatttgaactaaagatgaagagtctgatgaagaagtatgacatttcttagttaagacacttctgatgttacttcgttctgtatttgttcctgaagtactttggctttggtactagaatatgcctatttacagttagcaaaacacccagcaaagcgttaggtgttggaagggtgcaaatatgactaagaacatgaatctcctctttctcttccctctctgtctcctgtggttggtcacaggatatttccatggaaacctagggctcccctggtagagaaattatgccaagagtccaagggagaactctgggaagatgccttaggagaggacgcagtccctgagtatttggctaggtggaaagtgaggaatgctgattccagaaccaggaaaggtgtgagcagcagtgagaaccatggtctgtcactttctcagcaccttctgggagttatgcattgtgccagctatttatctgt

SEQ ID NO: 44616 - DNA, 1030 bp, Homo sapiens
gctaattctccaagtaggcaatacagtttcatggttcaaaatccaaaaattttaaggtggtattatattggatagggtcctggctaaaaggcaagaacagaggcccaaaattactatggccggattacgataaaagattattgctcatgtcatagcgtagaggtaggcaggtggtcaagttgggtagcctgctctgttccatacaattgttcagggacccacattcatctcttgttattccaccgtatcctaagaatggttttgtattgtaaggtgctctttcccaaatgttaaaagctgctcactactattatgtttgcatttcagcccatagggaagaaggaaagactagaatttacatatctcacttctcatattccattgtcaagtcctcaatcacagagacacacccaacagcaaagtagcctgggaagcatcactactaggtgggtgaccctgtgaccagttagaactctggggcattggttacaaacaggaagaagggaagacttgactttgagaaaaagttagcagcttctgcttcagtttgcccctctggccactcaggtatccatgtatactcttcttcccccttgtagaggccattcctcccaccccaaaggagacatcacagagtctcattcagttcatgcttccagtctaaaatctaggatttctctgtagtgcgcagtagtcctttacgttaggccagggcatggttcttcttaccctgaaaacttataaaagaatagacaagtccctctactccctacctcccaaatgcaatataggaggtaaagtaggaaccacaatacaagcttctgtttggaaaagggaagaatgagaaatacggatggtcactagttcataacaacagtgaaattctgctgagcaagaattgcagagtcagtatgctcttggctcaactttggttctgttgtgtagaatcccttgtccattgtcctccatggcacttggctttgtcttctagaagattctttcttcattttcctccataaccacatctaca

SEQ ID NO: 44617 - DNA, 1053 bp, Homo sapiens
tgtcagtcacaggcagtgagcatggctttgtgaatttgtgtatacggagtgtgtgtgtgtgtgtgtgtgtgtgtgagtgatggttttcagactaaggctactgtgcaaagaagggattgtaacacatttagacattttgtgcaggcattttactataatgctgtttgatttattctgatcactgctctgtaatttgatgatcatttatacccaatttgtaaatgagggaacataccagggatggttaggtaatttgggaatattaagtagccaataaatacttgactgtaagtcccattgtctttctagtatactatgctgcctgaacccctgctccctggcacctgatccttacttatccagggatggaggagaaaggagggaggaagagagagcgcagtgtgagagggagcacttgtaacttgtgttttttttgtgtttttttgtggggggaaagcagtcctttactgaccataaatgtgtttgtctcttttgtcatctatcctagtcctaaatggcactttgcttcctgtaaaaatactctgatagaccttgtaccatataattttattttatatatatcttaaaagtaggagatgtagtgaatgaatgctactgagcttctgagggcctcaaggttagcactaggacagggccctcagagagtgcctgatgtaccccttgtgtgatggttccggtggagtgaggcccatagtggcacagtgagctggaccatcactggcccagcatcttcccccctttactgctgaggcagatctgctatttgttcctatttaatattggcccacccagacttttgcccctccttcgcctgtgttgccaaaagcgataaagtgaatattgacttctttaccaaaattagagcatattttagaagttcttacataggtgtgatttgtctgctgtttagtttctctcgctggcctgcctgcttagccacttccccatgtctctcccacctgtgtcctcagtttccactcctaggagatccttcctccccccaccccacacccacctcaaccctccgccacc

SEQ ID NO: 44618 - DNA, 1052 bp, Homo sapiens
agttggtgccttacgagacgatgcttgtcttcctcagaaactgctccctcctcttctccttctacccgattcatacacagggttaaatatcaacataagctggggaagatctgaggctgctcacagaaaagagattttgtaccccagagctcctgcaagaatgggccaatgtgcactagcaggtactaggagagatgcctgtgggtggatccagaggccagtggatccagggggtgactggaagataaagctggataaggaagagtttgttaacatgaagccactctcccatcatgcaggatttaatacgctggcaaggagcttggaaaatgagtcaaatatatgctatttgctgactcatggaagcttggaaaaagtaacatccttcattaaattaagcggagatgccaaaaattgccttggaagacgataaaggaaaggatcaaaaggcttagaagagtggaaatgctataatggatctactatgtaagaccgaaaagcctatcggctgatcatgttcccaaggagacctggaggacactctgcctagcaagatgattaaaaagaatgtgctgtaaaagaaagtattagctggggtggattatgttaggagctgctgttacagaactgagttctctagtagcaaggggacatggataactagaacagcagaggccaggtggcagtgcttaactgtcagatgcaaagcgggtggacttaccctattgggcagaaaggttgaactggtagataggagcaggctgaattgcagggatctttggagatggctcacagaacatagtgttcttgaggcaggctgtgtgggcagctaacaagagttctgctgaatatacataactgaaagagatcaagaatgtagaagaaaaaggctaaggacagtcaccccactggaaagtcaggatcctttgccaaatctccagatttgagctagtccacagacccacgatctatcaaacgaaaaggaatctgaggcaccagaggtagggccctgcgacaccatgacaagtatgtctagtagcagttccccgatt

SEQ ID NO: 44619 - DNA, 1047 bp, Homo sapiens
aataactattgagtactaggcttagtataggagtccctatactgctgtcagaaaatttctcagcaaaagttttacagtccaggagagagtaggatgatgtattcaaaatggtaaaagcaaaaaaaaaaggactgccaaccaaaaatactttacctagcaaagctttctttcagacatgagggagaaataaaaacttttcctgacaaataaaagctaagggattttattaccactaggcctgtcttacaggaattgctaaagggagttctttaagctgaaactaaaggctgctaaggaatgacataagatgtataaaagtacaaaacttgatgatacattaatatatagtgatactcagaatactctaatactataaatgtggtgaattcagaaattttatctgtagtattatggttaaaaaacaaaattattaaaaacaactgcaggtacaataaattgttaggggataaaaattacaaaaagatgttaattttgtcatcaatgtcataaaaggtgggaggggctgtaaatgtagagtttttgtatgtgattaaagttaagttgttattagcttaaaatagcttgttattaagtatacaatgttttacataagcctcaaggtagccacaaagcaaaactctatagtagttacacaaaatataaaaagaaagaattcaaagcatatcactacagaaaaccatcaaaccatagtgaaagacagcaagtgagaaaaaggcaaaatatccacaaaatacccagaaaacaaattacaaaatgggagtagaaagttcttacctatcaattactatattaaatgtaaatagattaaattctcaaattaaaagacataaatgtggctgaatggcttaaaacaaacagaaaaagatcttagtatagactacttataaatgactctctttattagtaaggacacaaagagagtaaaattcaagggatggaagaagatattttacacaaacggaaaccaaaaaagaccagggagagctatgctcatatcaagaaaatagtccttaagtcaaaaacctt

SEQ ID NO: 44620 - DNA, 1037 bp, Homo sapiens
gttattgcagatactttgtttctatgagttacagctctttcagacaggtgtgtacatttttggtaaatatttgactcctggttatatgtagttttccttcaaaatgatgtcttttcctcttacctctcactacatttcttttttttttttgagacggagtctcgctctgtcgcccaggctggggtgcggtggcatgatcacggctcactgcaagctccacctcctgggttcacaccattctcctgcctcagcctcctgagtagcttggactacaggtgcccgccaccacacctggctaatttttttgtatttttagcagagacggggtttcacaatgttagccaggatggtctcgatctcctgacctcttgagcagcccacctcggcttcccaaagtgctgggattacgggtgtgagccaccgcgcccggcccacctctcactacatttctgaccctaacacaagactaaaattttaatgagttttacagaattttgattttcttgctaaggaccataaaaatgtatacttagctgaaatgcctacaaccaaaagaaacatatcaaatgtcgtgtaaccatttattgccactgatatctgatttgatgcaatagttttcttttttctttctttccttcctgtaggagttgctgttggggctccactgtctttccttagtaactatcattcttgaacatggtgaaacttattttagcttgtgttcctccagggacagactttaagaccaagatttgaatagaaatattttttagtttttaatttttttaatgctcagggcaatataattttttaaaaaataaaggtacattattaggccagttaccacagtggaacactgaggcttcatcctgagaggaatctctggcaagtgctgtgaaacatgtgactcagagttcccacacctctcaggcagaaaagcatgggttctccatgccaattttcccgtcactggttgaggcttgctcctcagggtttttagtggccttatccccacctacccctttagtctgcagtgt

SEQ ID NO: 44621 - DNA, 1032 bp, Homo sapiens
ggtagacaaacactttgaatatttccccgcaaaggcatccacaaagcagttataaaatgtagaatagagtctgctgccaagggtgttaaaaaaagaaaaaaaaatgttttaggaaggcatatctggcatcgttactaagtcctcttttctgtggttggaattagtttctagaaatacaactgatggcctgaaacctgtgataaaaattgtgatacactgaaaactgattcctcaaaatggcttattgatttcagactttgtgaagataacctcccattgttcaatgcaccttgtcaattcctacttatagtgtgaaaaatgactcatggtgtgatataggattggacattttgtacagtgacactggaatgccaggcttctacaaatatcttcacagttgtgcaaagactcatattttaaaatatctacgtttttgaacagctctctcccagtattaaactaattaggactaattatcacttctagttaatgggtcccagtcaaggctgaattctgttttcattatacaacttaacacaggtttaacaaggacatattggtactgaagaaaaagtgagcaaattgtaaaataaaatactagaaatgaaatatttatattttatctttttttcaattctgaatttaagatacaatcttcaatatcacatatatattcatacacatacacattatctggtatggttgcagtcttagtttagaaaaataaacacagtgattattttcctgacagttggtttgttttgtcatacggctgccatgttcgcccgtacaccttgacgtctctggcttctgcagaccctggagttttgaatgagctcttccaggcctaggtcttacttaggaatggattatgtgttagcagtaaagcttattaacagttttcaccacaagatggagccttatgaatgcctctcggaaaagggagcaattccttaattcgcccactagtgggcaggcatgctctttctaaataggaaacttctggggaaacctttcaaaacctatttgaga

SEQ ID NO: 44622 - DNA, 1069 bp, Homo sapiens
atgagtatttctttttatcattttaggatttgttagactccctggatctgaggattggtgtctttcaagatctctggaaaattcaatcatttctttcaataataactctcccacaatctttctattatatctatttgaacctcagatcagatgtgtcttaggtcttctcactatatgctctatatcgtctatcctttttcatattttccatcattttttcgattttagactgaattatgaataatttcctctactccagatccagttcagtaattctttcttcaactttgtttaatcttctatttagtctcttcaataaatttctattttgaactattttatttcaattattttttaatttctagttttgattcttttttataaatacaattattttctgttcaagtttctagtttctattttatttttcaaatgtacaaaacatggctattctatgttctgtgactagtaattctgatatctaaattttgcctgtttctgattctcttgtttgtaatggctgtctttcattgtgctttatttcctgagtgttatgtggttttaaaaattattaatgtgagcttctcctttcatgtgaatttttgtcctagaaattatttctagatacattaaagttaaatttctctagaaaagatatgcatgtgcatcttccaattgaatacattagcaaattgggaccacctcaaattatttgcttagggtttttgaattcacagatgtagcatgaattaatattgcaaacctatatggaaaactggtttgtgattattcattctcattgatctttttccccttcatctttcagcagggtcaagacaagcaaattgcattgatttcttctgtgacatgaatttacttcctatttacctttaccctgttggaatacccctttggtgtgtgagctttgtgctgggatgtcatttttaattatattctttttgtgagcttggtcttaatatcctaggctggaaaccccatagagtcactccccatacattctccagggttttgtggaagcattgtggtgagagccagctttcatgcttgc

SEQ ID NO: 44623 - DNA, 1238 bp, Homo sapiens
atttatgcttaggacttgagttgtattgacgagaattttgcctacctctaggtcacaaaaagattccttatgcttaatagttctaccattcacatttagttttataatttatctcagagtattttttgtatatgatatgaggtatgggttaagggttcattggtttttatatagacatctaatcaatcaagaactacttattgaaaaggcatttcacaccattagactttttgaatctatgttcattgagtaatattcgtctctaggtttttgttcttataatgtacttacgagattttgctatcaaagttatgctgggtgtaataaaaatgagttgggaagagtttcttcatttactagtctctggaagaagttttatgatattagtattatatttttctcaagtgtttagaaaaattcaccataaaaatccttttgggactaaacttttttgcagaatgtttttgattttggactgcattttttttatgtataggattatttatattttctgcttcttcttgctgttttggataaattatgttgtttaaacaatttgcaaattcatctgagtttgttaaatttattggcatatgattacttgtaatatcactttgttatatttttaatgtcttttgggactgcaataatgtcccctgataattataatggattctctctctgtgtctctttattgatcattcttagtttggttcattaaaaccaacttttggttttactgaatttctaaattttttaaaatttgattcttgcttttatgtttattatattctctgatttactttaaatttgttattctttttctaatgttttgaaatagtttactttcagtctttcccttttattaatgtatgcatttagagctatagagttttcctttattaagtaattcctttattaagtaattgcttttgctgcctcctgcaaattttgataaattgtattttaattattatttagttaagatattttctaatttccattgtgatttcttctctgacctaaggggtgttcagaagtgtgatccttaatttccaaacgtgggaattttctaattaaataaataaaaattatttatttctggtttaattccattaagatcagagaatatattctacatctttttgagtttcttgagacttgcttcatacccagtatatgttttatttgagaaaatgtttgacacgcactaaaaatcatgtatattctgttgttgg

SEQ ID NO: 44624 - DNA, 1030 bp, Homo sapiens
gctgagcttggatttggttgggattcaataccacttatagctgagagtgcaagagtaagttgccctgaagaaaatttaaattatgtacaatataaatatttgtcctaactcttctctctttccagaagtaccactgtaacaagtttattgcacttgcaattctatagatgtaaaaattaatacctttttatgttgtatatgtatagtaccgtatgtgtttctttctcttgcttttgtcattgatcaatatattttataccccctacttatgaagatcttcaaggaaataccataacttctcttttaaataatagaaatatcctaaatagacattttattgtttataaagtatttaagaaatatcaaaaccgaccacccaaacattcttaggaattcattaagtgaaaatttccatgagtctttttataaagtgtatttcttattaggcttcaatctatatttggggttttaacacaggcagaaaaatacctgtaggtaaattaaatacttttcagcaagtaatatttctgaaagaatgtatcagtttagagcatcttggctgattaaagtataaagtattatatcagtattgtccctagtgatgaaaattggataagactgggtgtatggtggctcatgcctctataatcctggctttgggaggccacattgaggggatcagttgaggccaggattttgagaccagcctgggcaacatagttagaccttgtctctataaaatttaaaaacattagtcacgtatggtgagatgtacctgtagcttcaactacttgaaggttgaggtaagaggattgctcgagcccaggagtttgaggtgaccatgagctgtgatcgcaccactgcattccagcctgagcatcagcataagaccctgtctcaaaaaaaaaaaaaaaaagaaagaaagaaaagagctggttaaaaactcagattttcaactgaaaataaattaaagatttaactgtaagacctgaaactatgaaagacctaaaacaaaacatagcggggaaac

SEQ ID NO: 44625 - DNA, 1033 bp, Homo sapiens
gtagttcatacagtgtctctgttagttcagtgaggcaccctgaatgctttgtcactcagcttggaaacccttcttataatagattcaccattgatttcagtaatactccacctacacacacacacacacacacacacacacacacacacacacactcaagtttgtactaataatctcattaattgatgagctgaataatatctttggcatgtgttccttttatatttgcatgaaggtcatgattctaaaccttttggaaattacactttaagcactaaattctccttagtttgttgttaatttaaaaggtgagtaaataggtcatcttaactttcttggaagtcagtttccttatctgtaaatgacctgtcatagactatgagaattaaaagtgaaaatgcacctgtaaaagcatagcatgcagcctttgaggacaatgtacaaagtgggcaggtcacacatacctgggagcttgtgggattcctcaggtgctcatcccacggaaaggacttaggctaggctcgcctgtgctgcagggtgccctgtaatcactccaggagaggaatctcaactgctgccctcccacccccacaaaagttccacatatttgctggaacctccaggtgactgtaatactgtgtgtctgggaacttccaggttactagagtggggagcttgtgttgctaagcagctaatttcagcctattcttgcgttgttaactctgacctgctgaactagctccttgaaaaatccagaaattggggaaggggaggaggtgaaatgaactccaggaccatctgcatttgtatttatggtccctcacttgttttttaaaaaagtgaaatgtatccagtagtcataactttgcatttagacagcagttatatagttttgtcattttaatttccatatgcttgatctccatgtgctaagtattaccttctaactacagaaatgactttatttcgccaaaccagtgagtgttggagtcaactctaaaaatattgtcctctccttcaaattttaaacttc

SEQ ID NO: 44626 - DNA, 1021 bp, Homo sapiens
ggcctctgagcccaagctaagccatcatatcacctgtgacctgcacgtatacatccagatggcctgaagtaactgaagaatcacaaaagacgtgaaaatggcctgttcattccttaactgatgacattaccttgtgaaattccttctcctagctcatcctggctcaaaagctcccccactgagcaccttgtgtcccccacccctgcccgccagagaacaaccccctttgactgtaattttccactacctacccaaatcctataaaacggccccaccccatctccctttgctggctcttttcagactcagcccgcctgcacccgggtgaaataaacagccttgctgctcacacaaagcctgtttggtggtctcttcacagggacgccagtgaaaatactgatgtctggaatttgcttcaaaataatttcacaggagggaggagacagaggtacaaataaaacaacattggctgtgaatggaaacctgttgaggctgagtaacggggacacaggacttttacagtgctctctccaattttggatatgtttggaggctgatcactcagaagagaaaaaatctacatttctaataatgttcaggggattattacaattcatacttatattatgccagaaatttaaatctaatttctacctctaaataagagaatgactaccctcatgttatcaccatgacctacatcacactcatcaaatttttagaaaataggaaatgattacagtaatcaatgtgcaatgatcaaatatagtttaggggtagtgaatatttattttagggacatagtagtaggagggggaaggaagaaaaggaaagggaaggtcaaaggcaggaggagaagggaaaggaaaaaaaggatatgaaacacagtaccctgcagaatgtcctctatgccagaaaaggtggagcaaaggcagacaaccaacaagagagagggaacaagacttggcagaaatcagaaaacaaattctggcccacctcttcttggcccagtcttccagct

SEQ ID NO: 44627 - DNA, 1022 bp, Homo sapiens
atgtacactcccaagagcagtaaaataataactctctactttattttaaagacaagcaaagggaggttaaatataatggaattattatagaagaaaaactgctgtgttcataagctttaattaagatttctagctgtttagatagatgaaatagttaaagatataggtgtgtgaaaggacagggttaaatcaagtgtttttagccaaaacatttgagtatagaataattattgtaataaaagcatgatgtcaaatcagatctcagcaagcaattttttgaaactgatgattcatattaatgtcaaagaaggatgaaaagaaagaaagaaagttacagaaaaggtttctcaagaatttctgagtttctgaggcaactttagcccagctttaaagctcccaatatttatattttgcacaaatttaataggcaggatgttcaagtgctagtgaacaatgtaaaaaaaacccctccaaactgcaaataccatatgatattcaatattttaggatgactttagcaatcattacataaggtatattacaagtattttcaacaggattatttgaaaatagtactttgttgagagatgatttttttttttgagatagagttttgctcttttcacccagtacaaagaagtacaatgtacattggagtacaatggcacaatctcagctcactgcaacctccacctcccgggttcaagcaattctcttgcctcagcctcccaagtagctgggattgcaggcatgtgccaccacgcctgactaattttgtatttttagtagagatggggtttcaccatgttggccaggctggtctcaaactcctgacctcaggtgatctgcctgcctcagtctcccaaagtgctgggattacgggcatgagccaccacggccagacaagagatgaattttctaaacctatcaatttttaaaattgatttgtattgacaaagaaactaagactactaagagttttgcttatttgtctagttttaatgtcagcaatgatgtgggct

SEQ ID NO: 44628 - DNA, 1019 bp, Homo sapiens
cggggaaggaggggaggagcactgcatttgcaaccatcttccagactcccctggatattctcaaaggactgagaggaaaggcagctgctttcatagctgatgttctggggtagaatgtaaggctgtgtagggatgtttctggtgggattatgtgaaaatggaggtaggcttaacatgtaagatattcagagaaactcttagttggaacaagtagaataggtttttttctatgaatgctttatagacattataatgaaaaaaactaattttaaatgtgaaaatgcctattcgtgatgtttggaagaattttgtcagatttttttttttttttgctatgttttgctcagtaatgtatgtttatagttgataattaatagcttttgagtcagataaccatcttgaattataggtgattaattttaacctggaacaatagtgtgttcttccaaatgtcatttcttactgaatgaagctgcttgatttatttgcttttgcaggcaaaccctgaagaactgtaaccagttgcatttacaaaatcataataacttggtttacttataactgaaattattcactgggctgtgcttacttttttctttttagattttgtggtggatgcaacccgcaagggtaacaaaattcgttttgcaaatcattcggtaaatccaaactgctatgcaaaaggtaggtacctttgacgtgagaattggaactcccttttcagtcctgtgatgatggacttgaatacttctgggatagttgtttgttatgtgaacaagtcagttaaccccccgtggcccgtcttcatgctcactgacaccagtgtgtctctttgcagttatgatggttaacggtgatcacaggataggtatttttgccaagagagccatccagactggcgaagagctgttttttgattacaggttggtaaagtacatttctagcatgatctctaagggctttttctactggattgtgaactctggacaaaggagggtttttagttctttgcttctttt

SEQ ID NO: 44629 - DNA, 1050 bp, Homo sapiens
gtgtcacagaagagacaaagacatttttctggtatgcatgagtataagaatggtttgcctaaataagactgtcctcatggctctgtgactgtgcctcttgtcaggtgtatgagtttagagtcaaagaatctagcatcatagctccagctcccgctgaggatgtggatactcctccaaggaaaaagaagaggaaacaccggtgagtctgtcatgaagctccttagagaagtcaacatagatagacactgcaggcaaggcccttcctaagggctgttgttggtttctacttagtctatttttaaaaaaccttaaactgccatcaaaaacagaactatggaatcttatttccactgggaattgctagtatttttctataagaatacagcagccttcagtatatttggtatgttaagagtcataaaaattacggttaccagactgcatttgggttaagaaaaacatatttagtagcttttgcagtaaaggttacgtaaacaattactttaacatcatgaaatgttctgtgtttctgatgtgagctctgggccagtttttagaagtatcttttattccaggagcttgaatttctaagttgtgtggcattgcattccgatactcctaatgggtaccctactttaagcttgtgtgaatgttattttcaccttagcgaatgttttcaggctgatttgatttgtaaatgtagaaccagaaaaattgatgagtggactatctgctctaatctccccatacctctacctcacatttttaaaaatgagaaacctaattgggtaggtaagggtgcagttagattatgcttcttaaattgtgtacaggctcatgttacattttcttactttaacaaaaataagtgtagggccaacccaatttagaatttttttaaagtcaagtttttatttttattttttaggctttaggagatgcttctgaaattttggttgaattatttctgaccacgtagttcacttgcttggtttatgatgcctgaaataagaggaagtgatcagtgtcatccacatcagaataaatcaa

SEQ ID NO: 44630 - DNA, 1029 bp, Homo sapiens
attgctggttagttttctttttctttttttgagatagggtctcactatgttgcccaggctggtcttaaactcctggcctcaagtgatgctcctactttgggctcccaaagtgctggaattacaggcgtgagccactgcacccagcctatatacatttcaaaatctgtttgtctagttctttttaaaaaaaattagtggtatgtttattggaatcccattaaatttataaattacctaatttctttttaaaatataagggttaagtctaactaaccataccatcacctctctttttgtgtcctttaattatctcccaagttttctttatgtgactcttgtacattttttgttgagtatttctaggtattaaacttgctgctgctgttgggctttttccacattttgtcttctgttttgtaccctgctaccttactgcattgtcttcatgttttatcagtttctcagtacattcttaggagttttccagctgtgtaattatactgtctgtagttattaatggttttaccttctatccagtctttataactgaagcttctttctcttttctacctactttatttatttattttttggttgggcgggggaggggagtggggaggctttctgataaaaaccagaaagcctgctagacaaattctaaaagagctgtaactgtcttttctacctactttagcttgtagtttcagtacagtttaaaaattagtagtgctggtagatagagataaatgttctgtctcttctggatgagttttagaaaattattctttacatccaggttttgagatttatttgtatgaagtttatgtgttctctaatgttcgttttatttttgttaatattcttgttctctatatatttcattgtcacttttttgttaagaagtggtttttgtattttaaattatgtatttttttcttcagagaaccagctacaatgttagtttaactcataaacagaaaaacagttgtattagggttccttaacaaacgtaatccagcaccagattag

SEQ ID NO: 44631 - DNA, 1049 bp, Homo sapiens
attgggaagaaacagagtcaatagttggtgttctctacttggcaaagctcatgctaaggcagcatagaatagaataatttggcgggtgaaatagcaatttctaagaagcgtatttcaaaaaagagaaaataacaaaaaggtaccttattgaccttattgatcatctagttcagctccttcattttacagatgagtaaacagacccaagaggtaaagtgatcactctaagtcacaaaatcagttagtagcagagctgggagtagaacctaggttttctgcttcccagtgctcttaaagcttttcatatttgaatttgaattttgtttttgactgactggcattccacagacatgtaaagtatgtgagaagtaagtaaaacacaaaatagagatgatttcttagaaaatcagctttgttatagagacataattgggtagagaaaatgaaagatcaaaaacttgtttacttccattctttttttcctttcatattctcctgtttagataaagaaagccgcccacctcggaaatttccttctgataaaatttttgaagccatttcctcaatgtttccagataagggcacagcagaagaactaaaggaaaagtaagaatttgttcctttgaggcaatcttgccctgtatggtatgtaactcaccattttggtttattacaaatggaatcaatgtagcggatgagccactacactttgtttacagtgtttgcaagatacttgaagcaacatgtgtacttgtggtactctgcattacaaaatatttcctgtagatagaataaatacatatgtataatttatatatacacataaacacacacatatacataaaatttacagtagtacatttacaggaaaattatctggatactggtagaaatttgatgtttagttaaaactaatataatatccttttccatgatatatttgaatcatatcgatgaatttgattcttgataacaccatgcacaatatttagttggctctttatctaaatagagccattcctttatgttttaggcaagataaacatcaa

SEQ ID NO: 44632 - DNA, 1035 bp, Homo sapiens
tgtggtgtttttgtattatttgaatgtgggaaactatagtgtaaaatctatatgcacctaagaaaatgttcttgatatttttgaggatacactagatttttaacctgctttacaggtgttatacattttctaacaatgaacaatttctcctttcctctccttcatttttttttttaagagtatgtttagttccaatcgtcagaaaattttggaaagaacggaaatcttaaaccaagaatggaaacagcgaaggatacagcctgtgcacatcctgacttctgtgagctcattgcgcgggactagggaggttggttaacataacatgttgtagtaattatcatcatcttttggtttatgctattggaacatttgtttggttattgggaggaaatcattgacctcagggtgtccatctttttattgctatttctttttaatgtgcaactgttaatgactgctgtagatcacactattagctattcctataacagagttctaagtgtttggaatatactttgaactaggtagatgcctagattttataagaatgttgatttaaaaaaaaaagcttttaaatcaaatactctttaatgtcctcatcagatcactatttagagcaaggttttctgactcactgttgtaaccccaatttgaattagccatgtggtaagaaatgttttaatattcatggacaagaaagctttttattatatattttgttcaaaggctaagcctctctataagaatttttaaatttcttgttgagagattggaatttctttttctatagtactttctgaacgagctagctcttaattactccaagagtttcctattttcaaagaaaggcagtaaatctatggtagaatctataattaaatatcccgttaaaacatgattgcagcaagatgagaagaaaatggcaaaagtctaaatagcttaggcatttctgtttttaagtgcctgtgttgtatagaaagacatggcataggatatttaaaggggagttgaagcaaaaggggaaagagcgagttg

SEQ ID NO: 44633 - DNA, 1013 bp, Homo sapiens
tggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattaggtatgttattaatggtagaaacagcatggaaagtcttccagaatattagacaaggacagttctagtactaaaacataaaatgctaactaatgtcttcatcaagacataaaatatgtatcttaaaaaataaattgtaagccaggcgcagtggctcacacctgtaatcccagcactttgggaggctgaggcgggtggatcacaaggtcaggagattgagaccatcctggctaacacggtgaaaccctgtctctactaaaaatacaaaaaattagcctggcgtggtggcgggcaccggtagtcccacctacttgggaggctgaggcaggagaatggcgtgaacccgggaggcagagcttgcagtgagcggagattgcaccaccgcactccagcttgggggacagagtgagactccatctcaaaaaaaaagaaattgtaataacacccacattatacatcagtgaaaactaaacacgttactaccctaggccttattgcacaggggtgctacctccaaggagaaatttgtctaggcagcagatggactagaggtgattagcctatgagcgaatgaggctacagatcattcctttttatctgattccttttctttctagttcctaggccttggaagcactaagtggtcttaag

SEQ ID NO: 44634 - DNA, 1033 bp, Homo sapiens
tggagtaggggcgtatctggtagagaacagtgctgattccttggacttgtgtggcctggccacctgagaggtaggtaggaaggtgtgtcttggccatgtcctggggcctctgtaaacctgagaggatggaggaagctctactttttctgacgatgctgttggtgataatgaagtaggctatgagagcccatcttccattaattcagatgttcctatacagttggccctctgtaaatgggattctacatttgtagattcagccaactgtgggtaaaaatacttgaaaagaaacaaaagtgtgtgtactgaacatgtacatacttttttcttgccattattccctaaacataatagtttaacaactatttatgtaatatttacattgtattaggtatttagtaatctagagatggttttaaagcaggggtccctagtccccaggccgtggactggtacccgtctgtggcccgttaggaactgggctgtacagcaggaggtgagctccgcctcctgtcagattggcagcagcattagattctcacggaagcgtgaaccctattgtaagctgcacacgtgagggatctaggttgcacactccttaaaagaatcttttttttttggagacggagtctcgtctcactgtgttgcctaggctggagtgcagtggcatgatcctggctcacctcaacctctgcctcccaggttcaagtgattctcctgcctcagcttcctgagtagctgggattacaggcacctgcctccacacccagctaatttttgtatttttagtagaaacagggttttaccatgttggccagactggtctcgaattcctgacctcaagtgatctgcctgccttggcctcccaaagtgctgggatatgagccaccatgcctggccatccttatgagaatctaactaatgcctgatgatctgaggtggaacagtttcatcctgaaaccatgtaccctctcccctctttgtggaaaaactgtcttccacaaaaccagtccctggtgcaaaaaagttggag

SEQ ID NO: 44635 - DNA, 1992 bp, Homo sapiens
cataagtaatctagagccagatgatttaaagtataaaggagaatgtgcataggttatatgcaaatactgtgccattttatataagagatgagcatctgtggattttggtatccatgaagttcctggaaccaataccccctagacccccatggatactgagggcttgctataacagtttttaataaaaataaaaaacaggccaggtgtagtggctcacacctgtaatcccagcactttgggaggccaaggtgaggtgattgtttgagcccaggaattcaagaccagcctgggcaacatggcgaaaccctgtctctgctaaaaatagaaaacaatagccagacatggtagtgtgcacatgtggtcccagctacctgggaagttgagatgagaggatcacctaagcccaggagggcgaggctgtagtgagccgtgattgcgccagtgcacttcagccagggccagagtgagaccttgtctcaaaaaaataaaataaaataaaagtaaattgtaaaaaactctttagtttttcatttctattatgttaaatgttaatagctataacacatataaactaaacaggtcatgagaccaaaatgctgaagaatggtgttaatggtgttcttacttactttgaattaccgtttttatttttctatgctagctaattactatgtgaataattaacctcaatgaagttctgtattctctgttgtagcagtggctgatttagggctcagttgtcttttgacctgttcttccttctcatatgattgcatctcgatttttaattttagacttagtttttaattctaaaattaaaaatctttttttttttttcttctatgcccactgctgtcaacccagtcagggcccttatcactttattcttgaattacttcagttctccattttttttctcatgtggtgtttttcaaacttgagtgttgattggaatcccagggttaattcaactttaattttatgaatatgatttcatataagttccttatgataaaaccagagcagatttacaaattaaatatagaccatcaaattagctgtacatatttaaggatgagattttgttaaaaccaaatagtcaatgttagagcttatagaatggcatagcctcaggatcagctttataatcagtttttttaaatttggcttgataatactaacagagaatggctatttgcataaatatgttttataaaatggtgttaacttttagtctttgttcaggataatgagacctactagttaaccagaacggggccagcaagcaactcttgaatgctagttttaatgcctgatcaaaattctgtaaagctgtgttgatcactgaggcgttgcggatatactgagcctgcattaagtggatatttaatctaattatttctggaatctttaccagaaaacatgctcttacatagtttgctcctgggtttgctgttggtgaactgccgttggttggtgggatctctgtgtcccatgggctttgccacacagctggggctctgagtacttcagctcacattcctttgtttgccacccttgccttaactcacttacctgtattgttttttctcccatagcactcaacatcatcttacatgtaaacattttactttgttgttgttgttgttgttgttgttgttgtttttgagacagagtcttgctctgttgcccaggctggtgcagtggcacatcttggctcactgaaatccctgcttcctgggctcaagtgattctcatgcctcagcctccttagtagccgggactacaggtgtgtgccaccactcctggctaatttttgtatttttagtagagacggggtttcaccgtcttggccaggctggtcttgaactcctggcctcaggtcatccacctgcttcagcctcccaaagtgctgggatcacaggcatgagctactgcacctgacactttgtttttaactgtttctgtccaactagattttaagctgtataa

SEQ ID NO: 44636 - DNA, 1026 bp, Homo sapiens
cttgtgtgtttttgtcattcttttttctttttttgaaaaaacaatagagtcatttaaggaagcaaaaaggtccctgggtcaagatttttattttatcttttatggtggtagggtgaggtgtgagtatttagggagatggttggtaggatggcgttgtcttagggttgcaggaggatcagaagggtgactgtaactactgatgatatcttacagtggtgaaggagaagataagtgaaaacagaggcaatttgtttaaacgaattttagtagatattagtctcttaatttggcactgacatatgacagattatttcatttaaattctgtagtttgacaggtataataaagtacccttcattaaatattcttcacatatactcttgtttgcctttttctagttgcaagagtggtgatttctatgtttcattataaattttagaaatatataatttgaatatattgtctgttctaggttctctgtgagtcaagaaaaggcagggtattatgacttcggattcgtatgatgtctggatatatttaaggggagcagttctcaaagtgtggcctgggattatgggatcaaaactattttttctttctttctttcttttttttttttttttgagacagggtctcactctgtcatccaggctggagtgcagtggcgacatcttggcccactgcaacctctgcctcccaggttcaagtgattcttgtgtctcaacctcccagaaactattttcataataatactgagttgttccttgcttttttttaaaaaaacaaaacaaaacaaaaacaaacaaaaaaaccatgttggacatttgtacccacggtgcaaaagcaatgaataaacactgttggcaccttagcacttgcagttaaaaaagccagttttgtttgagaatgtccttgatgaagtactaaaaatgattaattttattaaatcttgatccttgcgtgcatgcagttgtaacattctgtgcaacaagatgggaatgtgtgtaaagtgcttctgctgcatat

SEQ ID NO: 44637 - DNA, 1032 bp, Homo sapiens
tggtacttccttgaaagaactggctgtggcatatacagaactcaaaaattgaaattactagataatggttacttggtttagattgcctggaaattatgagaggttctgtaaatgctttgggattagtagtttgaaccacctagtccattttatgattctgtcttcagaatatagaaggaattgcatcttatttggggattaggatataaagttagtgtacaaggcaaaatagcatgtaggcaaagttacccatgcagagtttgtgggaagatgccttaccacaaaccagtaccttctttttaggttcaagaccagcccatttttcctctagaatgagaacagatcattgctcttctgttgagcacagagttgttggtttgtacttaagggcaatcctgttagaatcactcctgagtggctaaatatcttcagtctgagagacttgtccagcaggttatgggaacagcagattcatgtcacctgtctcttgctcacttaggcaaacgcttagtgtctggaatggtgggtagaacccttgtatttactaccaaaattgagctttctctgacatttttgctcaatgtatgttagatttgtgtaagttaaattagatgttggcttatgcgtggtataagatttaaaatagacttcttagcaaaaagaacacctggtatcagattgacttaccccttcattttgtttgcttttattcagtgaagtgttgaaataacaggtatctcatgtctcatctttgaattataatgaattttgtatcatagctttagtttctggtacttttttttttttttttttgagacaagtctcgctctgtcacccaggctgaagagcagtggcgcgatctcagcttaacgcatcctctgcctcctaggttcaagcgattctcctgcctcagactcccaaatagctgagatcacaggcacctgccaccatacccggctaatttttgtatttttagtagagatggggttttaccgtgttggccaggctgatctccaactcctgacctcaggt

SEQ ID NO: 44638 - DNA, 1017 bp, Homo sapiens
attttcttcttttcccatatggaagttctagggtgatatagtttggctctgtggccccacccaaatcacgcgtcaaattgtaatccccaaagttggaggaggggtctggtgggaagtgattgaatcatgggggcagacttttcccttgctgttctcctgacagtgagttctcgtgacagtgagttctcgtgagatctggttgtttaaaattatgtagcacctgccactttgctctctcttccccctgcatcagccacgtataatgtgctggcttcccctttgctttccactgtgatgataagtttcctgaggcttccccagccatgcttcctgtatagcctgctgaactgtaagcaaattaaacctcttttctttataaattacccaccctcagctctttatagcaatgtgagaatggactaatacagaaaatatgtaccacagaagtggggcatcacaataaagatacctgaaaatgtggatgcagcttttggactgagtaatgggcacaggttggtacagtttggagggctcagaacaagacaggaagataagggaatgtttggaacttcctagagacttgttgaatggttttgaccaaaatgctgatagtgatatggacagagatggctaggctgatgaagtctcagatgaagatgaggaacttattggggaactggagtaaaagtcactcttgctatgtgttagcaaagagactggcagcattgtgctcctgctctagggatctgttgaactttaaacttgagatgtttagggtatctggcggaagaaatttctaaaagcagcaacgtgttcaagaagtggcctggctgcttctaaaagcctgtgctcatttgcataagcaaataaatgacctgaaactggaacttaaatttaaaagggaagcagaacataaaagtttagaaaatttgcagcctgccatgtggtagaaaagaaaatctcactttctggggagaaattcaagctggctgcagaaatttacataagaggacgata

SEQ ID NO: 44639 - DNA, 1033 bp, Homo sapiens
acacagtttcactctgttgcccaggctggagtatagtggcgtgatcatagctcactacatcctcagactcctgggttcaggggatcttcccatctcagcctcccaagtagctaggactatagacgtgagacacgatgtctggctaattttttacattttttattttttgtagagttggggtcttatatgttgcccagggtggcctgccaccttgtcctcccaaagctgggattataggcttgaatcagatcccagtgatctttatccctcagctgcatttatatgggctaaattcatacatagtatatcaagatgtcttcaggaagtttaaaaaaaaaaaggtatcaaaaagacagtatgtcatgactgctttatctattttagtctcttagtttttgatactaaagactagaccggagaaatgctttaacaaatcacaaaaatctaagaaaatagacagttaattatttttaaacagtggaagaatttcaatcataattaaagcagcttttgtattttttgatgtcatagcctatagtgaaatttcatatattctgtttgtagatacatgagttcctacgatatgcttgcacataatagaactaattactatttgttgagaacctaacctgtacctaatatacatgtagtttctaaatcaaacattttactttttttaaaaattgtaaaaagcccatagtaaattaatcatgtttaccatttaaaaatgtacagttcagtagtgttaaatacattcacattgttgcacaacagatctctagaacttttttgtcttgcagaactgaaattctgtacccattgagcactaattcccacttccccctccccccaaattcttggcagccacctttctactttctgtttccatgatttttgactgttttagatacttacatgcatgggattaaacagtatttgcccctttgtgattagcttattttgcttagcataatgtcattgaggttcttccatgttgtagcatgtgacagaatttttttcttttctgtaaagg

SEQ ID NO: 44640 - DNA, 1029 bp, Homo sapiens
cttgaactcctgaactcaagagatccacctacctcagcctcccaaagtgctgggattataggtgtgacccactgcacccagcttttgtttttaatatttgtaagaaccaccttgtgtctgccaacaggcgaattaacaaaatgtggtatataaaccaatgaaaacataaaaggagtgaaataaagacgtaaaaggagtgaaatttcaaaataaaagtaaaaagatttcaaaataattcagacataaaaggagtgaaattctgatacatggatggagctggagaatattatgcttagtgaaataagccagatacaaccttttgtacaaaaatacaaaattgtatgatctcatttatatgaggtagttagaagaggcaactctatggagacagaaagtagaatagaggttaccagggctgtgaggggagaggtgaatggggagtttaatgaatacagagtttctgtttggaatggtgaaaaaattctggagatggataatagtgatggttgaacaatattttgaatatatttaatgccacagaattgtacacttaaaaatggttaaaatggtaaattttacacgatatgtatctgtatctatatatatctctctctatatctatatatcttaccagaatacaaaatttaataacacactccgaaaacctttacagatgaggaaactgaagaaaactgtctacaggggaggagttaagaatttgcccaggattattcagctgggaatttgcattcgggatccaaacttagttctgtttcactacatattatctactccatattatctgttctgtgttatctgctggctttctgggtgattaaagatatgtcagctccgagaagaatgagtttatttgaatcattcagaaagttacatttaaaagtaggtaattgtagtttgatggaaggtacagtgtgaaaccctagacagactaaaggttaactttgaggatttctttctcagccagagtggtaatagtatgcatttgagaggggaggagagtagagttct

SEQ ID NO: 44641 - DNA, 1031 bp, Homo sapiens
atacggttagcagtttcttattaattggtctcgttttctgtgaacaatagctttggtgattcagaaaagactgcatggagaaatgtttgttgcctaagaaatttaacgtgtgctgtccacagttaaacttcctttatcacacaggatctgtaacatttaaattcatttggaaataaaaatgtgtctttgctatttacttaaaggcttgctttttagggttcaagcaagttattattagtttaattttgtggcgttttgatgtcatcataaaacagcatttaataaacctttgaaaaacacgaatgctgtcacaattgaatgtagtttatacttttaggggttttggagtttattttctattactcttcataagcattagcaactaattcatgtttaggaatactgtacaagtgtgtaatcctaacttgtttatttgtaattttatttgcaggaaaacaagtatttaagatatattttaattttctattcatggtctctaaagttaggaataggtaggattctagtcatagatataaagcgtcttgttctctcttttcggaggtgtgttgggtgatgtaatatttaaggtttcccggaaacaggaacactgcatcttaaattctcgtttttgtggaaagtgaatatattccaagaaaacaagttagaaaaacataggcgttcttctggttgcactgtcctatatgataaagatctaatgtgcatctgctaacttaaggtttcataaaaatggagacaaataaatgcaatataaatttattacatatattttggagagtgttgacaccactgtacgggcattccaggtgctggtctaagtgttgagacattataacaaaaaagtaacgtttatattagttactattaattctgtatttaaaaaatcctattaataatcttgtccattatgagataaggtagttatgcagatttttggcagaaattcggatattttaggatacatatgtgtgtgtgtgtgtgtgtgtgtgtgtgcgcgcgcgtgtgtgtgtgtg

SEQ ID NO: 44642 - DNA, 1049 bp, Homo sapiens
gttgctcaggaccacggaggagtgtgtaggcagctgagtccccactgctgctttaaaatgtctattttttcctctctcattcttgatcatgttctgcctacttttctgaaacctggtgttaactcaacacacagagaaacatttgaagaaactgctcacaactcaaacccagaattaaccctttagccttcagccccaccctttgtttgctcatggatctgaacaaagtaatcactgggtttttaaatgttttcaagagtcatgaattattgtcttaattgttttaagctataaaaattaattcttttaaaaagggtattcttaaaaatccttttggtacgaatggtaacagtagaacaaacacatccatttaacctaaaagagttttcatgtaatagcaagtcaacaattattcattcaactagcatgtgattttttcttctttaacaagagtggtacggttttgtgggtgctttggggatggctaataaacatgagaggacatacctggttgatcctgacagtagcaaaagaagaaaataataaattttaaaaagaaataggaggattgtcaaggcctctgctggggtgggtaggggaggtggaattcaaatttttgagtaactgacaacggcacaagcactgaccactcagaatggacactggtcacaaacagcctgtgtggctgtattggtgtcaccttaacattaaatgggtcaactttcctttggtgccagcactaactggtttccagctccaacaccccagctctggctacaaacttctgttaggcactttttttttttttgggacggagtctcgctctgtcgcccaggctggagtgcagtggcatgatctcggctcactgcaagctccgcctcccgggttcacaccattctcctgcctcagcctccctagtagctgggactacaggcgcccgccaccacgcccggctaattttagtgtattttttttttttagtaaagacggggtttcacggtgttagccaggatggtctcgatctcctgacctcatgatccgcccgcctt

SEQ ID NO: 44643 - DNA, 1100 bp, Homo sapiens
aacaatagctagacaagacaaagcctgtgaaatcttatgcaggcttctctattaatgtggtttagaatgatatgttaggagcactgtataccagaagaatattgattgcatttcagataatgcaatttacagttaataagatggttaggctggtccagggaaatatttgttttcttcaacaatgttaggcagaaaacatacattttaataaatactacatgagaacaatccttttgggtgaatttcaaggaaacaaacagactaccatatggctacacattggtggattttcacatttctaaaatctggataaatgtattatcagtaatactttgctttacaaatagatttgtttgaattattcttgctttagtaccagaaacctttgctgacattttgtatgtaacgtttaatatctaaggatgatagttctaggacagaatatataatgtgatcacatttgtttttaaaaaaatacacacacacacacacacacacacacacacacacacacacacgcaaactctggaagactagaccccaggtttcataggggttatggtgaagaacagggcagagtgagattatagggtatttttacttttagagttaaatatttctgtgacatttgaatttttataataagtatgtattgtttttgaaatcagaaaaagatatattaatttatggggctgacactgatgatgttgacagtcaaaatagtattgcaaagagcctgaaaataatctagctgcagaatcatctaccaaaactgattcctgcctgcatgtacaaggtggatgctgcagcattgctcagagtggccacagatctgccactccttgaaagtccatcatcagagggagagaaagaggaagtatgaaggcgtatctgtctgcatagactaggaaaatctggcagaggatgagaacctagtaactctaaagtcactgggggctgtgatttttcaatttggtaccatgtgcttggtccacatgttaaaaaaattgggcggccaggggtggtggctcacgcctgtaatcctagcgctttgggaggccaaggcgggcagatcatgaggtcaggagttcgggaccagc

SEQ ID NO: 44644 - DNA, 1011 bp, Homo sapiens
tgtcagcctccaggtagtggcgcttgctgggatttaccgacgctggaagcacagactttatctgtagggctcacagtttcctccaggtcccacagagctgtccggagggtcacacagcaaacagataaaggaggccagcgcagattgggcggctctctggtaccttgcggtggctgagccactcaagacaaaccgggggaaagacgccctgatgacgaaatgctaattttgcatatctctttcccaggatgcttagcaacacgtctgattcttgttattcagtacgtttttccagctattgataaatagatgtgccagggaattcttagagtatatatatatcattaatattgtaaatatagtcatcagtaaactgaaaccagaatatcactgtaaggggaaaatgaacaaatttgggggctttaaatagttcaaacagtaggaggacttattggctggtccgaaggtagtgagttatctcaattgattgttcacagtcagttacagatcgaactccttgttctactctttccccccttctcactactgcacttgactagtcttttacgagagtttccactctcctggcatccctcgtttcttgttttcatctcaattttaaaatgttgaaagtcagcatcattaaataaagcatggaatacagggggaaaacgaagtactattcttttcttccagaaacaaacagtaaatttgggaaaacccatcacagacaagaaggaaaaagaaaacaaaaatcaaataaatagtaatagatactacggaccaattattggtaaagatggtatagtatgtcctaagagatcaaagacaggaaatgggatgagggtgaataggggtttttctttttcttgtactttttcttttcttttctttctttttttttttttttttttttttttttgagacaggctggagtctctgtcacccaggctggagtgcagtggtgtgatctcggctcactgcaacctccgcctcgtgggtccaagcgat

SEQ ID NO: 44645 - DNA, 1052 bp, Homo sapiens
tgggctgcattgtgggtggccagtgggtctcagggataagggggcaggatctccagggctctgagactgatcagatgctgagggtgggtgagtggacccaagaagacggataagatgcccaggtttctgaatgaagggttttgtcacttatgaaacttttcagcatatgcaaaagtaaagagactaggataatacacaccctttactcatcacccacctaaaacaaaatgttgctccatgtttaaacctgtgcctatcccaccctgcccgccccttttttttttttgaggatatgatggaggaaggacaggtcttgcctgtctaggtcatatcacctctgcctcatagaaaaggaagcagaggtcagatagtaaagaatttcccccagagccacagggtgggtaaactgggaagctggagcggaactcagaacaggtgtccttcagtgcatcagcagctcctagaacgtgttgaagccttctgaaggaggttagtatgcactccactagagtagaatctgtgagttacttggcttgggaaataatggagctcaaacaaataaaacttccgtggggttcttgggtgaagagcctctcagagcctgtagccccggcaggccaggcctccctccaggagatggataggacctttgacttcaaggtccctggctttgactacacatcccacagatccacgagttcccgaatgatcagctctcctaacacgtaagtctcgtcagctgagtctgtcttctgagcacacacctgcccttggaaggaccaaggcatcccctgtcaaggtgggccagccctagggtaagggctgtgagctaggaagggctccaggagccccatggacaaatctgaccctccaggccaccaggtgcacaacctcagaccctacccggtgcagcaaagggattaaactcgagtggacatgattgattatttgattcctactataatgaattaaagaggtacactcatgcactgagtaatgacatttctgtcaatgatggaccacatttatgacagtggtcccataaaattata

SEQ ID NO: 44646 - DNA, 1272 bp, Homo sapiens
tctctggcctttgcaaggacagagagtagagagtagcagctactactttctacagtagtgggctcttcctgtgtgactggcccgtctggtggccacaccaacctcactgcctggtccagagagagcccccagaatctttggcctttgcagcactgacgccccctcccgccttgctttccttggcaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgc

SEQ ID NO: 44647 - DNA, 1023 bp, Homo sapiens
tggctcactcagaaatcccagcctggggcccttgcacgttggtggctcaggtatattttttaattgatggcttccctttttagcaggatgggagcttagattcaggtgcagaaccctcttagagttgacgtagctgagacttggaggagttcagaggctgcagagctgggactagaccagccctggccccaggcaggcgtggccgtgccacctgggcacaggtcttaagggcctgttgggcttgcagctgtggcccccgtgacaagtggggcttttccagaaacatgtttccctccaattgaggtaaatccagggtttgagcattgtcagaatattagcgacaggacctgaagcctgacctcagagtctgagctgggacttgctctgtgtggccgcctggcttatggcccttggtccctttcagcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggtgagcccgtggctggggctggggtctcccatcagctgctgtgctcctcgtgcggaatccagacaggccaggggcgtctggtgctctggccacgggcacgacacccccttaagtcagccagcagtcctctctcacccccgagggactctgacttctcgtccagagaaatgtcgggtgtgaccccaaactccaaggcaccagaatagcttagaagaaggatttgcaagtgttactattttcttcttggcagttctcccagtgtttactttgaaagcaaaagcaagattcggagtccatctcagggcttacctagcatcactcagcggccttagcacatttccagcgctgatgtgctaaaattccag

SEQ ID NO: 44648 - DNA, 1050 bp, Homo sapiens
tgtcaccagccaatgacgtggtgggcccccagggaccacccgggacttgacacattctgaagtgtatgaattttaggaaagtttttttttttttttttttttttgagatgaagtgtcactctgtcacccaggctggaatgcaatggcgcgatctcggctcactgtaacctccgcctcccaggttcaagcgattcttctgcctcagcctcccgagtagctgggactacaggcgcgtgccaccatgcccggctaatttttgtatttttagtagagattgggtttcaccatattggccaggctggtcttgaactcctgacctcgtgatccgcccacctcagcctcccaaagtgctgggattacaagtgtgagccaccgcgcccggccaggaaagttttaaggagagtcaccaccagctttgtaaccagtctgggtgttttccactcagattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtaaggaccgcgttctaatttctgcaggtggacaagcgctgtgctccattcgctcagcccttcacccggtcatccagaccttggggggtggggtaggagtgtctgggtgcaggaacttgcactctagctttaagaacgctgggagctcactcgttctaccactgtgcgttgaacggccagtgagccagccctcatggaaggcgatgtcttcttgtctcagtccagtgggttaaagatgaatacgtcctctgatggtcacagctgggggacgggcatttaacaagcggcaatgacacagagccctgtgttggtaacagacacgtccttgttatagattctgctccgacctgtctcaggccaccctgccttcctcttccctcaaaggctgttgctcaggcagctgccccaagtgcaggctgttggc

SEQ ID NO: 44649 - DNA, 1032 bp, Homo sapiens
atagtaggctaggtgcttacagaactatgtcctatggtaattgctcaaatgttcatttaattgaatcaaattatttcagattgtgtttctccagttacaaataagtgtctgcagaagttccaatgattgacttctctatgagtctccccaaactattcctgtaaaacaagggcctatgtattcaatattccacctctgtcagggtataaatctgctttgtttgcagcactggttaacttttgaaaagaggaacagcaaaatcatcacaagtctattcctggaattatgtcactaaagcctaagtcaattcacatgatgaatattctgccttctcaagatttgtgtcctaactccttccccaatataacaaaggtagaagggcttttaaacattactgatgaggacaggtgtgaagccaccctgagacaaaaggaaatgtgtttggggttccaagtggcaatgacctttgacgacatggccatctgtttttcaatacaggagtaggagaatctggatggatatcagaaggaactttacaagcaggggatgaggagtatctgtgaagctctgatctctctaggcaagatgggtttttgttgaaaatttgagagtaattcatgaaatcagagactaagcaagtctctgcaggttacctgttctttctgttggctgcttggttggcctctggagacagcaacctacttatcagtaggatatcctgagaaaaattatttccttgataattatgcctagttcatgtcttccaagtatcctatttgccttataataccttaatcaaatgctttattgccaccaatttcttagggtctctgcattttggctttattgtcttagaacgcaacccacaaaacagccagaagtgtatgtgccagttaaatcaatgctcatctttccagaattttcattcctttatttaattcaggagaaatcaataaacacttattgcatacttcccatgtatcagattctggggtaagtagaaagataaataaaatatagtccctaccttca

SEQ ID NO: 44650 - DNA, 1068 bp, Homo sapiens
gtgtccaggcacaggaaaggcagagcgttctcagcatgccctgcctgtgccctgggcaacggccgccgccgagcgagatcccggggtcgcgcagggtggggctggggctgaagggcgcaggccccgcgtacgggggccgcccctgcttttcctccgcgagaccagagcttagactacggcaggactagtccctggggttccccttcgggtgtcagaccctctctgggcggtcgcgggagggctcgggctcgcaggatctgcaggtgttggggctggggcagtggggagtggtccgtgggcccaagaggacgaagcggagtcgggcggttccggctgggaggaggcgcctccccggggctgccctgacctagtaaaatctgtggggaagccctggccggggagccttcccccagctcgctccctggggcctggacaaaaggccgggaaggaaacgcagccctgggctctgcggtctttggaacagagactgcgacttttcatcttcgtttcccacctagtgtggggcccccgtgggtgctgtacaaatgctgtggaatcaaagaatcagtggaggagtcccgcacgcacccattgattttactcagtccagagtttccggagagtgcctgcttccctaagcgcagcttgtgggcggagactctgctggatgaggtgcagattgggagaaagaacaggaaattacgggtgagaaaagaaaaggattcccataaagggcacatgtgaaagtacaatgctgaattgcaatattaggcacttccattttctttttatttatttatttaagacggagtctcgctctgtcacccaggctggagtgcagtggtgccatgtcagccgactgcaacctccgcctcccgggttcaagcgattctcgtgcctcagcttcccaagcagctgggattacaggcgtgcgccaccacgcccggctagtgtgtgtgtgtgtgtgtgtgtgtgtgtgtgtgtagctgggattacaggcgtgcgccacccccccccccccccggcgagtgtgtgtgtgtgtgagtgagacggagtatcactcagttg

SEQ ID NO: 44651 - DNA, 1109 bp, Homo sapiens
gacagcctcagtgtgataaaaaaaatcagaggcagggctttatggaggggatgggcactaggagtaaggtgacaaagctcccagaccacttaaaggggcagaaagtattaatgtggggttgggggagaaatacagtcaaatattttgtattataaagttttagggcaatttgctctagcaaaggcatttttttaatatctctgccctttacagaccctccttttggcaacattttatttcaaacttaaacacccaaacacatacatgttctccttctcttatttctgaaaatttttgctttatacatatgcaatgtttggagaaaatacttttttcctcttgagttcattctcagtctccttcaaataagcatttcattacctttacaagttttgacactgtagatgagtaaagttcactggcttctcatcagttcttagtgactccatggtatctctccactgctcaggtaactgagtatgctactaacatactaacacaacagacacctagggcttagaaactctttatgcagatgacaggttttatgttggtaattgctatatgttctcttgaatctcctcagtagacaacctttcgatttcaactttttttttttttttttccttgagactgagtctggctctgttgcccaggctggagtgcagtggtgcgatctcctcactgcaacttctgcctcctgggttcaagtgattctcctgcctcagcctcccaagtagctgggattacaggcatgcgccgccatccccggctaatttttgtatttttagtagagacggggtttcaccatgttggccaggctagtctcgaactcctgacctcaagtgatccacctcagcctctcaaagtgctgggattacaggcatgagccaccgcatccagcaacctttcaagtgcagatttgattactactaatggccgaaattcatgtaaaataaagtctagtgcttatacagaaacatcctagttcttccaaattcaaaaataaggcattaaaaccaagtgttggccgggcgcggtgactcaagcctgtaatcccaacactttgggaggctgaggcaggcggatcaccaggtcaggagatagag

SEQ ID NO: 44652 - DNA, 1032 bp, Homo sapiens
gggcaaaaaaaaaatcctagaaatcctgtcaaagaatgtgagtaatttgaactggcatgacagatagcagtgaccacctagtagcttttaattggtcatcttatgcccaccatttagaatgtttttttttttttcctctcagaacatgttcagaaacaagggagaaaagagccaaatcacttacagatacatgtgacctgaccaaaatgaaaccaaaagtaagagtgttcataaaaattttaagccaagtatgcagacagatacggtttggatctgtgtccccactcaaatctcatgtcaaattgtaatccccagtgttggagaggggcctagtgggaggcgactggatcatgggggcggtttctcatgaatggttcagcaccatcccctcggtgctgtcctcatgatagtgagtgagtgagttctcttgagaactttgcattgaccacattgctggagatgaggatcatacagacggagtagtagcttgtgctgctggactaataggggacttatatacagcatttgggaaggatgtactgaaactagtagaagctaggccactgatccatgaattgttaactgaacggcggagatcgaagacgaacaaagcaaaaacccttgctacacgggcaacaaaagaattcaagaaactgaaggaccaagcttgatctgttaccactgggatgataacctgaggacccccactggaaatctccaatcttttgaaaaacctggaagtgaggagtgtgcatggatgctgaatgtttgggaatgagaggatgagtgagtgaggcttgaaaacacaccacattgaaaatcctgccacagcagcagccgcagccgccgccgccaacagcagcactgtcagtgagctaagtaagcactgacttcgtagaaaaccataacattggctatcttggaaaagagaaaaacaatggagttacttataaaaaaagaagaaagaaagaaaaagaaagaaagaaagagagaaagagcgaaagaaaagagaaaagaaaagaaaaaagaaaa

SEQ ID NO: 44653 - DNA, 1082 bp, Homo sapiens
catttatttcacctgttcttacttttttaacatgactaccagagtacttaaaattagatatgtggttcacattcttttttcttcttagctctggtctagaccatttacattgattatggttattagtttatttggattctttttaccatcttaaattgtgctgttaatctttagttctgccttttctgtatttttcctgcctctcctttgggaattattcatttaggtattttccttttcaaactattgttattttaaattaatttgacagttatgtattctatttctattgttatagaggaatctttagaaattttttcttcctttagaagttattttttgtgggtctgatggtaatgagccctcagtttgtgtgtgtatatgagtttatatgtgtttatatgtgtgaaaatatctttatttcatccctatacagtgagtcctctgtatttatgtattccacatttgtggattcaggtaactgcacatttgaaatattcaggaaaaaaggtgtctactaaacatatacagacttttttcttgtcattattctctgaacaatacagtgtagcaactatctacatagcatttacgtcgtattaggtattataagtaatctagaggtgatttaaagtatacaggaggatgtgtgtgggttatatgcaaatactacaccaatttatacaagggacttgagtattgtgggattttggtatccatggggtgccctagaaccaatcccccactgacaccaagggacaactgtagtggaaagacataattttagcttgagtgttattttctcttagcttttgaagataatttgccccttttttctggcttttgttgttgctattgagaatctgccatcagtccaatcaggattcctttgtggatgatctgcattttttctttccctgcttttaggtctcttgggtgatctgcagttttaatacaatgtgtctagatgtggatttattttcttttatcctgctttaatcactgaaatgtttcaccaatttgggaaaatgtgttatcttccctctttgaattttgccttgccccctttctaaccttttatt

SEQ ID NO: 44654 - DNA, 2746 bp, Homo sapiens
acttttctctcactctgcccagctgcagagtgctgttccctggtgctgttccctccgccctgtgccagggccttcgcagtgccctctactgggaatcctcctcaggcaggtcccacctgcaggcctttcgtgtcatcggcactgcaggccctccccacccaggactccaggcctactttcctgctttgggtcttccgtgttagacagtgtcacataatatatatgtttcctatttatagattcatcgtatgtcaggtctcctccattagaatgtcaatttcaaaagtataaaaatttttacctgtttaatcattttaggaacctagagtattgcctagtacagagtaggaattcaataactatttgctgaatgtatgctgtttcaaaatttaaaacgtgtgtgtgtgtgtgtgtgtgtgtgtgtgtgtgtgtgtgtgaaataatgtatttctgatagcatttaaattcctttttaggtctcccaggcctccctaggaattttctgtttattctttctatccacattttaaaacgtctgctgtgtactttggtagctgtaaacaatatataatacggttttttgtgttctgaaaaattacatagatgtcattatatttatcactcattattctgtatttcagacttatccatgttgatacatgtagatcaagttcattccttttaacagatgcttaatattccagaagcaactatattgtaacttattttccattcctccactgattggcacttaagctttttctgattgttcactctcacaagcaatactgtagtgagcgttcttgcgcctgtttttttgtggccctgtggggatgctgctccagggagtagacccagcggtggcctcaccacgtcgtaggcttgatttcatctcttccgttactgtatggccctccccaggggtacccagtgccagcgggtgctcctagaacttgcttcctaacgtctgcccagtttccataattacatttttgccgacctgatgggggtgagatggcctctcgtttcaacttgtattttcccccttaagttgcacgccctttttatacgattatttggctgcttctccagtgagttgtcttctgtttttctattgagatattcttcattttcttcttgattcagggcttctttgtatgtgttctagatacaaatcctttgtctattatttgtgttacaaacattttctccgtgtcggtggcaggtctttaacgttgtagttcttgtatggaagttttcactgttgaaagagtcaaacatgtcagtcttttcctttatgatctgtgctttttctgtagtgagatatccttgcttacctcactcaaggtcagaaagatactcttctctattttttttataaatttttaaaagttttgcttttcaaatttaagtctttaatttatctagaattaaaatttgtgtagcttgcaagggagggtttcagttttttctcccacaacgatggtctcattttccaacaaagtttgctgaatgtgttagcttttctccactgatttgtgatgcgattctgtcctgagctggtttctgcatgtgcacaagtctgtttctgggtgcttgcttctgtgtcattggtctctttgtcagtctctgcaccaacagcttgctcttttagcttcataataagccttgatatctagtagactaatccttctctgcttgttcttcaaaaaactgtcttggctattcttggatatttgttcttttatatgaattttgggatctgtatgtcaagttcctaagaaaatcctgttggaaatttgattggaattgcattgactttacagtctaatttctggagaattgctctcatgacaacattagcctttctactcattggaacactcatttattgaaggcttctatgtgcttgaataagattttacagttttcttctgatagttgtttttcattataaatgggatttttacagtttattagatgtattagttatttcaggtgtacaggtatgctgttgacttttgtttattaaaaaaaatcttgctctcatgtctaatggtttgtttctttatattctcttggattttttatgtagataattatatcctctacaaatcacacaaagattgtgtctgttttttaactttttgtaactttatttttcttatttagcagtttgactaggacatcgttgaatagcagcagtgatagtagcatcctgtctgtggacaagatacatttctagagtttcagccttaagtatgatttttgcctttggcttttgaaaatattgttaaagacatttccttctaaccatgctacccaaaagtttttattgtgaacaagtgttatattgtatcaaatgctgtttttctcctttttaaaaatattgtgttttgtttcttttaaaatagcagtccggaacctttttggcaccagggaccagtttcatggaagacaatttttccaccaatgggggaccgggagcatggtttggggatgaaactgttccatctcataagaagggagtgtgacccagacccctcgcatgcacagttcacaatagggttcgcgctgctgttagactctaatgccaccactgatctggcaggaggcgtagctcagtcagtaatgccagcgacagggagtggctgtaattacagatgaagcttcacttgctcgtcttccacccaccccctgctgtgcagtccaggttccccggggcatggggacccctgttttacaa

SEQ ID NO: 44655 - DNA, 1092 bp, Homo sapiens
ttgttaccttttgtgaaggatgagccctgggtgatggagttaaaagctcccttctccctgtgttgagtttcccagaatgccagtctgggaacggcggtggcttctctcctacgcaggcccgggatgtggacctttctgttcttgctgacttggagcggggaaggccccatctgctctcagatccagtatgtaattgactcacatttgagaaagactctttccttcagccttctcctacaaacatgcgtggcccttacggcaacatgcctcgaggtcagtggagaacatgggcagacggtgctgcttgcagcagacattttcttcatgcctcaaaactttgcttccctcagcccctggggctactgctcttctccttgtttaatcctgcccaggaagggcctggactctgtttcttcctgggctggttttctcttcctaatggtttctgtgtgaccccggagccgagggcagtgagacctgttagagagggcaggagcaggtgcagacgtgaggttgtttcgtcagcacaagtgcactgctgtttaacgtgcacgctctgtggcagtttcttcaccccggcactgtggacatttgggaccaggtgattctgtgtgtcggcggcatcctctgcattgtaggatgttgagcagcagccctggcctctcagggcatctccagatgccagtcacctctcccccagccctgggcatgacaaccagaattgtctccagactttgccagatgcccccagggagcaaaattgcctgtggttgagagctactgctttgtgacaatcaagagatttcatttctagaccattgttggttttccgggatgactgtccccagctttgactggaacgtggcaaaaactaaccttctgtctttcctcagactacgccatctccaagcccgaggtcctctcccagattgaacaagggaaggagccctgcaactggcgccgccctggccccaagattccagatgttcctgtggaccccagtccaggtaagggctgggagaaggccagggaggcatcaggtattgtgcaggaaacagagacggaaaggccagaaagggtgtgatctttcca

SEQ ID NO: 44656 - DNA, 1655 bp, Homo sapiens
ttgcttttagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggtaaggatgtggttttattgacttgaaataacaaagcccgcaagcaacaactgatcatccgcgggatgctgccacaaggaataattgagcactcattcagacacaggggaaaccactgcctctttcagtctttctcccagattccaacagtcagtgttacagcatttcaccttgttcacctccctgagaagacgttgcagctcactcaccccagtgggcactgggagcctctgctcaggtgggagacagatgccccccacatgcacatctggtgtttatgaagcagatactggggcttcataaacacagaaggggcagggaagtagccccagggcatagtgtggggcctcctgactaaaagtagcttgcaaacccctgcctataacagccacttcctggcagtcattgtgccacttaggagccctcctcaccgctcttcctttagttccttcactctgtatagaccctgccagagcagctcagggtggagcagctgcagccatgggacctgctccaggcaaggccctatgctacacagtccctgggggtgaggattccagaggagtcaattccctacccgcccttccaggggatggccgagatgagcgttcccacagggaaagtgaaagttgcaaggctgttgcggaaacaccaggggttccatctaggtcttgctgctcatctcacagaaagccagtcactgagacaagtattgtcagggaagaaggctttatccaggtgctacagacagggtgaacaagagatcagtctcaaatccatcatcatcaactgactaaaattaggggtttatatagcagggaagaaatgtaactacatgtgggaaaacagggattaacgaggggcaaggaagaggagttggccaacaggcagcaggtggtcacctggggaatcatgatgggtgaggggtctggcttctcactttccagatgtggggatctggtaaatttcagtttcttgataccgtctgggaggattgctggctggtttcctgagaaaggaattcagatgacataaatgtaaatttctccttgggtttcaagactgagagggtcaatttctaggtttattcaagaaaaaccataaacatcagttctatgggacaattgggcccatttcaaggctctgaggataagggttaatgaggggacagagtcgcctggagaagttcactggggcctacaagaaactagagaggcttcctggcaaagctctatgctgtctatcctctcttctctccttgcaggaagattccagtataatagacccgaggtgaaaaggcttttgttcaataagtagaaaactgaaggggggtgggaggcacatggatttgaaccagagaccgcttggcctgcaggcaaatgctgtaccttcagttgcacccctcacttgttacagctgtttctgataagcacttgtgcagccccatcagcacctcgatttct

SEQ ID NO: 44657 - DNA, 1026 bp, Homo sapiens
gaaagggagggagaccgtggaaagggagggagaccgtggaaagagagggagagggagaccgtggggagagggagaccgagagggagagggagaccgagagggagagggagagggagagggagaccagagggagagggagagggagagggagaccgagagggagagggagagggagagctgacttatttttgtaggtgaggattatcacccatgtgccttcttttctgttttccaatatacctactatatatcaacttctcagataaaatgctatatatttactttctgttcaattttatcttccatgttttaattattatgattagttaatagtgtttatgcccaatgtacataatcctaagctgaactaagagttctgatggaactttttttcccctcaagttactgatagcctcacattttcaacggcttggttttcttggaatatctacggttttccacaacctttcattgctccatgaaatgcctgtcaagtcagtttaccacactgtaaaagctgttacataattaacattttcacttcttgttttccagtagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatggtgagtagaggtgaattttttaagacctggcatgcctcgaaatgtccataattccacctacacacttgattagcagtctggacagacatagatttctagtttcaacttataatccttcatattgtgaaggattgtttctgttatcttctggtgtctagtattgctatagaaaagtcaagtgccattgtgatcctctatcttttgtatatcacctgtttctttcactctttaagttttgaagatcttcccttttgt

SEQ ID NO: 44658 - DNA, 1068 bp, Homo sapiens
cattgaggctttcaggtacggtggccttcagcttcgtggaaatagggaaataataacaacaaaaagcaagcagggcagttgggcctgatcagattaatccctccatttgaaggcaagcaggaaacaaccggccttgggggctcaggggttacaaggcacaagtgaaccacttggaagtggccctggatcttcacttatttttgcatctgtgaccttcaccatgagactttgcagatcttcccactagaggtggaacatgcttccctgctcttgagttagggcttgcttctctgacttgatttgatcaatgagatgttagcacatgtgatgcaaacagaggcttgaaagctgcttgcatagttgggcctccccctttgcatttctgctgtcaccaccagaagagtgtccccttgctagctgctactcctccagctgggattgtggaaggaacacacatggagcaaacttgagcccggctcagacagaaaccaagcacagatggacccacagcttgaagcagacccagcctacatcagctgattggcatccatgctgctgacctatcagcacgagacatgcttatggtttcatacagcctaattttgggatgatttgttgtgacacattgttgtggaaatagctgactaatacagccttgattcttacacctgcctctcccccaaccctcatcccctattcccatcaggtactgagtaagggaatgggaggagatagttgaaggagttcaggttgtggctacagagtaggaaagtaccattagaccagtgaagggtctctgggaaatggaggggtgaactcatgaccagaagggcggtctctagtcagttgtggtagagttgccagtttccataagctggctgggaatgaatacaatttatagtgcactgtagaatccttgggtgtggcaacacaggtgaaatatgctaaggaggaatgtccaccaggcaagggggtatagctcacaggtagagcatttgactgcagatcaagaggtccccggttcaaatccggttactccctgctgccacttacctgtgggttctcttt

SEQ ID NO: 44659 - DNA, 1456 bp, Homo sapiens
agtgactgcaccacaaccaccatctccatctccagcacaccactccccaaccgcctcctgctgtcccttcaattccctctctggtgtcctgattccagcagtttccagtctttcaagacctgcaagccatcgatcttgccgccttttcactgccctctctcatttccctccatgcccaccattgtggtctccctttgcacacagccccagtgcccttgcccttgttttgttcattgtatccacctggtgaaatccatcagtgttctgtgcctgcagccaaacagctgcacgtggtgcagagaaccaggtaagctggctgctggtgtcacgtgacatccacgcccagcgacttcagtgggcgctctgccacgcagtcacactgtgtttccctagcctaggggccggccaactgtggctgagggccaaatttagctcatctgtttctgtatggcccacagctgcgattggttttatattttaaccccctttttttaattaaagagaaatacaccactcacttgcacagctctccccatgccatctgcctgcacctgtgcccccttctctgccttcagtcctgtgactgctaaactgtcgactctccagccaaagccccacttccacctggtgctgcatcccaccccatgccagcttctcaagggcaacacagtcaatcctaccttgacctctacccctacagccacggcctgcttctctgctccgcttcgtggcagagccccttgggtacatctgtgcttgctgtctcttgcctcttccctcccactcttttaccccttccgccaaaacctctccagcctcggttaccagggccctccgtggtgttaaatggtctgtcttcttacttggcctgttcgtaacacttgccatgttgctcactttcctctcacctgccacccaccttcactgctctttcttcgctggttcctgttgccctgtggagcctctcagccctagagcgcccttggttctcacacccgctctctacttgcatttcctcattcccatcgtctcccagggtcttggggccacacataccatctaggaatgtgtgcctcaaacctgggtttttgccccaaattccgcacatctagctgcttggcctgtatctccacctcagtgtctcataaactccccccaaacattcccagcgctgagctcctgtcttctctgaatagcctgctcctcccacattctccccaacccagtaaatggccgctccatccttccatttacaggcaaaaccccacgagtcctctctgacctcctcctccacatccgcatccactccaccagaaaccctactggccctccctgccaggtttgcccagagtctgtccacgcctcatcccctccactctgacacccaggcttatcgtctcttgctgaggttgttgccagcccctgccctgatcccccagagtctcatctcagccca

SEQ ID NO: 44660 - DNA, 1612 bp, Homo sapiens
ttgcaaagagtcagtcttgcttccgagaaccagtgtctatttatttattcatttatttatttttgagacggaatcttgctctgtcacccaggctggagtgcagtggcacgatctcagctcactggcaacctccgcctcctgggttcaagcatttctcctgcctcagcttcccgagtagctgggattacgggtacctgccatcgtgcccagctaatttttgtatttttgtagagacagggtttcacccccgatgttagccaggcaggtcttgaactcctgaccttaggccatctgcccgcctcggccacccaaagtgctgggattgcagatatgagccaccgcgtccaaactcaaccttaatttaagccagtagcagttgtagaacataaacccattggtcagccttatggttcagtatgattagaggcatacatttatttaaggtgaatctggttaccagatatcagtgtctcagatttccctggagccagtcagcacctttgaaagttaagggaaggacagatggacacaggagaaaaaccacatttctgaattggagacctgctggtcatttgaccacagagaccacatctctgcaaggctcgacccctgattcctccagaagacctgcccttgaccgtcccacctgctttggttttccctttcgtctgacactgagaaaggtggtggtccgcagaggccctcctgtgcgccacttgtgtgaaattaaatgcatcccccatgttcgtcatctatctcagtcagatttgcactttcctaagggcagaagcatgttccgggctggccgctttgccagtcgtcatcaggacattgacagtttagttctacagatgcatttttgagaatcttctaggtatcaaggacagtgctaagcgctggaggatgtaaagatggccgaggacagatacttttgggctggaaaagagggttacaacccatgcgcgtccagcttcttagcctgggtgggaggttctgggtgggtgggtttcgttgtatttacaccgtatgtggaggcttctctcacttccacggcatcattcaatgagagtaaagaggggctggaaatatgttggttgctggtaagaccctgtaacactctctagctgcatcgtatgatgttcagcagcatccgtggcctctacccaccagtagacaagatgagtagacacaaactccactgtccatcctgagcctgttggcagggatcctgtgtagcctttatccctgtcctgtttttccaaggagccgggaatcatggctcatcccttgccacatttggtctgacccatccccttgtgagacctcacctccccttctcctcacctcctgcacatccctccactgagccttgtgggacttagggctcagcagacccgccaggtcctgagtgttccctgctcagactgagctccaggggactgcagccctctgagtgcttgtcatcctcttccctgcctccatctgagcccaggcccaccagggacagggtcctcgcctctcatgattgcgtctctgccagcctcactccctctgtagagaccctgcctttgggtctcaggcctcgtcttttttgctgcttctgcagaccttc

SEQ ID NO: 44661 - DNA, 1130 bp, Homo sapiens
ttatgataggagtttgggtaacctgtgagaaacacagccacagtgtaaacctcttgagacaagctacactgatgggacaatcagggtgagggcaatccggcgccgtggctatgtcagctcatgtgtgctctttcaggaggacatgtctcacagacacagatcttcagctctgacatgctcgatctcacaagcccttttctgaaacctccatcatgtgctttctgattctctacaggcagaaggaacataaagtatgcattttatgatacgactcagcttggagggatgaagtagaaggtcctcactgcacctcatggcaggctgctgacggcagatattttaccgggctcactgaactgggcagtcagggaagggtcggctcctgctctgtccagctgtcttcataagggactctgtgacactttttataaaaatgactttgatttctgcataagaaggcttcccaagcttgctgtctagcagtggctgctacagggaattattcacatggcagcaagagagccctggctccctggaccaggacattccctttgtgtgtgttggaatgagagcaggaggagtgctggtcagaagcccctccccagggctctgggacttcagtgttctcagacaaactgggccgctcctctgagctgggatgctgacccacacttggccccggctctggcatccacaggacgctgccttatccgtcatctcgctggggctgggggctagaggctgagcaggtcacactgaacaaaagaagtgtgtccccatcactaggctaacatctgagtttcttccacagtatttggtaacacagtcagaaacaagactgaagatgattctggaggcaactgggaaccccccagaacgattctgcaggcttctgggaagctgaaaaaccccaaggccagactggcctcagaatgcctgagtccttttgattccactggaaaagccatccatctgtgccaagtgtgtggagagcttcaagagccatatagccctggccaccatgagcacagccacgtgggggagtagtcctgaaagtgtcctggtgtggcaaaggctttccactaagtggacctcagatggcacaggaagaccctcctggggatgtggga

SEQ ID NO: 44662 - DNA, 1329 bp, Homo sapiens
gtacagcgctgcccacagggaaggaagaagacatggcggggacatggcctgactcccgatgtgctccttcctgtagggtcttccacatggctgggctccctcccgtcccagcacacatcctgggtccatgtgaccttgaacttcacaaggtcaaatctgtgcagatccaaatggtgtgtggatctaattttcttcctcaagaagccttgcacaatctggccctgcatgcttcctctgagcccacacttcctgtgagcatacacttcctgtaagtgtatacttcctttgagcgtacacttcctgtgagcttacacttcccatgagcttacacttcttgtgagtgaacacctcctatgagcccacatttcctgtgagctcacacttcttgtgagtgtacacttcctataagtgtatacatcctgtgatcatacatttcctgtgagcatacacttcctgtgagcttacatgtcctgtgagtgtatacttcctgtgagtttacacttcctgtgagctctcacttcctgtgaacccacacttcctgtgagtgtacacttccggtgagcacacccttcctgtgagtgaacacttcctgtgagtgaacacttcctgtgagcccatacttcctctgtgtatacttccagtgagtgtatacttcctatgagcccatatttcctatgtgtttacctcctgtgagcccatacttcctctgtgtatacttccagtgagtgtatacttcctatgagcccatatttcctatgtgtttacctcctgtgagcccacacttcctatgtgtacacttcctttgagcccacattgtgagtgtacacttcctctgagcacacacttcctatctgtgcacttcctgtaagcctacacttcttgtgaatttatacttctatgagcccatagatcctatgtgtatacttcctgtgagcccacatttcctctgatggtatacttcctgtgagcacacacttcttatctatgcacttcctgtaagcccatacttcctgtgagctcacacttcctatgaggccacacttcctatctgtgcacttcctttgagcatacacttcctatctatgcacttcctaagagagcatgcttcccgtgagcccacatttcctatctgtgtacttcctgtgagcatacacttcctacctgtgcacttcctgtgagcatacacttcctatctgtaaacttcctgtgagcatacactttctgtgcacttcctctaaacacatacttcctctctgtgcaattcctgtgagcccacacttactatgatatacacttcctgtgagtatacacttcccatgagcccccctt

SEQ ID NO: 44663 - DNA, 1035 bp, Homo sapiens
ttaatcagatacctcaattagtcaagacctgtctcttttatcagaaagtgaatttagagaacaattctaaaacatagggtaatacaaattttttaaaagaaaaccaaattctaagctcagcttggtcccagggcaaattcactcctcattcttaattcttctccatttctggtcacgggaggggcacccccaaaatgctgaccctaggactccccaagatcctccagcatccaaaaggcctctcttctccagtctttactttctatgggaacaggttgaaacccctgggaatgaatacattctcaactaaaaatacaaattaaaagaatttcttgcttagactatcagaaacttgatctagtgcacatatttcccaagcatttcatttactagatctgattaagacactctgttattgtatcatttaaatttttaaattttattatttaaattttaaatacaagttttaaaggatggttacaaattagtaactcaaaataattgagtggaaagatcaaggtacaagacactctgcctttaccttcaaagtctgagcaaatatgattttatatctttttaattagagattcttttaaagaccaagttactgcagtcctgtcttgttcttctcctattttatattgatgtgctcagtaccttggtgtctttgtctgtcttttagggggaagggaatacacgttttggactagagtagcacagatgccattcttacctcactgtaggtttctttaaagaatgtttagtcctgacaatgcgatgcagatttctttctctccccactctatcttttgcagagctttatccctttttcattgttcagcataactgggaacctgccagctcgccacaatgacacataatgatttttgcaaagtgtgtgtcaaatgtcctgagcttagaagagattcatcgtagagactgctgcttaatgagtgtaaattaactgatcatttgctaaatctgatgtgcccagtggtgtggacgggagaatgctggataggatgtaggagatgc

SEQ ID NO: 44664 - DNA, 1049 bp, Homo sapiens
ctggtggttccatcagagcaacatgaaggaaagcaactgtcggaagccacaggccctcacttaatgtggtttgcagagtggtaagtgatggctcttcccacgtgtatggttgtctggcacagagagagccgggggacccacacgctcacgcagtccctgccagcaactgtgagacatgacgactgtgactttgcagaatccagggttcatccaccctcccgtgggtcctcctgctccccgttttgctgccatctcgggcccatatctgcaggttcagggaccctggagtagctgcacctcagcctcatgtcctctgtggtcccttaattgcccaaaagaaagaatttaaatgtaaagtcgctctgtgcagcgagcacgttccttcgtgccctgggcggcctctctgacagccctgactctggtctgtgacgctgggatcgtgactgctttcaggcaccgtcatggccttccatggtcctctgtctgcctttgtctccttccttctgtttaggatgccctttagtgggggaactcctggtctgccttctcctctaaatctgtgctctctaccaaggattttccaagcctgcgcttcctcctgtcatctcctttgctcctctccatggctccggctcctgttccgcagcccctggacctatatctgtgatcacacttagtgttttatacatcagttattcacttaagtgtcggccgtgcccaccagcccagaagactcaaggatgagtacttttccatacttacctttacacaagatagggtctcagtactcatcgcgattaatacatgaatgaacttcagcaaaataattgcaatgtgtaaaggccaagatccagaataaaacctttcatttcttagctaaaaatctccccacatccattagttttacatccttggcattaaagatcctaaggagaaattggtattcctgtctggaaaaacttgctgttgcttaatttatttaaaagtaagttatttttaaataaatatgaaaccccatctctactaaaaatacaaaaaattagctgggt

SEQ ID NO: 44665 - DNA, 1092 bp, Homo sapiens
tagctactctgcttgtattttttgtttccatccatcctcttacttgatacccctccatgttctaaaaacaaagcctcccttcacattttgagtgtgtctgctatggataatgaggcagcaatcctggttctaaagaattgggataaagcagtcactaaggatcccattaaaggtcaaaccatctaattcttaatctcacggcacctgcttgataatgatggatacttattaaactcattccttctgggtctcagaataccctttagaatgatccaatttttcatccaggcacttgaagttcattaaatgaatgctggagaaactgttttcccattgacatacttgctttaatgaaatgagaaagtaagaagtgcctgaatattggttgttgttctcaaacccaaggaaatctaggggtttgtggagatccagaatctcctctctcctcaccacttttatggcctttatctaattttacttttcagccacgtttgatgtagctgacttccatctcgaaacactctcttctgattttcccttcgattgcactatccactcctttttccatttcctcaaccggttctgtcttcccgcgtgacctctcagcattgaagtcttatctgcctgccctcttctggatgcattgtattcctggatgagcttctcaatgccctagtctcatatactggccatatgatgaggattcctggttttacatgtcaagccttatcttcgtaagtgaactgcaaactcagttttcaaagtgcccatctgaccactccactctgatgtctaacatgtcctcgctaacatgtggccagaagagagctcctcatccccacggccattgctcctccaccagtgttccatctcagtaaatggcaccaccaccaacccaggtggtcaagccacaagccctggggttgtcattcgttcactttccctttcacctcatttaaccattcagcaagcctcatcgatcccatctccaaaatatacccctaatccatgcagtacacccacctccccactggggctgcaccaatccagccccagccactgttgtctctcactggaatctctgaagtcact

SEQ ID NO: 44666 - DNA, 1060 bp, Homo sapiens
tcttcttctgtgtaaatattttataactatagcctattataaactatttgtttagaaaaaagactggaaaagtacacaccagaatgtagggtgtgtattttcccttcaaactcatttacctttgcagccctcttgaataatgtccttccaagccttttgaataacttttatgttgtcgaatgtttaaatcgtctccaatagtggtaatttttacagtctacaaacgacaaaaggtaattcaatgtcaagaacagttaataaaatagatattcagagtggttgatatggtgagatgaggttgggtttcaaagaaatggttgttctaaaaggaaaccaatcatgtgtatgtatgttatatgaatgttgagctctgtttggagttacccgcatcatgaaggtgccctcaaccatagcaatatcactaaaataaatgacaaggcaatttttttggaaggtaatattgtctctgaatttaaaaaatggaaaatctttatgcctctctctctctctctccattcaatgacactaatgactacttcaggatgtctgaatattgtacttgcttatatatgttcattgcaaccaccatggcaatgaaacatgacaggtcctatagtggaaatcatggcgtggtcctccaaggttaaattggagggaaaccccaccatgaaatgcagtggctagatgctagatcttcactccactccccactcaccagcgctgcttctggctttgggattgagcttccttctgggtgaagctcagaagagctcaaacttttctgagccaaggtcaagctgggaaccttgttttactctattttatttttaaatattcacttcccattatgtctgagtcttcagccacatcttgtttatctggtgaacgagtaaataacacacagtttctatgtcagtttcattcatcccatgttttattgagcacctgctgtaagccaggcattcacctggtgatcacttaaggcccatctccttgcttccagcttgcttccctataatagaggattttttattctctttgagtatgagggtgcacagca

SEQ ID NO: 44667 - DNA, 1026 bp, Homo sapiens
cgtagagtggggagagaataggagagagagactgatttctggtgtctcttccttttcttagaagaccttcctccagtcctgtcaaattagggccccacccctatgacctcaggtaaccgtgatgacctcttgaaaggccctatttccaattatagtacactgggagttagggctttaatgtatgaactggaggtagggggagcacagttcattcataataaagggtaatgtatacgttttgcccaaaggtccagagactttttattttttcagttttaaatacgagatatagacccatatttgttgacaaggaaaaatgttcatagtatattgttgaatgagaaaaatcaagtttatttattctttttctgtttctgttgtctgtcatttcctcctgtttgatgatggttattgttttaaaatagatacttggattcttggaaatgtctttggaaattcttgggaatttttatctgctttgtttcaatatttttccagatatttttttttttcggtcttttggagacaggatcttgctctgtcacccaggttggagtgcagtggcacaatcttggttcatgtagtcttcacctccgaggctcaagtggtcctacctcagcccccgagtagctgggatcacaggcatgtgccaccacacttggctgacttttaaattttttcatagaggtggggtctcccaatattgcccaggctggtctcaaactcctggactcaagtgatcctccctcctcagcctcctaaagtgctaggatgatgggcgtgagctaccacgcctgcccctggatatgtgtttttgtctgccatttgtttttcctcttttctctgtcccttttctttctctttgagtgtttttatatcactgttggctggcttctttgtgccccttactcgtctctgaatgagcagagttcttctggactaatggcgtgtgggtaggctggggaggtcctgggcagcgtctgggggaagctgtgatctgccctggactcttcccttgccgctgga

SEQ ID NO: 44668 - DNA, 1118 bp, Homo sapiens
attaaggtggggagacacaaagggaggatgtgaaagaggccttgaattgggcaaaaggacagcagtgaggtgtggctgtagcccaggaataaccagggaagcagataatttgttaaaatgtctcagcctaataagggaactgggcaggtggggataactaaaaaagtgcataaaagcatgttgtctaagttggcaccagagtgggggaattttaagaggttcagaagcttggccgtcaatacccacaacagctatgggggcaagggaaacaggcccttgaaaagaaggtaatgtggagtgggtagcctccatatcaattaaaaaggggacggacttaccctccactgtaaaagttacccgaagctcggcgtccatgatggtccagggggctttcccaggtgatcgggcagcatcagtcttcagccgcaaagccgagatctgagaagcagtcagccagagagctttgatccagagctccaggggccctagaagtggctgtgatattagttggacagtccgatttccagtggggtcccgcacaggtgggacacggcttaggaagaatcctgggctgtgggcatttcttggtctagtggccagttttgcggcacttgaatcaaggtccatgaggaggatttaaaggagtagctggaggctgtggtttggttgttctgaagtttttgtgtgctgaaggcatggctggggtttgtcttacagcaggcgcaagcagttgcagctctgaaatgcgttgccgcttggctgcctctttattgttgaacaccttgaaggcgaggttgattaattcctgttgtggggtttgagggccagattccaatttttgaagcttttttctaatgtcaggagctgactgggtgataaaacacatattgagaataagatggccttctggccctcgagggtctagggctgtaaagcgtctaagggtagccaccaagcgggccaagaactgggctgggttttcatctttaccttgagtggcttctttaagcttgtcataactaacagctttgtatgctgccttttttagcccttcaactaggcaagagaccatgtaatctcacctagctatacctgggaagcctgtctggtattccctt

SEQ ID NO: 44669 - DNA, 1047 bp, Homo sapiens
gcctgcctctccccttccctccctgcaggctgctgctggccccgggtcctgcctctcccccaaataattgaaaccacagcatttgtgttattgctttttcctttctctttcatttttttccttttcccttttatctcactctccagtctcattaccctccccataggcaaccgttcaaatgtacttactgtgaatgtgttgcttgcatatgttcttgcaaatgtgtattttgtctggatatatgcatatagatttaatttatgtaaatgatattgtgctatatgttgtattttggtgttcgcttttcttacttgggaatgtgctttaagtccagctgggttgctgttcgacatctagtctgtaggtgcgtattcagtggcatgcggccgccacgcttcacccacccactctcccggggagggaccccacaatgtctccaactcccagccactgtaaatgaggctgtagtgaatatccttggacatggtcccttctggacttgggtgaggatgtctgtgggatacacgcccgggagtggaattgctggatcgcgggacatgtggacacttaactaagtactgccatgcctgtcatcaccctccttctcagagctcgagattcccatacccgcatatcttggccactctcgacattatctacctttctaaattttgccaatctaataggtgacagtgatttcttgttgctttaatttgcattcctttgatttctgttgagtctgagcatctcttaggcctggtagcctcttgggcttactttcccgtgaattgcctgctcatgtcctttgctcattttaattttgacgtcgccgtcttttgtccttgttgatttgcaggagttgcttgtgtactctagagataccaatgcatactgttaaacattcagtgtattccagattttaattccttgttgaactggaaacagatattgcaaatatcttctcccattcagtctctcttcaatttatccaacaaagatacttaattttgatgcaaacaaattcattgatttttagctttgtttgta

SEQ ID NO: 44670 - DNA, 1028 bp, Homo sapiens
tttgtggactttatttaatttcataaattggctcctttcccacagtctggttgatgtggtggtcaagtggctctacagggcccatgggctggaggtgtctctggtctgttactgccggccgcaatcctgcttctggctcaaagacagcaccttgctcttctactttaagaggccatgaccctcacccctcacccctggggcagggcagcactgtcgctgcacaccccttcctcccaccctcccttcctctgcccaggagggcctgatgtggtccctcagagtgaggggagcaaggatgggctccccaccagggtggagaggaaagggctgggcctctccttgtggttctccatatctcaggtggatcctcttgtcctttccctcatcatcccccccataccaaggcctgcaggctggcacaggagagccccaaagatatggttccatcaggaacaccccctcccactccctatttgtcagtttcccaatgtttggggtccagtgaaagagagggaagttgggcctgtggctggggcctggtgtgtccttactggcaggaagaggaagggagggctccgcctacccccacccccacccccaccgtctcaagcctggggcctttagctcttgtggggaggctgaggaggcagaacttgtttgtatggagacaggctgtgtgccgcacttggtcccaaatgtgggaaaggagtcaggatgtaaggcaggacacaggtgttcttgaaagtggagtcaccccgtcttctccctgcctcttcttgctgagctctgggcagagttttcttccagttatacctttattgctgactgtgattctgcacctcacacctaacccgggcttggaggatacctgtcctcccttctctctaagatgtcagtcggctaaactcactcacactgaggtgcaaatgactgataacctcttgctaccattctcccctagagattcatgggggttcaagggcccagctccacatttcagaagccacgtccagctggatgatggctgg

SEQ ID NO: 44671 - DNA, 1077 bp, Homo sapiens
agggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctggtgagtgggagcgcccagcatggaacccagcaccgtccagccgcggagcccgcgttccaccctctgtgccgccgccgcctcctgtgggagagggaggtggtcgggagagtgcacgccggtgccgcctgggctccagactgggcgcgaccactaacccggttaatgacctcgggcttaacttaaccccttcgctgctctgggcctgcgtttctccaccggtgaaatgaggtaatgccagccctgcctactcttcatgggcgtgtaaggagcatcagagatggtgcatgtggaattgctttgcaagtagtgctgcgctgagcgcactgaggattatgattgctgtttcaaaggcgtggaaggaggcagaggggcggggtggggaagaggcccagagcagtcacaaaggcttgctctgaccacaggccccctaaatgaggagtgaggtaagcagtaggtagcaggtctttctcccctttggagaaaacctcacccccttttttgggctgcccctcagggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagt

SEQ ID NO: 44672 - DNA, 1027 bp, Homo sapiens
tgaatatcctcagtcagggttgctgagtgtcagatgtatgcacatgtgaatggattgctaggaaaaaacaggagttctttgtgttcattttatgttatgttaaaatggtgagtctgtgacattttacatttttccagctggcaacataacatacatttaaaaacttcaacattaaaatggatgtctaatttatactttttgttttatagttttgaagtgattaaagttatccatggcaaattgttggatatggtggggaaagtacagtaagtagtaccattttatctgcttgttagagaaacttcttttaatagtatcttctgagcaatacaatctggcacttactggtttgtcttttttttcttacaaatagaatacctattatgttggttgggaataagaaagacctgcatatggaaaggtatgtagcttttataaagtcaaatctaagatgatttagtcactgaagtatcattttaattattgttctgatgtcaagaatatttttagctgtagcatttttatccgttcagaggtgttatggtcgtgtgcagcagaagcaaaagtggaatagaaatctcacattcctctagaaaagagagagcaaactttataggaaactacctttaggttatctgccactttgcataaagcaaattctaaaaagacatagtgctcatttatgcagcaagtggtttttgagtaccagggtttgggattacagtgaggagcaaaggaggcagatgtcccctgcccaggcagcttcatgtcagagaggaagagactctacagcctgcatgcaagagaattgagctttcaggctctttcacaatttcccctggccttgggtgcttacaacctagctgtaaaatagtcaattgttacagatacgggagtactggaaaataagatcatgttctctgagctggaaggtttgctggagcatggataatcccataaagcaatgtctattctgttccccagctcaggcgtaattaaaacactcctgtgttacattcttgatgct

SEQ ID NO: 44673 - DNA, 1030 bp, Homo sapiens
tcaccccctgatacctgtcctcttgacagaagaataggagttggggcttatatggaccaggggagcagtagaagtctctgttagggggtcgggggcatggcacagatgacgaggctcattagaaattagtagggaagggaagagccgcttgagtaggaaattgttttggattgttgggttttgtatctttcttttatagttgactatataatttattgcctaaaccaagacactttcagagttgtgggctgggggtgctaataataattatgttgggacaacagtgtaacttagaatgtcctgggcaaagaaatacagctgttctgtttattgtgggactctgacactatcaagacttcagtttgcttttgtatccttatttggaatctcctttaagctcctgaaaactggtgatgagaatgtaaattgataaatcactttcatgtaatgttactgtggaaacacgttttgtatcaggcaattcagggaaccagtatttcataactgtttggagtgtgggccctggggttacacttgcctggatttgaatcttggtttttgttgctaacccagtaaccttaaggaagcgaatgagggctgggcatggtggctcatgcccttaatcccaacactgtgggaggtggaaggatcacttgagcccaggagtttgaggttgcagtgagctgtgatagcaccactgcagtccagcctgggcaacacagcgagatcccatctctttacataaaagggtgaagaagtctttctgtgcctcagagctttatctataaatagtgataactggcattgttgcaggattgtcacattggggttaaagaggctgtgctctttctttgtagaccttcaatgctgctgaggcaagtgtgacgccagcatattaactgtgttgacaggctgcatggtggaagtgcacatgttcttaatacttggagagctgtctttgaaaagatttctctaaagaataaatttctttatactgactacttatcaagttggaatatgtgttcctctg

SEQ ID NO: 44674 - DNA, 1120 bp, Homo sapiens
ggcacgttttgccagactcatgtctagtcatcaaggtcaaaaaattcattgtctcctccttggtattccattccctggaaatctactcggtactgcaggatacctccaattccaccaaatcctttcacaaaccgagacccgtcttgcattttatctgtgatcatttccaacatagctccaaattttttatagttgttagcaaaccattccaacaggggcatgctctcgataagctcatgttcctgtccggtctctttgtctgtgaaatgagatttatccttttcttgctttggagttagagaattttctccttttctgtgccttggcaataaagaacatatctcattatatccagattttcatagaccattagaatttctacagctcccttttccaaagtctttagtgtatcttcaacgccaaaacagtactttcgcgtgtcctgggtgatttcatcaaagtatcgttctattgatttcttttcttgaatgaatttcacttcggagaggacttcagtagataactcagtagcttgattgaatccattttcaccaccataggatatatcaactaattttaaaactttcgattgtaacctctgatcaaacatatcagattgacttagttcaaagtcagcagatccagctaaaactagaccagccacattcactttgtccccagaaatagctgcacagcagtctctgctactttctgaacatagttatgtcgcttttccatttttaaacgggcaaaacgcctctactgtgtttctttgggagatccacagtgaatttgtgcaggacttctcttgtgtttccttggagtgtgccaaaaagtgcaccactaccatctattacaatgaatccaaacttgctgtcatctgaaagtagtgctgtaagagcccctttatggaatttgttgtcacacaatacaatgacgtattaattggtttgaaagattcaaagtcaacgttgactttcttttcctttccttcttctgttacagttgttccacagtaaacaaccagaccatctggaggtactttgttataaagtttgagcctttgttgtatagatgtaatggctcccaggactggatggcggtttactcctgccttaat

SEQ ID NO: 44675 - DNA, 1651 bp, Homo sapiens
ccagccacctcagcctcccagagttctgggatcacaggctgagccactgcacctgtattttgctggctttaaaatctcaatcacatttggcatttgtttgaaagagaacatttgggccaggcccccaaagattgaatcactgcaactgttggttgaagaggacagtttgtgagtgttatgtgttattcaaattaggtgttcattaagcatttgaataaatgctctactttgtaccagtcacaaaagctaggacagttataatccttgccctcaaggagcttcagtctagttgagagccacaggaacttgttcctgctactgagaataataattgttggtgcttttgaagcatttactgttatggggtacaatcttaatgcacatgtattaatagcctttaaactcgggtaggtgcagttgttacacctattttgcagataaggaaactgaagtacaaaaagtttatgtgacttgcccaatgtcaaactgttgttaagtgacaaagccaggattttgaactcaggcagtggctccagagcaggcagtctttaatcagctactacacgattgttacttaaatacagttgggataggtgtttgagagaaataatcaaaggcagggctaacttgatcatcaagtggggatgggggtggtgggagaattgtctttaaaggaaaggcagtgtggctcactgagtgaatgagaagggtgaggtgtgagtaatgagagaggtcgggactcatgtgtttgccaactgtccttcaagaacagttttgtctgctctgtgaaaagttttagactttttcctagaaactgtgggaagtgactgaagggttttaagcaacaaataagacgatgatctataccagggactggcagacttgttctgtaaaaggccagatagtaaatatctcaagctttgcagggcaggccatgtagcctctcttgcagctattctactttgcctttgtaggacggaagcagccacagacaatacatcaacgagtgggtgtggctgtgtgctagtaaaactttatttatggatataacacttgaacttcatctgattttcagtatcatgaaatactgtttctttttccaaccacttaaagatgaaaaaaacatttttagctcatagactgtacaaaaccaaaacaggctgtaggccaaatttggcccctggtctgtagtgtgctgatcctggcttccatcctcctgctgttctgtgaagtgggaggggtggtaagggagtagaaatgggaagaccagccaaggcgcagagtagatgagatgaagaggacgcacatgggagatttccttagagggagaatgggcaagaccaatgtggaagctgtgaagtagccttcagatttctcatgtgagtgcctgagtaggtcatgttgccattggctaaaatcagaaatgatggaacaggagcaagtttaaggggtggaccagatttatttatgcacctgccagatccacacactttccttgctttctggccacagaggccctagcgaccacccacacagggcacagttcccatggtcccgaagacaggtggctgtgcctacaagtagggttctgagggtttgctggccctgggtccttgtgtcacccaaggatttgaccaagcataccctcaca

SEQ ID NO: 44676 - DNA, 1035 bp, Homo sapiens
gagtataccacattttttctatgcatttgtcaattggatatgtgggtggtttcttttctttctttttttttttggctattattttttatttatttacttttctgaggcagggtcttgctctgttgcccaggctggagtgcagtggagctatcatggctcactgcagtgtcaacctcctggactcaagtgatcctcctgcctcagcttcccgagtagctaggactgcaggtgtgcgccatcacacccagctagtttttttatttttttgtagaggtgggaaccttgctttgttgcccaagctggtcttgaactcttgacctcaagcaatcctctggtctcagtctcccagtgttgggattacaggtgtgagacaccacttggagctctactttctggctactatgaataataatgttttgaacattcctgtacaagcttttatgtagacatgttttcatttctcttgggtacattcctaggagtggaattgctgggtcattatggttaactctgtgcttaatattttgaagaactgtcagattttttccagaacagctgcacaattttatattcccatcagcaatgtatgagggtttaattttctccacattctcgtcaacaattgttacactgcctttttcattttagccatcctattgggtgtgaagtggtatcataggatttgcaaataatttctcctgtctgtgggttgtccttttaccttctcgatggtgtccttcaaagcagaaagtttttaatttgaaggccgatatatctatttttctcctgccacttatgcttttggtgtcacatcttagaagccattgcctaatccaaggtcatatagatttactactatattttcttctagatattttatcctgttaactcttacattagatctgtgatctatttgtggttaatatttgtatatgatgtgagggagggatagaactttatacttttgcatgtggatatcaagttgccctagcttcttttgttaaaataatgttctttcttcattgaattcccttg

SEQ ID NO: 44677 - DNA, 1063 bp, Homo sapiens
gcgagggttccgaggctcccgtgattgcggaacggggtgactatctgtcatgggaagcttgtacctgcctgccgctcactggatgcactccccaactgcgctttccaccgcctgtgccagggtctgtgctctttgaccaagatcagccactgcatgcttactcatccttttaccacctctccgtcgagagccggggggaaattaagggctgaaagaagcttggctagagatgcggggtgcctagagtcgtaggggaactcttgtgcgatgcggtgctgaatccgaggggatgcataggtggcagctttaacagctgcagccaggaagtaaccatgaatcaaatggaggggttcaaagtcactaattgttcaaatatcaacatggaacctgggatccagcctttattggcagcctgaatccatgctcttgtctctgttctcttgatttcctcctctgcattttgaggagttgggaccgcgaggtgttctggctcttgggtgagccttccctagtcagtcaagtaagtacttattggcaactatttggaaatagtagtccctgaataatcacgttataggcaacaagtacctcggctacctgatttcaacccaagagaatgacctaaagatcttgactgatttacccttttcaaatgtcgaaatggtagctctagtctttggtgagcagggctagttttatcacttttttttttttttttttggctacagaagttccttatgtccagttgaaatccattctgttttatcttccctctattcagcgtcctcctgaggacggagatgtgacaggccaccccttagccttgtcctcacaaactgttgcttgttaaatactgtgctaacttagtctccggtgggatacagggtcacttttagtccctattttctgtcttcagtatttcatatttctgcaacctaccccacttctccatatttattttcaagcgtagtcatattaaacgattttggagaggttaagttgctcccaatcttgtatttgatttttttttttttttttttccgagacggagtttcgctcttgt

SEQ ID NO: 44678 - DNA, 1038 bp, Homo sapiens
gaatatcagctctgcctgttgtggatgagtcaggtttgtgtgtttggcgctgacaggcagaaataattgtttatctcagggtgcaattattgtaagatgacctggcacaggagatacgtggggaaaatgaaaacttgggtatggtgaataaattcagcaccaaggggcacgcaggatcgtaaaaaaagtttaattggtttattttcatatgtccattaaaatatgatttcatatctaagttttcatttaaaatagacaaggttatttatcagtgtttaacttttagtaattatgtcattaaaactgattttaaatgaatttctttttgtcccttaagacatttttctaacatatatttttcatttttaggaaaagttgtagatatttattccaaatttgatgtaattgtaagtattttaattttgttcaatctgtcacctagaatgcattttaaacattcatgtaatgtgtttttatgtttttatcttgtttcttaatttaataatttctaaccttttggggtgtgaggatattatcagaattttatagaccttctatagtaattgtacttttaatctgcattggtttagcaaccaattatatattagtagcattttataatttttcatctttacaatacatgcatattttatgcactgccacagcatgtgtatatattttaaatgttcttgtttccacgtaggaggcctgatttattcgcctctagacgcgtgcgcagtgcacacgtggactcatggctcctttgtcgggcgcatcccattgcttagtgattgggagccactgttctaaagaagaaaaggggactgacactttatagccccaaatgtgcacgccattttttgccacaatactgaccccacattaaacattcttctgcagctgcctcaaaccctttgcttcacactattatgttaaacataacagtcaccgagaaatatgctgatcggcattttggttgagtgggacccgctaaaatgaatgagagccccatgaagccatttggatccatggggctcc

SEQ ID NO: 44679 - DNA, 1050 bp, Homo sapiens
agccgggcatggtggcacatgcctgtcatcccagctactcgggaggctgaggtgagagaatcaattgagcccaggaagcagaggttgctgtgagccaagatggtgccactgcactccagcctgggcaacagagtgaaaccttgtctcaaaaaaaaaaggtatttttcttcctggactttgaaagtatgttttgtttctcctctttttcttcaggttaaaaaggccttctttgctttggtagccaacggtgtccgagcagcgccactgtgggagagtaaaaaacaaagttttgtaggtaagcagtgtgggcctgaggaaaatcgaaaatggaaaccttgaaagcagaaagcctaaagtattttaatagatgccggtttggaattcaacctagtaaacatgtttccaagttaaagaacattcttgctggcagggtgcagtggcccatgcccgtaatctcagcactttgggaggccaaggcagggagatcgcttgagcccagcagttcgaggccagcctgggcaacatagcaagacctcatctctacaaaaacatgcaaaaattagctactcaggaggctgaggtgggaggatcacttgagcccaggaggtcaaggccatgatcgctgcactgtactccagcctgggtgacagagcgagaccctgtcaaaaaaaaaaaaaaaattccttgcttttacatactgggtaagaaggtggacgtgctagtaaggtccaaacactgttgtcctttttttctttttttttttttttttgccgcctcattgagaactctacacactgttgtaacttttatggagcttttgttgttgttgttgttgaatttcttttaatttagcaactttttggctctctgaagagcttatgtgtctttaccagcccaatgaacaaaccccacgtaggacaccacagtcagatgtgagccagctgccccactttgggccacacatggcatatggcatccctgggccccgcactcatctcgctagtgcacacctttttgacagggcaaattagatgctgtaaacatgactga

SEQ ID NO: 44680 - DNA, 1048 bp, Homo sapiens
cagtgagcagctctgagacccccgagttgatctttaatattcttttcccattgttttttcaatttttcttttcattccactttttggaagattttttttttcctaacccttctagtgagatctgtgtaaaactgggacttgtgtgacttcagcgttcaaggccctgtcagatggctgcccattcattcataattaagagtgactgctaacagttggcatggacataccaagttcacaggtgggcttcttgcttggtgggcttcactgaagagcagtaagccagccatctttttcattggaggccccatgttcctatgtctgttttatttctggagcagtgcatttcctccagaaaacagtccttccatggcaatggtgggcaactgttcttctgaagtcgaaggagtactggggcttggaggggcatggaagatgagttcagggaggagggagtcatgcagctggcaagggaggcctgggcctggacggagaagagtctcgacgaccgtatttcagaagctggacccttcttgacgcagtagatatcagcgttaattttaaaagcttcacagtcaacttaattactgaaaatcagagtgaagctgtgtagaaagcagtgaggcatcagaggaaccagcttcccattctggggaacacagatgttctccttggtatagactgccagagtctcttagagcagctcgggcctgctcactattctaaaaacttacctatgaacattttatttcccatcttttcttatctaattatcacatttgctttgaaatgtgttgaaaatcctattaaaatgtaaactttaaaattaatcatagtttgagcaaattgcgtatcagttaaaaggaaagaaattttcaaaggtactcaagatccctgagcggtttcttcctgcaaattagaactagattgtgttagtcctctttgtatcctgtttattggttaattggaacaccctgtgccgtctataattatggagaattttccaagtatgattttaaattgctttataaacagctccatgcacgtgttc

SEQ ID NO: 44681 - DNA, 1033 bp, Homo sapiens
tagcgaaagcctgtctctaccaaaaatatgaaacttagccaggggtggtggtgtgcgcctgtaatcccagctacttgggaggctgaggcaggagaatcgcttgaacccgggagatagaggttgcagtgagccgagatcgtccactgcactccagcctgggcaacagagcgagactccatctcaaaaaaaaaaaaaaaatgcttgggactgctgccgggcacagtggctcacacctgtaagcactttgggaggccaagctgggcagatcacctgaggtcaggagttcaagaccagcctgaccaacgtggcgaaaccccatcactactaaaaatacaaaaattagccaggcgtggtggtgggtgcctgtaatcccagctgcttgggaggctgagtcaggagaatcacttgaacccagaagccagaggttgcagtgagcctagatcctaccactgcactccagcctgggtgacagaacgagactccatctcaaacatatataaaataaaaaccaaaatgctcgggactgggaatgtttcagatttagtattttttcagatttttgagtatttgcatcatacataccagttgagcattcctaattcaaaaatccaaaatctgaaatgctctgatgagcttttcccttgagtgtagtatggatgctcaaaaaaatttggattttggagcatttcagatttcaggttttcagatttgggatgctcaacctgtgtatatcactgttgttatttttggaaaacatgttcatgccttttattgctattacaaataataatttctgaaaacaaagtttaagttatttcaggcgttattgtagaagatactgcgtcaaccccaactgtctttcttccatctgcccagtcttagagtgccgcaggtagctcctgtttgcccccaggtcccattttcaccctgcctcacctgtctttctcaccagggaggctgagtgtgggacacatcggctgggctcccgtattctggggtcctgttgagcttagccagtgaggagcccccagag

SEQ ID NO: 44682 - DNA, 2039 bp, Homo sapiens
tcgggctgcggggtaccgggcgtccgcggaggggacgcgagccaggctcccagagcgcagccctgagcccggcatccacacggacgggcggcccttttgtccttactcgccgaactcgaattacagcaaggtgtcagggagcgctaattgtttgtgcttgtcaccatgcactcggaggcaaccccgaatcatacccacagtccagaccctttaatcatagactggtgcccttatctgcgcctgtgaagatatgaccggtagggtgtgtcttcttttttaatggggaaagttaaataggaaaacctgaagaggttattgaatcggtgttgagttcaggcgaccctctcactccgtcatttctgtcgcctctcctctcacttggttgttttttttccctctcctgtcttcttcttgtatcttacaggtaaataacttggatcttatttggaggctgttaacatttgaaaggcatgagctcgttctttggcaaaattaatatttaaaatggaatgtgacgagctttcaccaggatcttattttgaagctgttaacatttgaacgggatgagcttgctcttacgcaaaattaatatgtaaaatgaaatgtgatgagctcagagtcgggaaagaactttatataagatgcttgacaattcgaggacttgaaaaggcgttcacactgtcttgtgtgcttccattatttatttagcaacttctcttttttccaggagtattgatagaataaagctctcgaaacaaagaacgtgccatgtggatgctgtcccttgtgccaactttactttaatacctctgttcattcacagtcaggcaattacttaaataagcctgcacagccagcatggacgtgttaacccaatagaattagccgggtgcctgttatctttgagattcactgcagcatttcacaaacatgttagctggaagagaacgcgttcatagtcattgtcattaaaagtgtttgtctgtatttattggtaacaaatggtgcatttcagaattttaccggacttaatttgcatttcatcctacagaaaaataatccagggtcttcattcgaacccatctcactattcctcagttttattatattgcaggccaaatcttggccgctgtccacagggtggaatggtgtgcccgttccataagactttgaatgtctaaatcaccagggttttgtctcttatattagtaagaatgagagtcttttacagttacaatttttgcaaattagcagggaggcaagaagaactagagagcagcttctgttcgagaggaatcgctactacttatttagctgtgtgaccttggacaagttacttaacctctctgtgccttggttttctcatttctaaaatagagctaatatcaggtgttttgaggattaaatgagccaatccgtatcatggcatttaaaaacagtgtaaacccatagtgagtacttcataaatgttagttactattatcgcttaagtgccattaagcattgtactgaattcatgagctttttaagatttttattaatgaaacccaacacagagattcttctcaacacagatttggtgtcctgtcccttttcttcttcttacttgagatttattaatttaattatgcatttctctaagcagatatacactcttttttttcttttcattgtgtctgccaatgtaatgaatgtaaagtattaaacctaagtgtctaagagaggaatttcccctcttcacccatctatttttatctatattgctgtcattcctttaaagcacaccgaatcccacgaataaccctgtcaaacttttctagattcttaaggaggcagaatgttaaacagtgactttgaggctgagctgagctggaagaaagaacagtgttggcgtggtagtccaaatgcagctttgtttcttttgaactttaaattgcttattcatccaaaatacaggaaaattgaatatcaagcagaatctcacacttatttagcagggacaaaagtcccagcagtaagacattacacctctaaatatc

SEQ ID NO: 44683 - DNA, 1048 bp, Homo sapiens
ctgctaatgggtacaagctgtctctttgggatgatgaaaatgtaaacttagatagttgcacaattctgaatattccaaaaatcactgggctgcacactttaaatgggtgagttattttatggtatgtgaattatatttcagtaaagatttttttggctgggcgcggtggctcatgcctgtaatcccagcactttgggagtctgaggcgggtggatcacgaggtcaggagatcgagaccatcttggctaacacggtgaaacccagtctctactaaaaaaaatacaaaaaattagcctgtagtcctagctactccggaggctaaggcaggagaatggcgtgaacccgggaggtggagctggcagtgagctgagatggcaccactgcactccagcctgggggacaaagcgagactccgtctcaaaaaaaaaaaaaaaaaaatttattgtcatttcctccacagaattaaatcagcttggcctgactcatagggaaaaatacagggtgatatcacaagcaggatattgacattgatacagtcaagatgtagaacagttcggtcaccacaaggatctcttacattatcctcttatagccataggcacctctggccccctaccccagcccctgatccccggcatccactaatctgttctccatttcgaccattttatttcaagactataatataaatggaatcatacagtatatgacgttttaggactggctttttccccctcagcataattccctggagatctatccaagttgttgtatgtgtcagtagttccttcctttttcttgctgagtagtattttacggtatagatggacctaccacagcccgcttcaccattcatccattgaacgacatctgttatttcgtttgcactgttgcaaaaaagctgctatgaatattcatgtacaagtttttgtgtaaatgtaagttttcatttccctgggataaatgcccaagagtgtaactgatgtgttacatggtagttgcatgtttagttttataaaaaactgccaaattgtttttaagagtggtg

SEQ ID NO: 44684 - DNA, 1052 bp, Homo sapiens
actgagagccttagttcattgacatgggcctctcccgcatggcagcttgcttcaccaaagccagcaagatagtgatctgctagaaagacaagccacagtcttatgtatatagacagaagcttaataatggaagtggtgtcccatcacctgtgctgaatactgttggctagaagtaagtcactaggtcctgctcacactcaagaagagggatacacaagtacatgaatgccaggaggtggggatcatgcattgggggccatctcagagtctgcttgccatattcatacaactcaataagaacaaaaactctaataaataaatagacaaaagatgtgtacagtcacttcacaaaagaaaacacattaattaccaataaacacaaaaagatattgtcctcaaggaaatgcaaattaaactcacagcaagaaacctatacacccactagaatgactaaaatgataaaaaatgttaagagaccataccaagcattgatgaggacatgaagcaactggaactctcaaccactttgggcagaaatgtaaaatggtacagccagtctgtgaaatgggtggtttctcatattaaacacacacctaccaaatgactcagccattctactccttggtatttgcccaagagaaatgaaagcatgttcctacaaagacttgaccacacatgttcacagctttattcccaatggtcaaaaagtgaaaatatcccacatgtccatcaactggtgaatgaatagacaaaatggggtctatccatagaatgggatgctacttagcaatagaaatgaacaaactactggtatactgagcgacatgaatgaatggcaaaataattatgctaagtgaaataatccaggagcaaaagcacatatactgtatgattccatatacacaaaattctaggaaatatttatagtgacatagtgataaaaagtagatcagtggttgccttgaagaaggggtgaaccacaaaggagcatgagcaaacttttggagtgataaaaaaattttctctatattttatttttttaattttctctt

SEQ ID NO: 44685 - DNA, 1048 bp, Homo sapiens
cacacaccagttttcccaaagcagggggcatgaggaccacggtgggatgcaagatgctttcaggcggtacaaggatgaacgttttcatagcgacatttttgtatatcatggaaaaatatatctgaaacagcaaaacctatgatttcatggaattgttgcctaagggaagacttgggggtttaagtcaatttaaataactgtgtaggttgtatggggatatgatagaatgacacctgtccaaagtttgggaggcatagctgatgaatcaaaaatctctgtcattcttcctcagcatgatccacaccacccacccctcctctccgccaaatgacactggaagctactctagttacacaccaaaggtacttttttggacagccttgtaatagctgaagtttaacagattgattgcagcattccccctttattacctcacacaggcccattcaatccctgttccctgacattcccaatctctttcctatttacttcctaatccacaaagtcgaaactgttcttatctctgcagtacctctgacctgctcgcttaatttttacattcattgtaaagacgtcttcaatgtccccgctgactccaggctctcctgcagccaaccctctctactgtatgcagatattaggatttttttatattgccaaaaacgatttgagattatctacattcacttcttacatgcaatcctaagaaatccaattccattcctttcactcccagtggtctccaatctttctttcacttctctacaagaatgttctactctcagataaagaccatcagcacatcctgaccttcaggctcttcctctgccacagccgccacccgaatgtccacctttccttgctcccttcaaaatctgcctctgcacatctctgtaggaagccttcctctcaaaggtttccttagcatttgtgcccacaatgcagtcgctatagctttttattatttaaattactttgtaattttttacagtgtgacatatgcagaaatctgatttccccaattataactgtcacctaattagaatat

SEQ ID NO: 44686 - DNA, 1022 bp, Homo sapiens
cacaccctgacatgggatctgtacacctcctccatcacccgagacacagcccagccacctggggcgcctgggaaacccagaggagggcggcttctgggtgatggtgccaaacccagtcggtggcaggccaccaacactggacctgtgtccccatgtctagagttagcaccaggctgtggctaggaagagtcctggggtccaaagatttctaaattgtagaacttgcatctgagttgagacaggctagcggctctcaggaacctgcatatccgagagtaaccctaacaagtagtttaaacacttctgtgatggagagcctgttctcttcctcgttccttcaacacatttgataaatatctacaggttgcttaactttcctgtgcctcagtttcaccatccataaaatggggataatattgctgtcctccttggtggatggagattaaaggaagcaatagatttaaagtgttgaaatatattaacctatttgaatattaactctttgactattttctgaagtgcatacactaaagtgcttagtcatcactggtactgtgatgcctattactgttactactaagcctagcactgttagtgctctaagcttagcactcttagtactctaagcctagtactcttagtactctaagcttagcaccctcagtactctagcctagcactattagtactctcagcctagcatcctcagtactctaagcctagcaccctcagtactctaaacctagcactcagtactctcagcctagcactcagtactctcagcctagcactcttcatactctcagcctagtactcttagcactttaagcctagcactgttgatcctctaagcctagcaccctcagttctctaagcctagcaccctcagtactctcagcttagcactgtttagtactctcagcctagcactcagcactctcagcctagtactgttgatactctaggcctagcactgttagtactctaagtctagcactctcagtactctaagcctagcactc

SEQ ID NO: 44687 - DNA, 1042 bp, Homo sapiens
cttccttccttgcttcccttccttccttcctttcttcccttctttccttcctttccttccttcccttcccttcccttcccttccctccctccctccctccctccctccctccctccctccctccctctctctctctctctctctctctctctctttctttctttctttctttctttctttctttctttctttcattcatttagagacagggtctctgtcatccaggccagagtacagtggcagaatcactgcagagcctcaacttcccaggctcaagcgatcctcctgccctttgcccgcaataggtggaactgcagatgcacaccaccatgcctggttaattttttaactttttgtagaaattgggtctcagtgtattgcccaggctagtctcaagctcctgtactcaagcgatcctcccacctcagcctcccaaagtgctgggatttaggtgtgaaccaccacacctggctcttggtcacaccaaaataatttccgtgtggaactaaactttaagtgttttaagtaatgtacctccaaaacatttgaatatctaaatcttgggatgtcaggcctttctagaaggtgcaaaaaatatgtttgtttgtgatataaatatccacagcctttcttgccttctctcaaagtttgcaggcttgattctcagagctttgctatattgatgaggtagaggagagctggatgcattcctgttagaaagaatgaagaatgtctaagagagaaatgcataacgggggtccaggtgagtgaagggaagattctagaaggtgagttttggttggagaagattttggagagtttgggagcgtcataccagagattgaagcccagttcttgtgctgtgtaggatggtgggagagggatagaagagatgaccccctgaaaggggcattatgtgtgttgggaatataagcacaccgctggctcccaggcagcctctccagacacctcttcagatttcctgaaaggactcaccttagtagaaaggccttcctttgacaccctgggtaaagtagtagca

SEQ ID NO: 44688 - DNA, 1056 bp, Homo sapiens
gtgaaaatccagcccccagatgccgggagagggaccctgagggagcggcagactctggggctaatggcaagaattattcctggtggctccgatgagctggggttgccgttggtgtttgggaagagctctgatctcctaggtggggcctttcccgcccccgcagtgttttgggaaatgcggctcccactacctgccgccctcagcatttaggtgacttggcagccacctccccttgtgaggatgacgaggttgggaagggaggcaggcatctgaaaacggcagccaccgcctttcccttcccagcgcctcccccacgagtcagtcctgatgctgccagggcccagacttccaagtggggccaccaccgcttcctccctcctcaacaatagttaggctggtggttctcaaacttgagcaagctctggggtcacctggaggctgggccccaccgccgagttttccgttcagtaggtctgaggcgggttcatgaatgtgcttttctagcaagttcctaggttgacaaggacgctgctggtccgggaaccacgctctgaggaccactgggccaggagttgaagagagccggagccctcttgcagctcaaggttctgatcagctcattagcccaagattcattttctccactaacaacgtcttcacctgagaaggaaatgagtcccatcctggctcaagcaggccacagacgaggagaagaggctgtcggggtgaagagggccatttttgtcgctgccaggagagggatgccgagcagtgatcctgccaggaaagggaactgtggggttgagatgtggggggcagctgggaacaggggcaggtggggagggacagatgtctcccagcacccttgtgcggggcggaggctgcctgccgccatccctggagctccgcatacactcttttcaacagcaccgagaagaggagctgtgacgtccccgtgtcccagggaggtttgccgggctggggagcacagaattcatctgccagactcagacccaggcggtctagcccaagagggaatatatgtatgtgacaaca

SEQ ID NO: 44689 - DNA, 1030 bp, Homo sapiens
agtaaaaatgtccaatttttaaaatttcagaaaatagcatattcaaaaatgatttgagttcaagtgaaacttaagtatggcttctaataagacccgagggtgaaacctttgtatgaaaaacagaaaaaagacttgttgtcacataaattggaagtatgtacacacttttttttaggggctgggcctgtatgctgctcgagacattgagaaacacaccatggtcattgagtacatcgggactatcattcgaaacgaagtagccaacaggaaagagaagctttatgagtctcaggtaggtgtctggtccccgagattgtatacacagcaccatcatcctctccctttctccgtgccagccagacaccctggaaggcagaatgaaatctgtcatgctgcattcagctttaaacaaaagccatatctgtatattagtgtatttttatcagttgtatctctttcaattggtgttacagtttactttgatagacaactgtaaattaatgagcctggcttcacacacaacctactgattccatgctttccattcgtgccatgtaaatgtcatctgtgcctaatagaatatccacagtaaggatgatcaggctgccgttccgttcagtttcgactgagtcctcctggtgtggataggaacacagaggggagtttcaggtcgacattgatgacttactgactgacttttccctcagaaccgtggtgtgtacatgttccgcatggataacgaccatgtgattgacgcgacgctcacaggagggcccgcaaggtgagacagcgaggaacctgacggggagtgcttttgcttgtggggccagtgctggtggagagaacactgaagccaagggaaaggctctcacggcagcctggcggtgactaaacattcagagcaaatgagttgagaatttttatttaaatgttatatttgtgcttctaacaatgggcaaatagaaatttaattagcaaaaactgctttatcaataaatgggaagtttttaaagctgcttctagctgtttt

SEQ ID NO: 44690 - DNA, 1034 bp, Homo sapiens
aggcatgagcccccgtggctggcatgaattttttttttttttttttttgagacagagtcttcctctgtcacccaggctggagtgcagtggcacgatctcggctcactgcaacctctgcctcccaggttcaagcgattcttctgcctcagcctcccaagtaactgggactacaggtgtgtactaccatgcccggctaattttttttttttttttaagtagagatgggatttcaccatattggccaggctggtcctcaaactcctgaccttgtgacccgcccacctctgcctcccaaagtgctggtattacaggtgtgagccaccgcacctggcctttttcttctaaccccacgaaatcttgactataaactgaattttaataccagttactactgtacgttagattttcatacatgcagggatctatttctcttttctgagatggagtctcactctgtcacccagactggagtgcagtggtgccatcttggctcccagattaaagcgattctcatgcctcagcctctggagtctcactctgttgcccaggctggagtgcagtggcatgatctcagctcactgcaacctctgcctctggggctcaagcaattctcttggctcagcctccctagtagctggaattacaggcacacgccaccatgcccagctaatttttgtatttttagtagagacggggtttcaccatgttggccaggctggtcttgaactcctgacctcaagggatctgcctgccttggcttcccaaagtggtgggattataggcatgagtcaccacgcctggcccatttggaatctcttcatttccactgatcttgtttattcttaaaccacactctattgatctccatacatactttttgtgtgttctggttcattcacttgtgagttgtatctggagtagaacagataatcaaagatgcttgttcagaggataaatcagttcacatactaaagtctctcacatggcccttcccaccatgtgctcccggatgtgcttcatgaggatgcagctgg

SEQ ID NO: 44691 - DNA, 1124 bp, Homo sapiens
actagaagcagcagtgtcacctgggagcttgttaggatgtgcaggttcgggggccccagcccagcctcactgaatccagctctggaggtggggcctcctggatgattctcatgcatgtcagagagtaatttctgtcttatatcctttctccccttctgttctttgtttccttgtctctctgttctttctgagacttcctctactttatctgctaatctttcttgtctatttttagagattagctacgagccctttctgctcttgatcttgtttgatattttgtttttacattatgagtggagtatctgtgttttctctgctgttgcccctctctgttgagcctctctcggattctgtgggtgaattagtgctttgcctctactccttccagttctagctttcccctgctaagtcaattacttttcattttaaatagtccattcactcttatacccattcgtgttctcgaggagtgtgcttttactgtgattttagtgggtatcttaactgtgttcaacctgtcacctttaacctgaagcatttttgagagctctggtttctgtctctttacttatttcatcctgccaccctcccatctgtccacctccctggggatcccgtggatgatctaatatgtatcctgtttttctgtgctaatatcttagaactatatacacttttatgtacatatataaaaatggaatcatgttatatttatttttctccgtcttccttttctctgtaataatcagaggtccctctcgatcaactgacgtagcttcatttcattcttttgaatggttacctgatgttccatagtgttgatgaactgcagttaaaccattgcattactgatgagtgtgtatttgatttataatttttctcataacaaacagtgttgctatatcttgtacaaatatcacaatgaattaatagtttcactcctatggggtatattcccaaacgtgaggtttctgtgtaaaagcgtgtgtacttttcatttaaatagatattgccagttttctaaaaagtctcttactgcacacttcttcctgcagcatgtgagactgttttcttgtttcccatttgtagctggtgttactatttttttgtttagttggtct

SEQ ID NO: 44692 - DNA, 1031 bp, Homo sapiens
tccttatttaccttcttatccttggccttggctctttcctcatttctgactctgcaagtcacacttatttaagactcttatacatatgtcattgtatctttcataaaatgtttttttaccatcttaacctgcaagcaaaagtaatatctgtttccctctctgtcttactttgtacttagactgaatagtaatctctcttggtgacttagttttattagattcttcttttatactgccattgctttcccagctatttgagaataggcatgtttctttatttttgccctagtgtcagataatcgactctgtaaccattgcttagaagataaattttttttattaattaaagaataatgttaatgaaccatgttgtaatgagttgatactgcataatttttcaccatgtgccaccttgtgtcatcagtcagttttaattactaacaaaagttgattgcctttaggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggtactttgctactccttttatgaccccacctcctacctccagcgaaaatgtccttggcagtgtctcttccaacatcagagagagacaccacttatggtggtgtgatggacacatgttcctggtgatggcaccagcgtatatcagatgtgcttgggctgaacaccaaagagctacaacaggctgttaaagggaatattatgaggactacgtatttttaaatagagtgaaccgtggaccacatagtttggttttatacatgtattttttccctagctaaattatcacatgctaaatattggaacatagtttcctttctactattaagataaagaaccactgtcacttttgaatataacataaaaataatgtatagatcctgtttttattaaattttgacttgttgagattcccacacatttctctttgcttt

SEQ ID NO: 44693 - DNA, 1016 bp, Homo sapiens
tctcagctccctgcaatctctgcctcccaaattcaagcaattctagtgcctcaacctaccaagtagctgggactacaggcatgcaccaccacaccctgaggtcaaggctgcagtgagcatgattgtgccattgccctctacctctagcttgggtgacagagcaagtctctgtctccaaaaagaaaaaaaaaaaactatcttaactcataagctgttctccaaccttattttatcatcctcatgaaattctttatctttgcaaaatttgtaatttgactttgcacttgatttgcatggtgttattggtagattccaagtctctccttgagagactaatcagtaaatgacaaattggtgataactgttaagctgggagaggtgtctgaagaggaactacattaatgatttagttactttagtagtagcattagtactgttgcttcttttaaaggtcttagtcaatccagattctcatatctcggatgtgagttgtattacaagtttaagaccagaaattcttaagtttttcatagaactagggcatatcttaatgagaacttaaaggatattttgataatattttgcaatttcttgattgcattttaaagttatccttcactagctataaccacgaaacttgaagaattgcataaataaaatcaggtagaaaggaaattagcttcttaatttcagagcttaagtagtcaagctgggtaaagtaagcaagttggtatgtccataaaatcacgagtatctgttccactaagaagcctcctggccttgtaggtattgttttcttggtgtgcaagatacatcttgattacatttctgtagccttgcttctatgtgcaaaaaattcacagaactacgttttagcaaggtcattgcatattcgctcagtagcatataatttaaattttttggtctcctgcagcagaataatttaagtaatcctccaacaccccctgcctctcttcctcctacaccacctcctatggcttgtcagaagatggcca

SEQ ID NO: 44694 - DNA, 1049 bp, Homo sapiens
atcctattggcatctgaaatttacggtaatacaaatggattgataggtgatagtcaagattttcttatgttcataaggagtagcctcagtaccaagaaaaaaatctgtcctcagtactttgttgtgactctgaatccaaagaaacacattgtgaattctgttctacacctttgtggttgttacagaaggtgggagacagttgctaacagtgctgttggtggtacccagcctcagttgatgccccagtttttgctgagcatagataagaaatatgtttttcttgttagatgcctggcagcattcatttagtacagagcttatttttaagtctcaaaggtctgtagtctctctcacttactccagcattttgatacttgaaaattttaagtctcatttttctgaagccttattcaacaaagttgcttcgggtcttagaaagttgagctacactgagttccttttatcatgtacattactcttaaatgtgttttttaatagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaaggtatgtttctctgccaaggtgttgtcttgcttcatctttgggtaacatgtcagaattgatagagcttgtcttatttttgtatttagtttacatctactcttccaagttttattaaaacttaagttcagctacagggttaaaattttacctggtgaagtatttctagcataaacatttgaagttgtttttataggtaagaatacaaattgcaagaaatatctattatgtacttccatggtagtggaaatccttatttccttataacctttattaacacttaaaatgaattcaaaaatcattgtaaatggtggggatttaaaaaaagtagtagtttaccttgaaaaatgaaattaaacaattttaagtatatctaataatttaggtat

SEQ ID NO: 44695 - DNA, 1027 bp, Homo sapiens
aataaactagttgagaagcagaacccagctgaaggactggtaagtgtaaatcataaaaacgacaacttttttcttttgttttaaattatacttacagcagattagtaccagcaactgtatttccacattattctacaacctttttattctaaaggaccattttttattttgtcatttctacctctctggaacccatgtttttacttatatctaaactatattaaataataatttgtttactattttttaaaaagcaaaggcatgtattgcatttcatatataacgtgatgtgtagcaactggttattaccacattgagttgatatgactaaagcaaagtaagtaaatgtctatgtactttattgtaaataagtgattaatttccattaacctctttaaaatgcagaggatagcccatgcacccctattaatacccttggcactcttagggataccacactgggaagctattgtgtggttacagtgttgtattgatacttaatgtaatgttacatgtagatactgttttgtagttttccatgtatcaattttctatcagttttaagttattaacatttaatttgctttttttttcatttacatgaagagctaacttgtaaatatacctttacaagaatctgtcccctttatttcagttaacttcattaagatagttccaaaactggagtttgagtcatgggaattggtctgcttaatagctcttgcctgtttatctttcagaaggtgcagtgccattaccagtgcattcataaagctgtccctagagagcttctcaaattggatttcattttcatattttaattaagggttgagtggtatatttagttgtccagttttttcattttaagattgttaatgaagctcatctttttgcaagtgttgctttttttcttgtctttgaccattcagtagagattgagtgttgacttgatagatttgtgtaatttttgtaaattttactggttatgcttttacagttgtcaccagtaaatataggcaactctcca

SEQ ID NO: 44696 - DNA, 1036 bp, Homo sapiens
tcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattggtaggagttttcttgagtctcaacgtatattactatgggtattagagtggcatgcgatatgcttataagattttattattagaattacagttggaataaagcactgagtttttctattcctccttgaggagtttgtttgttttgttttgagacggagtctcactgtgtcacccaagatggagtgcagtggcgcgatctcggctcacagcaacctccacctcctgggttcaagtgattctcctgcctcagcctcccgagtagctgggactacagacacgtgccaccatgcctggccaatttttgtatttttagtagaggtgcggggtttcaccatgttggccaggctggtctcaaactcctgacctcaggtgatccgcctgctttggcctcccaaagtgctgggattacaggcgtgagccaccctgcttggccctccttgagctttagaatgaaagcagttggctgggcacagtggctca

SEQ ID NO: 44697 - DNA, 1086 bp, Homo sapiens
atatgctgttttcccaaaagatcagcgtggaccctatcctcctgatgttgctagtatggggatgagacctcatggatttaggtaatgcttttaatttcctgccgaatttaaattgctattagaagagggaaacagagctgggtgtggtggcttgtgcctgtaatcctagctactagctgaggcaggaggattgcttgaggctaggagtttgagaccagcctgggcaatatagtgagaccacccccccccccccccaacctcttcaacaaatttaaaaattttttaaaagaaatagacaaatgaagttagtattaatcaggaagctgttactgctttctacttctttctcccctttgaaatatatataatctgctatttagtgctaatgagaggtcatagacatttttttcctctaagaactctacagactctgaaaacattacctttgtttttaagtattaactgtgttagcattaccttgcacccttaatgatgcagtttatcatatgacatcctcaaaatgtagctattctgcgtaggcaaagcctcctacgatgtgatgagacttgtcctctctccaaatttctaccttttaactttacattctaaattaattttaggctgggcgcagtggctcaggcctgtaatcccaatactttgggaggccgaggtgggcggatcacttgaggtcaggagttcgagaccaacctggccaacatggtaaaaccctgcctctagtaaaaatacaaaaattggccggctatggcggcaggcactgcacctgtattcgcggctactcaggaggctgagacaaaaggatcacttgaacccaggaggtggaggttgcagtgagccgaggtcacgccactgcactccagcctgggagacagaacgagactctgtctcaatttaaaaaataataataataaattttagagatttccgaactgaaaggactttccctttaggaactttccatggtgagatagggttgtaagttagtggtgatgaatcataagaatgtttcctttttcaaagtggctaaagtcaaagccaaacctatgccctagttataataaggaaata

SEQ ID NO: 44698 - DNA, 1044 bp, Homo sapiens
tgtcccttgaatctaaaaacttcccaactttacaagctacgttgttaataaggcagcacttcatttagaaaacgtttgtttggcctacagtgtgccacgatctttgttctttgtaaaaaacttaatataggtctatgacctcatgagaatacggcctgaataagattaactgtcagcagttcatcaacattctttattacaacacatcattagcatggctctgagaaagtgttatactctgttcttttgttgcagattggactactagagtgaagcaaattgccaaattgtggagaaaagcaagctcacaagaaagagcaccatatgtggtattttaagaaactcctctatcttttaaatatttaaatacagtgcttgaaccttatttgtattaggttaataaaaaacaaatttccatttcagaaaatgcttgttagtacctgtacaacaagcaactttatttttaaagtgattttctaactccttatgtcttaatagagagtgtgacatttttataagcaagttaatagaaccaaaacgttgaagattgaaaatcagctgttttaggggggaaggagtaattcatttcactttaaaattgttttatctcttcagcagaggtacagttggccgtctgtatccatgagttctatatctgtggattcaaccaaccatggatcaaaaatattttggaaaaacatctatactgaacttgtacagactctttcccttgtcattgtttttaaaacaatgtaacaacgatttacatagcatttatattgtgttaagtattacaagtaatctaaagatgacttaaagtatacaggaggggccaggcacagtgacccacacctgtaatcccagcagtttgagaggccaaggtgggcagatggctttgagcccaggagttcaagaccagcctgggcaacatagccaaaacctcatctctataaaaaatgaaaaaattagctgggtatgatggcgcatgcctgtagtctcagctacttgagagacttgagaggttgaggcttcagtgagccagaa

SEQ ID NO: 44699 - DNA, 1096 bp, Homo sapiens
tcttttgaccatcttttgaccgcccgcctcagcctcctaaagttttatgattataggtgtgagccactgtgcccgcccaagactaaagatttttaatttaggcctttttgagggtttaggaatcccttgaaattagatggagaattattgccttcatctatgccgtttcttatgaagggtttctgaatcttctaatagattataaaaaatatctaacacattctgttctccttaaaccactttttcttaaagctctagatactagatatctagatattagatagcaccttctgccctccctacgtaattatgtggaatttcataatcaagaatgtttccttgctttcattggtatattgttgtactctttagaagttaagaagtgaacatatattattaatagtattattttatcagtagtacagtattcttgggactctggctactaattatttgttccattgcaagacaactttttacttaatttcccgattaccattcaacatcgctttccgtgagatatgtctacttcaagttagatgcattacctggagcacatacctgctagcactgccatttgcagttttctgaatacctttgtgtttgccctaactagcttcctttctgtctttgaaatatttaatatatgatgataaaataattagcttccttatgtaatgtgctttgcttcctctctaatagttgttctcattcctttttatttccttcttagctgtatgaaagtttttctgttaatagagatagttaggagaaaagggcaaggtaggaggagcatgtgaggcttagggcttttaagtttgaagactcagtgttacaggttttaaaaggtagcagttctcagtatattccattttttaaaaaaaatgtacaaatatggtctttttagatggatgcatgcagtttgtcagaacttaaatactgaggaagaagtggaaaatgtagcagacattggttttgattgtagcatgtgcagaccctatatgcctgcgtctaatggtaagagaataatttaaactgtgagtctgcactcttgtaccactcacttgcaccttactgtccataaccaatgaattag

SEQ ID NO: 44700 - DNA, 1047 bp, Homo sapiens
ctgtagtcctagttactcaggaggctgagccaggagaattatttgaacatgggaggcggaggttttagtgagctgagatcacaccactgcactccagcctaggcaacagagcagagcaagactccatctcaaaaaaaaaaaaaaaaaaaaaaaaaaggccttgtaatgaacaaccaactcttgtcttactctacctccacgtctgaggcagtcgcttttaatcttttcaggtctttttttcttgtggttaatgctatagctctaaataatcaactggtttactgctttatcaatgctagattttgttgactttctgctatgaataaataaattctgatttaggtcttaaaatacacctccatccttctcccaatatagttgtattactatgtttagttcaattaataaggtgttggttatgactcagtaaatgttcactgcaggtctaaacagtatactatgagtttcttttgtctttcatggagttttttataacaagaaagtaatagtgactctccattcgttctttgtttttgcctactctagaactatcatataagattagtttttaaagtactgtttttttctgggagaagtcctaccctccttctagacattcccttctcctgctctgatatgtgccagtggcttctaggtatgttgttctcatccttaaacttcctggcctgatgtcctttgttggatctgttgatttatagatcccaagtcttcctattctttataatacatcctcattctgttccgcatatctctaagtaactttattagaaaggagaatgagggagctgaattttgagtcttcctgtgtctacaacgtgttctgtcttcacacatagttgcttgtgtagctaggttgagaattgtactttgaaaagtattttcctgtagaattggaaacttatactcttctagcatctggagttgggaagtttggtgccattctgatgggtgttcctttgaatttaactcttttattttcttctctggtagcttttaggctttcatgtacctcatgatctgaatttt

SEQ ID NO: 44701 - DNA, 1052 bp, Homo sapiens
agaatacttaatgttttggacctaaggaaattgaataagatccctttcaagatagtaatgtatttcttttaacccatccaacaattaccgaattcccattttacagatgagtacgacttacataagttaagattggacaattagtgcactatcaaacacatagttactggtagagctagaatttgaattcctgtttttaaaaattatgtatggttccttttgcacgatgacactgttttggacagtatagaatactgcagtctcattgagaaatacagcagtatctagaaatatactagggatatgtgaattggctcagcttgcatttttattgtaggaggcaattgtttgtggataagtttgatacctttgaagcttctttttaagcttgctggggcaagtctagaaagtcttcactctaaggtggatattttcaaactttatggttttagaaccttaacactctttaaaattactggggactccatagtttttgtttatgaggattttaactatggactgttcagcattttagaaattaaaactaggaacattttataacacaagactacagaagcacaacctgtacaatatcaatgtaatattatgatacaacatgtagcctctataaacaccactgtataattgtgaatgaattaaagtgaaaaaaggcaaattaaatcttagtattatttaaacttgttttaactttacagactcactggggttccctagaccacattttggtagctgcggtcctagcattaatttaaccctatacttaagacttggcctttctgggatcactactgaattctgctccctgttcaccagtgtctttgtactctgactggttgtgcttcacttgtctttgagccttttgcaagctgtggtaattgtgcagcttacaaattcccagtagatgtactttcccctggttgtgggtctttgggcttctagaagtacggcttggtgttccaccaaagacttcaggggatcctttgtagatttctggagctcttagtcgttattgcttcttcattttgagtact

SEQ ID NO: 44702 - DNA, 1047 bp, Homo sapiens
gtaatcttggctcactgtaacctctgcctcctgggttcaagtgattctcctgcctcagcctcctgagtagctgagactacaggcgtgtgccaccacgcttggctgttttttgtatttttggtagagacaggatttcaccgtgttgcccaggctggtctcgaactcctgagctcaagcgatccacccactttagcctcccaaagtgctaagattataggcatgagccaccacacccagctggttaatcttctttcagttgttcctcaagaaaagtaattcagttgttttatgttttgaccttgaacataacctgttgtgtttcaactctgtctttccaggcttaggttgtaagctttttaaagaaagaggattgtattttatgattttggcaatgccctccttgtcttcttctacagcttctagttcagagctttgttttgtttcataatcactctagaaattattaacaaaccagtgggtacttagttgatttagtcaaatagaactaagtccagactgagcaatattggttgataatcatatggctaatactgaaattttgatgttattcaaaataatattctaaagcagtgctaatagaaatataatgagaaccacatatgcaatttaaaacttcctagtaaccacattaaaaagttacagtgagctgggtgcagtggatcatttgcggtcaggagttagagaccagcctgaccaatatggtgaaaccccgtctctactaaaaatacagaaattagctgggcatggcggtggacaactgtaatcccagctacctgggaggctgaggcaggagaacagcttgaaccaggaggcagaggttgcaacgagccgagatcgcgccattacactccagcctgggcaacaagagtgaaactcctctcaaaacaaaataaagattatagtgaacaggcgaaattaattttaatgccttccatttcgaccgatatatctaaaatattaccatttcaacacgtaatatgtaattatgtgctgtattttatgtttgcaggacatctcagttcagac

SEQ ID NO: 44703 - DNA, 1047 bp, Homo sapiens
ctgatcagtctggctagagatttatcaatcttattgaccttcttgagtcagcctttgttttcatggacttttgtctattttctttcccctttctgttttattgatttttattatcatctttattttttcctatcttctcactttgagtttaatttgatcttctttttttgtttactcttacgtgtccctgcttggaagggacacttgtgaagtttaggtcagaactttctattctccttggctcatatctgtggtctaggaaaatgaaatttctatcaccttctggataaatcacactattatctatgcaggcaacaatagcacgtattttctcaaagattacctttgccctcaaggtaggttttatttttctagcagtctaacggtcatgaaataaattataaaataaaaacagtgggtcttcaagctagatgatactattttctttcttgcatggacaattattttaaaatattttggtttttctgcacttattatttaaatatgacagtatgactccccacccccacttgaatctagggacattgtagttttctactgcagactttgtttctggtttatactgggaatatattgtttatcattttcagtgaaagcgttcactggttaaatttccttttaaaaataataatggatctttacaatttctttgagctgctcagtgggtataatgtgttgaattttctgttagtggttgggaggtagaaatagatactttatctctattttagccatttccataattatatatctcaatagtcttgtcaatgcatcattagttctatgactgaattaatgattacttttagtagtcacttaatttcttactgatgatgatgattctacttttgtgaatcatcttggatgattctctaaaatcttagaaagctgattttgttaatactatgcatgtaacacatcaatacattttctctattaaaaaaaattaaagcattataggtagatcagaatttaccattactaactcctcagtccttcttatttccctgttatcagtttggtata

SEQ ID NO: 44704 - DNA, 1035 bp, Homo sapiens
aagagttctaggctgcagtgagctatgatcacaccactgcactccaacctgagtgacggagcaagttcttgtctcaaaaataaaagtaataacaataatgataaattttcctctaaatacaatggtgaatgaggtagaaatgttgagttcataagagaactgttgaatagtgaaggaaactgacttaattttaatgagaggaagaatactgttacacaacactagcaaaaatgaactttcacgctgatgtagcagtacagaatatgcttccaaccccgggacgctgcagccagacttgctagctaagtgaccttggacaagttacttaacctttttattcctcagcacactcatctcaaatggggataataaaacctactatatgggattgttgagagtaaaaaatacttagattagtacatagtaagtactcaatagatgttagctattattgtaatcaccgcgagaccagttaatgagagagttcttccttatacttactctatattgaatacaatttgttgcacttcgaaatatctggatcaggctatagttgttgtcgtcaccaagaatgtaggagtgggaaagagaaaaatcatgcaaaggcttgctgatagcattcacagtgacaggcctaaggtatgattctaaggttgtaagcattttatatttagatttttaagttgtggagtatacgtttaaagataaaaataataagccaggtctcttaatacttatctaaggaagtgtttgtgtaacatttaataaaatgttttatctcagtggcatttggatttaaaaattattttggtctgtcacagaatgttgacttttcccaatctgttacatagggccgtgggtctggatttccaggaaagcggagacctcgaggtgcaggactgtcggggcgaggtggccgaggcaggtcaaagctgaaaagtggaatcggagctgttgtattacctggggtgaggcttgcttcatgtatattttctctaatctaaatgtcagttaatgatgaaaatctcatagcaa

SEQ ID NO: 44705 - DNA, 1030 bp, Homo sapiens
gtttggctttttataggaataatatattgattttaatcgtataatttttaaactgtaaggccaagcttttaagaaaatcattttttaatgtgaaaattagtctcctctatatcaaacccagatatattttattctctaaagacaaggtacacgaaagggaaagtagttgtcagatgggatttagctgtttctgcatggcaaaagacgtgtgcagtaaaactaggccactctttatatatgcctttttctaagtattttccttgacagttatttctgctctaccatgaaaagtttttcttctcaaaccagttgtgctcctttctagtaagtttttttttgttttgttttgaatagttatataataattatgttgttctgactctgaaaagactttaccaatggaaatttgaatctcaaatttacttttggttgatatatttacattctttaaagatactgcttcatatgtattcctgttaaattttacttatctctccttccttgtagacttttgtttcaattgagaaaccaggttcaatacattaggactctttttctgtagactttatgttccgaaatattggggaggggggtgtatttccaggcttattccatcttatatgagccatgtcctagtattttgctgagctgtctttgattcccaaatccgatgataatctttctatttttctgcccctcttgttactacttcatcatttgctgctactcttgtaagtattttgtaggctgtgttttccctccctccagctttttagttttccaatcttggttttagttatctagcaaacagccttcacttgatgatgaacctgctaatatagtgctgttattagggagagtatgaattgaatagtacaagatagatcttccattggtgaggcactgggaccataacttgcaggaaatattctacagttagcaggaatgtgtatatccgtatattagaaatactgaagttcagtattctgttacatgaatttctttggtattaggcatttctgtattatac

SEQ ID NO: 44706 - DNA, 1069 bp, Homo sapiens
atttacaggtaacttcaattagttagcttttacgttttcttcagatttgagacattttaggaaagttactctgatattagtccctatgctgttacccaataaataaataaatttatgtgtgagagccattgttttgttaaggtatattttgcatacgctataattcaccctttctaaggtgtgtattgaatgtgatttggtaaatatgaacagtcatgtaattaccatcatagtcaagatacagaatagaccctttacccataaattcactcatgaccttttgaagttactgcctacctcccactccagctcctgccaatcaccgatctgttgctttcctatagttttgccttttctagactaatatatgaatggaaccatacagtatagaatcttttctgtctgcctttttttacttagcataatggttttgagattggtccattcactagcttacagttaagtttcgttcaatttttggccagtatataaagctgctgtgagcatttatgtaacatgcttcgttgtggatgtatcttttcatgtttcttgggtaaatacctaggactggaatttctgacttgttggaaatatattcttaactttggaaaacagtttcacagtttcttaagtgtctgtatacttctccgtttctagagatctgagagttccatttgctgtacattgttgccagcactggatattgccactgtttctaaattttagccatctggttggcatttagtgataatttattgtgggtttgattttgcattccctgatgattaattagattgagcctctttttatgtctttttttgccatttgtgtatctttggtgacatgtctgttattttgtctctaccatttttttccaattgatttacttgtcatcttcttgagttgtaagagtttttttatatattattcacagaagtcagttttggagatgcattttataaatatttttgcctaatgtgtgacttgttttcatttatttagcaatgtttattgaacagcagagggtttaattttgatgacattggtcatttgttaattttttggaagt

SEQ ID NO: 44707 - DNA, 1032 bp, Homo sapiens
ctgtagagggagggatagggatatgtccttatcactgggtgggtgttgaactcaggctccccactttttttccacccacactctagagggaggaagccgcgttactgctcagtgggtatgaatgtcctgtgtcccagttggcctgctgtggtatcatgttgtccgtgggcaggagtggggaatggctgactatgtcctccttttaagtctttgcaaaaggtatatggcttgggcttttatttgtaccatttggcttaaactggtttgttgttgtctatgagttttttgtcttggtagcctgccgcttccctgcttttttgacaaaagacagcagaattttcttggagttttacgtatgtgtgtgcctgttggtgtttctgagttgtctgcttctctagcaacttttcttgtatatatgagtcagaaaggaaacctagggaattcatcctcttttgtttcttggctcctgaagccctaattggtctgccctctctctacattttgttgtcttcttttgtttgtcttatgtatcacggctaagggtttttaaagctgtatttagtggaaagaacagggaaaagtacattttctgcattttgtctggaagtggaagtctgcattcatttttgctgtttttccctgaatacagagttctgggatgattatgtttttcttcttcaagcatttaaaagatgttgcattgtttcctgtcttccatggtttctaatgagaagtcaggtgtggtgtcagtagtatcattattcccatgtatataataatgttttgatattctctggctgctttcaggattttctctttatctttggttttcagcagtctgactatgatgtgcctaggtgtggttttctttgtattcatcctgcttgggggttgctgagcttcttgaaactgtaagttgatatttttcaccaaatttgtgaaaagcttgacttttatttcttattctttttctgtctcatttctctctcctcttcctctgtaactctaattacatgaatgttagtatatttg

SEQ ID NO: 44708 - DNA, 1027 bp, Homo sapiens
ctgaggcaggcacataacttgagctacaagttcgagaccagcctgggcaatgtgacaagaccctgtcttttcactaaaagtaccaaaaaaaaaaaaaaaaaggcaggtgtggtggtgcacacctgtagtctcagctactcaagaggttgaggtgggagggatggcttgagcccaggatgcagaggttgcagtcagctgagattgcaccactgcactccagcctgggcaacagagccagactttgtctcaaaaatgaatgaatgagggaatgaatgaatatgtttatttcccgtcaccttgacaccttgactctggagctaagaggaagctgaaaaatttgttttagaaaattaagagttttgtatgcctatttaaaaacagttaaattttggtaggcccattcaatgaagatgtctcaatttaattttaatctttctttttagtattaaataagtttaaagaaatgaacttacctttgtgatgaggtgggtggtattctttggtattgtaaaggaccccttgaatgtaaagtttaggggaggggtggagaataatatgaacttacatctgcataaaatatcttgtgaaggatgcataggaaactggtaaaattctttgcctgtaggaaacttattttatatagttgtatacaaagtgattttatactgcataccctttaggaacttttgaaccatggtaatgtttttatttcaaaaattaaaaaccttttaacagtttctaacttgttttgaaaatatacttcaaaaacttatttctctagttgtgcactattgtgtgttttatctatttgaaattgatttgtgtatcatgtgatataaggggtccagtatcattttttcacacatggacagccaattgttactacaccatttattgaaacatctttttcctccacatttgaaatataacctattatatagcaaacgttcaatgtattttagattgttggtaggttctctgttttattctttgtgtatttgagaatcccagtgatatatcatgatgt

SEQ ID NO: 44709 - DNA, 1022 bp, Homo sapiens
aagtgctgggattacaggtgtgagccaccatgccctgccatgtcttcattttttatggttgtttcaggaggagcgtaaatccgataatccggtctctgtgactccatcttggtcagaattagaagtattatgcaagtaactaagaagtttattatttcacaatagaaaattaggagttagggtgatgggtagttcagtagcttcatgataacaagttgtcagggtcttaacatcttttcttggtgcatccagaacatattggtctctttcttgatccagttcctctcatgagcaaaagatagtgggcaggacctctaagcattgtactctcaggatagcattcagaggcagaaaggaaaaaggaacctttttattattatgttaattaaggaaaaatccttgccagatgcttgtcccatcctagcatatttctctctctctctctctctcttttttttttttttgagatggagtttcgcctttcgcccaggctggattgaagtggcgcgatctcggctcactgcaacctctgtctcccaggttcaagtgattctcttgcctcagcctctggagtagctgggattataggcacccaccaccacgcccggttaatttttgtatttttagtagggatgggatggggtttcgccatgttgcccaggctagtcttgaactcctgacctcaggtgacccgcccgcctcagcctcccaaagtgctaggattataagcgtgagccaccacgccctgcccctggcatattcctcttaacattttattagctagaattaccttgagtgttcatatctttttttttttttttttttttttgagacggagtctcgttctgttgcccaagctggagtgcagtggcgtgatctcggctcactgccagctctgtctcctgggttcacgccattctcctgcctcagcctcccgagtagctgggactataggcacccgccaccatgcccggctaattttttttgtatttttagtagagacggggtttcaccgtgttagc

SEQ ID NO: 44710 - DNA, 1033 bp, Homo sapiens
ggttttgccatgttagccaggctggtctcaagttcccagcctcaaaagatccaccagcgttggcctcccaaagtgctgagattacaggagtgagccactgcacccagacagattctgtatttctaagaatttctcagtttgatattgatactggcactcagtggttggtccacatttttagaagggccactttactgctatcacaaatacaggatgccattgtatatttacatattagagttgattttgaagttttatgtctttatttattagctttaatttttttaatgtttgctcatttgctccttttcatttttcccattttaggcacttgttgggctcatcaccgttgtgtggagtggtcactaggagtatgccagatggaagaaccattgttagtgaacgtggacaaagctgttgtctcagggagcacagaagtaagtagacaaagcaaatatttaaatcatagttttataacattcactttaatcagaagttcacttgaaaggattattaaatgattgctgtagtgtaaaagctctcaaaataggaaattattaatttttattaagagaaattctaggccaggtatggtggctcacacctgtaatcccagcactttgggaggccgaggtgggtggatcacttgatgtcaggagtttgagactagcctggccaacatggtaaaaccccttctctaccaaaaatacaaaaattagctgggcatggtggcagtcgcctgtaatcccagctacttgggacactgaggcaggagaatttgcttgaatctgggaggtggaggttgcccgtagccaagattgcgccattgcactccaacctgggtgacagagagagactccgtttaattaaaaaaaaaaaaaaaaaaaaaaaaaaagttattttatgcaaaaattagccgggcatgctggtgcacatgtgtagacccagcaacttggggtgctgaggtgggaagattgcttgagtccagtagattgaggttgcagtgagccatgattgcaccactgcactccat

SEQ ID NO: 44711 - DNA, 1133 bp, Homo sapiens
tgatatgtgtactactttttaaaatgctatggaaaagtagaattccaaatgtataattattaaacttaattgttcttatgggtaatcactgaatagactgtagaaaatagattgaaaagcttagcttgtgctttagacataatttaaaagcacaagtatctatagttatcgcttaaagcagttgaataaagctacttttctccttctctgacttacatttcatttttactagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaagtaagcagtttcgactttaaatgttggaatagattaagactgcatataatttatttccattataatgtttataaattttcaaatgggattgttcttgttgaacagtttctcctgttctccacatttatgggatactctgactcaccattaacccaattaatccaacaaactatccttttcacaaatttttcttgttattttttaaaaagtttatattaattgtatatgaaagcggtgtgatcacaaaactaaacttttggaagaaaacttcaaagaacataacacaagctgagagggagggagttcatggaatttataaatggaaataatgtaataataaaacagatcaataaagtccttcttttgtttctctaaataagcttttaattttaagaatataacataatacaatagcaaatccagaattggttttcactactcatgtcttttgtgtcattcattcatcaatccattcagtcatttatttaatttatatataagtttgtgtgcttcagaaaatgttgcactgtcctatacattcttccctccctccctcccctgccttccctcccagaagatgcttttttcttttttaaggaattttttttttgtaatgatgtgtgtatgtctgtattcacgggcacattgtaattacctaaaggtcttgtctgatatagtttaaaatattttgtacagttgt

SEQ ID NO: 44712 - DNA, 1053 bp, Homo sapiens
tattttttagaatattttccaataatataaaataatatgtgactaggattatgtgcaaaaatgtaagacttttatagagaaaattataaaactttttggaaagattaaggatcacagacataatagcagtataatactcacattttaggggattcagtattttaaagatattctttcccaattgatgtgtaggttcaagaaaattctaataaaaatttctacagtaaattttacaagctgatcttaatttatatgaatatgcaaaagacaggataagccaaaggacccatgaagaagaggaaggattgctttacttgatactaagactttttgtaacacactaataaattaagtcagtgctgtattaccacagaaacagacaaatagaccaatggatcagaatagggaacccagatacagatacatgattaatatggacaggttatttataacaaaggggcatcacaaattagtgaggaaggaagtctctttcaacaattgtgctagaacaattagacatactttaaaaaaaaaaaaaaagaaagacctaatttattcatgtctactccagttaatttatagacttaacacgtgagaagcaaattaataaaagaagttaatgtagaggaatttcttcattgctttggggtaaggaaagacttttaaaaaacaaatggaaagccctaattatagaaaagggttgattggccaggcacagtggctcatgcctataatcctagcactttgggaggttgaggcaggaggattgcttgagcccaggagttcgagaccagcctgacttgaacatgacaaagccctgtctctacaaaaaatacaaaaattagtaggacttggtggtgctactcaggaggctgaggtgggaggatcgcttgagcccaggaggtcgaggctgtagtgagctgtgatcctgccactgcactccagcctgggtgacatagtgagaccctgtctcaaaaaaaaaaaacacacataaaaagaaaaggggccgggtgcggtggctcatgcctgtaatcccagccctttgggaggcta

SEQ ID NO: 44713 - DNA, 1034 bp, Homo sapiens
caatattggtagaaataattgttataaagatgtatgttgtaatttgttggtttattttagtttcttttattaattgcaaaaaattccattaacatttaaaagttatgtaggaaaactaaaggaaatactgataacaactaaataaaacacctagagaacagttgacttccaacagttactattttttttcatttattagcagtctatcctgcttaaacaattactatttaaattaatgcccgcatattttttggcttttgacaagtattggactcttaagctttttgaatttgcattaaaaaatcacattaaatattataacagtaatgtatatttgtagaaatttatggaactgtgggtaattataaagagagtaagtcacctgtaaaagtgttaactctcagagaaaattagtgctttttttgtgtatttacttttagttgcttacattgttctgtgaaagcagcaactatattcatattattaatcagtgtcaatattttaagtagtttagtgaataaagatagtgttaataaataatttgctttttctaatatagtgctaatgttttagctttacagtacaattttgatgacattggatacactagattcaatgagatatatccagaaaacataactgtcaggaggcagacttctttcaaaagaagggagggacatggttacacaatttcttagctatgttttcttctgtagttttagtaggaagcaagcatgaaaagtattgccattctctggagttaagggaagtcagttattctatttaatagctgattaggctgggcatggtgatggtggctcatgcctgtaattctagcactttgggaggctgaggtgggaggataactggagcccaggagttcgagaccagcctgggcaacatagttaatccctgtctctaccaaaaaaaaaaaaaaaaaaatccaggcgtgatcgcatgtgccttgtagtcctggctagtggggaagctgaggtgggaggataccttcagcccaggagtttgaggttctgatg

SEQ ID NO: 44714 - DNA, 1047 bp, Homo sapiens
tatcctttttgatgttctttgtcatttggtttctgagattaatttgaggaatatttcttcttcttcctctcttttgtctctttttggtatttccattacatgttacctttttgtagttttctgtattaaacattctgttctttttttttttttttttcccagtctttttctctttgcttttcaggtttggaagtttcttttgaaatatcttcaagcaatgagattgtttcctcagctgtgtgaggtctactaatagacccactaaaagcattcatcatttctgttagttttaaaaaaatctctatcattttaatctctagaatttcgagttctctgcttacattgcccacgtcttcttgcatgctgtctactttatccattagaaccgttagcatattaatcatagttgctttcaattcctcatctgatcatttcaaattccttcctgcatccaagtctagttctgatgttgctctatactgtgttttttgctttttagtataccttgtaattttttttctcgatagccaggtgtagtacactgggtaaagacaacagctgtaaataggcctgtagtaatgtggtgggccttgtaggaggagggggaagtctgaattttttactcttcctccccaccctgccctttcactgcttttaggtggggcagaatggcctagaatgggctaaagttagatagttctcttaggctagaactggctggagtttatttctcttctcgtaggttaggctctagttaaatagtttctcctgaaggcaggccttgttaagagaaatggttccttttcccctcctgctgttgaaagcaagaagatatttttctgtgaagttcactgtgagaaactggtagagctcctagaggtaaaacacaaaaccgtggggccccacgatgactgggtccctctgtagtttgtatcttccagactcgtccacactgaacctccaacgttttgtcaattatggttcaggtttttgtacccatggagctttttacccatgggtttctgctcaggtaagttgtgattcatg

SEQ ID NO: 44715 - DNA, 1036 bp, Homo sapiens
tggttacatcccgcccggccgtctgtggccacccaaccccttaactatttttaagtgtacattttagtgatgtgagatacattcataatgtagacactatccattttcatagctttttaaaaaatcttgttaaactcatactttatagccattaaacaataactcccagtttctcccttctctcagcctctggcaaccaccgttccactttccgtctctgattttagctactcttagtaccttatataagtggaatcatccactatttttttttctttgtgactggtttaattcacttaggagattgttgtcaaggttcatttatgttgtagtatcgcatatgtcagaaattccttcctttttaaggctgcatagtattccaccatagacatactgccaatgtggtatgtctgtaccacattttacttaactgttaattatgttttatttattgtgaataatgctgctgtgaacatgggtgtataaatatctctttggagactctgcttctgattctttttggtgtatacccagaggtggaatttgtggatcatatggcaattctatttttaactgcttgagaaactgccgtactgttttccagggcccatatcattttatgttccctacacctgtgcactagtgtttcagtttctccacgtccttgccaacatttgttattcttttttttatttttcacagtagccatcctaatgggtgtgaggtggtatatcttagttttgatttttcatttttctaatagtcatcgtgagcatcttttcatgtttttttggtcatttgtataacttctttggaaaatgtctgtggaagttctttgctcatttttgagttgggttgtttttgtcaggtgttcgtcccacctcatcctcctgagtacccaggactacaggcacatgccactatgccccactaatagaatctattttagacctaattatattctgtctacctgaaagacaattgaaataaaatgacataaagagaaagataaaacatgccaacactaatcaaatta

SEQ ID NO: 44716 - DNA, 1096 bp, Homo sapiens
ttagtttttgaactttttatttgaccttcatctctaacacctgctccatctccatctctatcttcttcattttagctgcatactcccttctttcttcttccatttgtgccagagggctcttagtcagctgccctttattcttgttgttatcaactccattataagtcacagctgccagttttctgcttctgtagttctcatagtggacattattagtaacatctttcaagtcctgagtgtgtgtttttatcagcatatttcttagaattgtaaaatcacaatgttcaccattttcaacttcagcagcaccccaaggatactgccttcctttgacccttttgccattaacttcaatgatagtattactagcttaccacagcaagaggtaaacagtcctttacctttttagcaagtttattttcttcttcatcatctatttctggaaaatcatatatcttaattttatgttcttggatttctttcattatctgttttttaaactgttggcattcctctggtataagtgtgtctgctttggcaataagttggatgataatcactttttcatgcgaacgcttcataaactcaatatccaatggtttaagttcatgtcctgaaggagcaatgaagtataaacaacactgcaccctgctattaggcatctgacgtctgttcactcgtgattctgcatttaggtagtcctcagatttactatcaatgtaatcgataagaggctgccagcaattactattatccactacatctccaaatcctggggtgtcagctattgtgagcagcaactgaacaccaccttctttgattaaaactttggattgtccacctgtatagtctttttaattctatgagaaggacctggatactctggagcatacaaatctgtaaggaataatgagttgattaatgtcgactttcccaatccaggttcgcctctctgggtaaggtggctcacacctgtaatcccagaactttgggaggccgaggtgggtagattgtttgagctcaggagttccagaccagcctgcgaaataaggcgagaccctgtctcactttgtatgctggtgccagccgggggtgc

SEQ ID NO: 44717 - DNA, 1048 bp, Homo sapiens
ttgatgtttatatgttactgtgttgatctgacaatcttaaagaactcttttaacatttcagttgataaacttgtattttctaagtagacattagtgatattttctgctaattatgacactttagcctgttcctttatggtattaaagtgtcttatttcttatcacttagcttaatgacacaacatccagtattaagtggctttgttttaaagtttgattccctgtgaaattttattattttgttcagtgggagacagaactgtaacttgcttttcagaattgttaggctgttatctcaatatttgttattgaatccatatttttgtcctgagttatagaaccatctactctttcaacaaaacatatattgagtgcttatgtttcatctggtgctgttaggtgttgggggtgcagcagtgaatagaacaaatttctagtcttcatggagtatacagctaaagagacagtaataaacaaataatatttttttgatccatagtcatttggatttacagatgcggaacccgtggacatagaagtcttactgcatttatatctgttttttttctgcatttgttgagatgatcatttttccttgatttgtaaatatgacaaccatattaacagattttcccttttgatttctttatgaattttctagctttcttcctatgtcattgatttctagtttcatacaattgttgttagaaagatacttgaaatgatttcattcttcttgaatttgttaaaacttgttttgtggcctaacatatgatctatcctggagaatattctgtgtctgcttaagaagaatgtatattcagctgctgttggctagaatgttctgtatgtgtctgttaggtccatttagtctgtaatgttcaagtctgtgtttccttattaatttttgtctggattatttatccgttgtcgaaagtggggtatttaagttccccactattacggtattgctatttccccctttagttctattgatagtgctttatatatttaggtgctccaaattggggcatgtatatatatttat

SEQ ID NO: 44718 - DNA, 1048 bp, Homo sapiens
tgaccaggctggtcttgaactccagacctgtgttctgcctgccttggactcccgaagtgctgggaatacaggcatgagccactgcaccctggccttaactacgtattttttatatctgcacagtgttttggaaaaagtggttcaactgaaagaatgaaaagatgggggcagaatttgctttttaaaaaaataataataatttaaaaaaagggcattgaaaaaagtttcagtggtgttgggagggccttggaacaaggaatgaatggaagatgagggagtggagggaggccatgtatggactctttctacagaccaggctgttgaaggagagagggctaacaggaaatgaagtgcgggggaagttttttgaagatgggagaaagaggacaacttttatatatttcatttcatttgattccttataaatttgtaaggaagatagagcttgtattatttcagtgaagttgaaaatagagtacagaaaaattaagatacagcacccccaaaactgagaacttctgacataatacactgttggaaatacttacttcagagtgaagaaaatattggaagttaggcttgttaattgctctgcatggttcataattactctttcttattaactatttaaggaacatgagaccaggaagttaaatacctgggtatatgcagatatatatctagaattggtaccaaagtaaatacaggcataccttggagatactgtaggttccattatagactaccacaataaagtgagtatcaccataaagcaaggcacacaaatattttggtttaccagtgcatgtaaatattatgtttatattctactgcagtctattaaatgttcagtagcgttatatttaaaaaaccaatgtgcatactttaatttaaaaatactttattgctaaaaaatgctactgatcatctgagctttcagtaaattgtaagattttttgctgatagaggatgttggtggctgctgactgatcccagcagtgattgctgaaggttggggtgcctctggtagtttcttacaataagacaa

SEQ ID NO: 44719 - DNA, 1084 bp, Homo sapiens
caacaggctaccgagtggtattggtctgcagctataggtggggggaaccctgagtacgataaactatcttctagaataatttttttaatatattgaagcagtagtgcctagtttataagtagacatatgtatagtataaactatatagtttatattcagagtacaaaatccaccttggccactatttttttttttctttttttgagatggagtctcactctgtcacccaggctggagtgcagtggcacgattttggctcactgcaacctctacctccctggattcagcgattctcatgcctcagcctcccaggtggctgggattacaggcacacgtcaccacacccacctaatttttgtatttttagtagaaacggggtttcgccatattggccaggctggtctcgaactcctgaccttgtgatctgcccacctcggcctcccagagtgctgggattacaggcgtgagccaccccacccggccaccttggccactattacaaaagtaaagctaaataatactgaagtatatgttccatattttgtaaggactgttgatttggaaacagtgtattctaacaagataaattttaaatgtaactaatagtatatgtttctgaataaatagttgctgcttctaatataaagtgtcatatttgttttaaaatcattgctcaagttgtatagttgttttgggcacgtattttcaacttctagaccaatacaaaatgtaaaataagtaaaagacgtgatatagttgtatcctttctaaacactgacctattttttttttttcctttgctaccttttttttttttttgagacagagtctcgctgtgtcgcccaggctagagtgcagtggtgcgatgttggcttactgcagccttcgcccctcgggttcaagtgagtctccggcctcagcctcccaagtagctgggattacaggcgtgtgccaccatgcctggttaagtttttgtatttttagtagagaccggttttatcatgttggccaggctggtttcgaactcctgacctcaagtgatctgcctgtcttggcctcccaaagtgataggattacaggcgtg

SEQ ID NO: 44720 - DNA, 1077 bp, Homo sapiens
aagttttctaataaacctgagttcccacttgttttttttccttccagcttttattttaggttcaggggttacatgcacagatttgttaacatgggcacattgcgtgtcgctgaggcttagagcacaaatcattttgtcactcagatagtgagcatagtacccagtaggtagtttttggatcctcaacttcctcccagcctccaccctcgagtaagccttggtgtctcttggtcccctctgtgtccacatgtacttagtgtttagctcccacttggaagttagaacacacagtatttggctttctgttaattaattcgcttacgaataatggcctccaactgcatccatgctgttgcaaaggatcatttcattctttttttatggctgcacagtattctgtctcgtatatgtaccatgttttctttatccagtccgctgttgatgggcagttaggttgattccatgtctttgctgttgtgcaaagtcctgtgatgaacatatgtgtatgtgtgtctttatggtagaacgatttctattaatttgggtatatatccagtaatgggatacctggattgaatggtagttctcagttctttgagaaatccccaaagtgcttttgacagtggctgaactaattaacattcccactagcagtgtataagccttcccttttctctacaaccttgccaacatgttttttttgtgtgtgactttttaatcatagccattctgacttgtgtgagatggtatctcattgtggttttgatttgcatttctctaatgataagtgatgttgagcattttttcatatgcttgttggccacatatgtcttcttttgagaagtgtctgttcatgccctttgcccatttttaaatggggttgttttttgcttgttttttttttattataaactatttttttattatactttaaattctagggtacatgtgcacaacttgcaggtttgttacatatgtatacaaggtgccatgttggtgtgctgcacccattaacttgtcatttacattaagtatatctcctaatgctagttttttgcttgttgatttaagttcctt

SEQ ID NO: 44721 - DNA, 1075 bp, Homo sapiens
attgcattcagaattattttttttttttttgagatggaatcttgctctgccacccaggctggagtgcagtgctgcaatctcagctcactgcaacctccgcctccccagttcaagcaattctcctgcgttcagcctcccccgtagctgggactacaggcactcaccaccacatccagctaatttttgtacttttagaagagatggggtttcgccatgtagcccagggtggtcttgaacccctgagcttgggcaatccacccaccttggcctcccaaagtgctgggattacaggcatgagccaccgtgcccggcccctgttcagaattctggcaattgtagtgcaagagggacaagaatctgcctctgcacaaagttgcaaaataatactgtggttcttttctcgtctaattttcataaactcttaacaacaagcatgttatttctggagaaacaaaatcacagtttgaattgaatataatctttatatataatcttacagagggactttttgttcctgaactcctgataagaaagaactttttatgtgacccgtatccaacttgtgcaacttatctaaagtaagctcacaaatgtattttctcaaataatacaatacatacttcattataatagccttgaatttccaaataggttgaaaacaaaactccttgtgagtgggaggggtagttttaaccaaaaaatcaattaagtgagaagatttggtggtggtggtgggattagaaatcctcattttattttgttctcataagcattttaaactgtccctctggaatcacgttgtttttgaacttgcatggatggtaggattctttaaggtaaggaccaggtcctactcatctttgttttctccgaaaccagcatatcattggttgaaataattcccatgaaaactgccattctctctggtgtgtggacacaatttctaactgacagggatctgaagtatggattttcagtagctgcttacgagtcactgcactgagtctgcttattacagaaaactgcctgactcaaagctcagctaagcccccttgcttagctgcaccgaacctta

SEQ ID NO: 44722 - DNA, 1062 bp, Homo sapiens
aagtatgtggtggccaggcgcggcggctcacgtctgtaatcccagcactttggaaggctggggtgggcagatcatttgaggtcaggagtccgagaccagcctggccaacatggtgaaaccctgtttctactaaaaatacaaaaattagccaggcctggtggcacacatctgtagccgcagctacttgggaggctgaggtgtgagaactgcttgagttcagggggcagaggttgcagtaagctgagatcacaccactgcactctagtctgggagacacagcgagaccctttttccaaaagaaataaaaaattaaagaataaaaatgaggccaggcgcggtggctcactcctgtaatcccaacactttgagaggccaaggcgggtggatcacctgaggtcaggagttcgagaccagcctggccaacatagtgaaaccccgtctctactaaaaatacaaaaattagccaggcgtggtggcacgtacctataatcccaactactggggaggctgagacaggagaatcgcttaaactcaggaggcagagtttgcagtgagctgagatggcaccattgcactccagtctgggcgacaagagtgagactccatctcaaaaacaaaacaaaacaaaacaaaaaccttttttcttcataaattacctaatctcaggaagttctttattgcagtatgagaacagactaatacatcacccaaaatgatcgctttctttacaggatggctaataccctagtataacagacttggactttagaattggacttcagatatgggaaggtcataagaaaacctttcttttgggaaaagcagcacaagcaccatgtctgagggagagtatgtcactcaaggcggccactgagtctatcattttgctccacctaggttgagcttcaagacccagctcaaatcctacatgttctgtgatgctttcccgatcatcctgggccagagctggcttctgcacttgtctgcatcctccatttaagactcgtattttttatgtgtatgtactttttctcccagtccagactgtaaacccctggaaaa

SEQ ID NO: 44723 - DNA, 1099 bp, Homo sapiens
aattaatattgaagtgctctttctaatataaataaaatataagaaatgaaaatgtgatttttcttccaatgaacaaatgaacatataatccaagatcttgtagaaataacagcacttgagttttaaattattggattccattcatttattttgaagtttcttaaaggatcttttttaaagattcagaaatatttatggatagtcatataattcatgcctttaacatttcaaatatgattcagaatttcctgaaagctttttggggataatttactgtgccgaagttgattcttctgtatttctgactgactgacctctcacgtcatttctacctctccaagctcacattggggtaatgatgatttatagggtgatacgcttaatcttacttaaaacaaaatacagattaccaaataccggtttgtctatttaaatcttctatataaaaatctaacttatgccagagataaattatagggtattacttatggattcttggctataaaaagtattcatacataagggtatatgtgaatagtgcactgaaaatcaaaataaatggctacaatgtatggacaacagaacctgtgactgcaagcagctgttgggtgtcgggagccttgagggcttgctgatgtggcgtaacccaccggacgtgtgactgtgtgtgagctgcttaatctcatggataaaacaaagagtctgaattaggatcactagcttcttttctactaacgtagtcgctaaaagaaatttggaaaattatgtatccccttacatgttttgacttaacattcaaactttcatttataagtatttaatttatggcatattcacattttaaaataaaacatttatttaaaatatccactaaaatctacatatcacagcagtttgctacccaccatacatttttttgttttgttttgttttttgagatggagtctcactctgtcgcccaggctggagtgcagtggggtgatctcggctcactgcaacctctacctcccaggatcaagtgattctcctgcctcagcctcccaagtagctggaactacaggcatgcatcaccacgtccagctaatttttgtgttttttg

SEQ ID NO: 44724 - DNA, 1758 bp, Homo sapiens
aggacaccctcactgggcagaagtattcatgaggagcacatgacctcagctcatatactgtggcagagcaaaaggcactttagctggacgctgtcagataactcactttcaaagggagatccgagctaagtgttctttcttctctctctctctctctctttctttcttccagaggcttgcttcttcgcccaggctggagtgcaatggcacgatctcagctcactgcaacctctgcctcctgggttcaagcaattctcctgcctcagcctcccgagtagctgcgattacagacgcatgccagcacgcccggctaatttttgtatttttactagagacggggtttcaccatgttagccaggatggtcttgaactcctgaccacaagtgatctgcctgcctcggcctcccaaagtgctgggattacaggtgtgagccattgcacccagcctggctgctaagtgttcttaaaggaggctgatgtaggggaacttaccctattcgatgtaaggatatgtagttaaggccaggcatggtggctcaggcctgtaatcccagcactttgggatgccaaggtgggcggatcacgaggtcaagagatcaagaccattctggccaacatagtgaaacccccgtctctactaaaaatacaaaaattagctgggcatggtggcgcacgcctgtagtcccagctactacggaggctgaggcaggagaattgcttgaacccgggaggcggaagttgcactaagccgagatcacaccactgcactccagcctgggcgacagagcaagactccgtctcaaaaaaaaaaaaaaattgtcgctaaagtgagagtatgctattggtaaaaggatacacaagtagaacagaatatagagcttcagaacaaacccacacgtatggactttagcatatttcagaagcagcaaatcattgtggaaaggatggactattcaaatccttgtaacaaggatggatgatacatgatggaaaaagatgcaactgaaaactgtattacatcagtacttataatttttactcatcaaagattccatcaacaaagcaaaaagagaagctacaaacagagtatatttgcaacccatgcgaacaacacgtttaatattaaaaccaaaatgtagtgtgtatactcataagtgtgtatatatgtgcacacaaatatgtacgtatacataaatcaagacaaaataagtagaaaaatgggcaaaggatattcaggggcatttcacagaaaagaaacaggactggtcaaaaaacatgaaatgatgttcaatctcattggtaattgcaaatacaaattaagagttcagtaaggtgtcatttcacgcacacttggatgacagaaatttaaaggctgacattaccgagtcgcgaagaagatgtgcaacaaataatgccaactctgtgctgctggcaaagtcaaaccaaagaagtgcaagcacctggaaaacgaacttggcattatttttctttctttttttttttcttttgagacagagtctcgctctgacgccaggctggagtgcagtggcgtgatctcggctcaccgcaacctccgcctcccgggttcaagcgattttcctgcctcagcctcctgagtaactgggattacaggcacctgccaccacacccagcaaatttttgtatttttagtagagatggggtttcaccatgttggccaggatggtctcgatctcttgaccttgtaatccgcctgcctcgacctcccaaagtgctggg

SEQ ID NO: 44725 - DNA, 1950 bp, Homo sapiens
caatctcattactgggtatatacccaaaggaatagaaatcattgttataaagacacatgcacgcgtatgttcgttgcagcactgcccatcagtgacagactggattaaaaaaatgtggtacatacacaccagggaatactatacagccataaaaaggaacaagactgactgggcgtggtggctcatgcctgtgatcctagcactttgcgaggccgaggtgggtggattgcccgcgctcaggaggtcaagaccagcctgggcaacacggtgaaaccccatctctattaaaatacaaaaaattagctgggcatggtggtgcgtgcctgtagtgccagctactcaggaggccgaggcaggagaattgctggaacccaggaggtggaggttgcagtgagctgagatcgcgccattgcactcccgcctgggcgactccatctctaaaaaataaaaaataaaatataaggaacaagatcatacctttgccagggacatggatggagctggacgctattatccttagcaaactaacataggaacagaaaaccagatactgcatgttttcacttataagtgggagctaaatgatgagaactcctggatacaaagaagggaacaacacacacacacacacacacacacaccctctcacagacttagaatacgtggcaagaaaagcatataatttgacattaggagcagaagaattagtgtgctaaggtccttgcattgtccgggagaaggggaaaagtatcaacattagacattgataaagggtctgcaccttttgatttcttaaccactcaaggatagaaaaggggcataactttaaaatgaaacaggaaaatggtgggctgatttttaaatttaaaagaaccgaatacagcaggacagatccaaagcacagaggagatggtgtatttaactccatccacaccaatcattacattacatgcaaagggactgaggactccagttaaaatgacagttttaggctggtttttaaaatacatatttgctgttttatttttagagacaaggtctcgctccgttgcccaggctggagtgcagtggcatcataactcactgcagcctcgaactcctgggttccagtgagcctccacctcagcctccaaagtagctgtgattacaggtgtgtgccaccttgcctagctgagtcccttgaattgataaaaggtatatacaaaaatccctcagtaaacattagttaatagtgaaatattagaagtgtctcttttaaaatcaagaacaagagtgcctgctattactacttgtattcaacattgtactgaaagtgtcaacacagtaaagcaaggaaaatgaaaaagcatgaaaaaaaggcatatggaagaaacaaaactgtcattctttaaaggttagatgattgtatgtatggaaatccaatatcatctataagcagattattagaattaagagtttagcaaatttgcgagctaaaacatcaacatttaagtttttctaagtaccagcaacagaattaaaaaatagaattttaggctgagtgcagtggctcacaactgtaatcccagcactttgggaggccaaggagggaggattgcttgagtcctaggagttcaagaccagcctgggcaacatagtgtaagaccctgtctctataaaaataaattttaaaaaagaaaatggaattttaaatatatataatatttaatcataactaaaaatataaagtttctagaaataaatctaataaaaatatgcaagacctttttggagaaaattacaaagctttattgtaagaagcagagtttaacccttttcccatttagaaaaaaaaagtgcagctcactgccagcgctcatttaattttacgtaaacacactcttggaggctgaagcaaatcttactgattttcaatgtgaaaataaaatataaaaactattcttggagtta

SEQ ID NO: 44726 - DNA, 1924 bp, Homo sapiens
ttttaaagtggacacatttccctccccatcaaattgggttttatactttaggaagaagggaagaatggatatagtgtaatcaactaccagaaagggtgtgtactgtagtcatcagattttggaaaggccctagatctgtggctctttatttttgaatcttacaaattgaagtgggagtgcatgtgagcctggccggaggagagtcccctagcctcttccaaccttcccaccaggctctaatttccttatttattgtatttgcttgtacagctccattttggcaaaagtgaatttagattttctttcacattccagtaagtgtctttttaaacttttttgcagactttgcattttgtaacctacccttgagctactgcattttgactgagatttttaaattttacacaggtgatattcttgaatttcatggcccagaaggaacaggaaaaacagaaatgctttatcacctaacagcacgatgtatacttcccaaatcagaaggtggcctggaagtagaagtcttatttattgatacagattaccactttgatatgctccggctagttacaattcttgagcacagactatcccaaagctctgaagaaataatcaaatactgcctgggaagattttttttggtgtactgcagtagtagcacccacttacttcttacactttactcactagaaagtatgttttgtagtcacccatctctctgccttttgattttggatagcctgtcagctttttactggatagaccgcgtcaatggaggagaaagtgtgaacttacaggagtctactctgaggaaatgttctcagtgcttagagaagcttgtaaatgactatcgcctggttctttttgcaacgacacaaactataatgcagaaagcctcgagctcatcagaagaaccttctcatgcctctcgacgactgtgtgatgtggacatagactacagaccttatctctgtaaggcatggcagcaactggtgaagcacaggatgtttttctccaaacaagatgattctcaaagcagcaaccaattttcattagtttcacgttgtttaaaaagtaacagtttaaaaaaacatttttttattattggagaaagtggggttgaattttgttgatatacatcataaaatagtcttttgcagggtactacgcaagccttaaaatttttcttaagacagagtcttgctctgtctcccaggctggagtgcagtggcacaatcatggctcactgcagccttgaactcctggcctcaagggatcctcctatgtgtgcctcctagagtgcagggattacaggcgtgagccactgctcgtggccaaaagttttctttttttttttttttctttttgaaacagtcttactctgtctcccaggctgctggagtgcagtggcacaatctcggcccgctgcagcctctgcctcttgggttcaagtgattcttccacctcagcctcccaggtagctgggattacaggcacccaccaccacgcctggctaatttttgtatttttaatagagacggggtttcaccatgttggccaggctggtctcgaactcctgacctcaagtgatccacccacctcggcctcccaaagtgctaggattacaggcccgtgcccagccctaaagttttaaactctaggggaattaacagtatttctttacagaatggatttgttaaactagcacagtaaaagtaaagactattctgtttctaggctgttgaatcaaagtgattttagcaattaaactttgtattaatttaccaccaatatttcttcacaaaggaacttttaaaagattatctcagaaagtaaatctgagaggtaagaagtaataatgagtaaatggtaagtacttgagtaaatctaaagaaatattgatagtaaggcaatcctaagcaaaaag

SEQ ID NO: 44727 - DNA, 1064 bp, Homo sapiens
gtcccttgttctctatcacatagggcagtaaaagatgcttggcaggagtggcgggttcagcatagctcctcagtaacatagtaagagagggcacactgaacatctgggtggaatacaggtttagttgctatgttaacttttaattagatggacaattgttaatatgaaaatagttttactccttgagcctagaatctttttttttttcttttcttttctttttagagacagggtctccctctgttgtctgggctagagtgcagtggcatgatcatggctcaccgtagcctcaacctcacaggctcccacttcaccctgagtagctgagactgggactgtaggcacatgctaccacgcccggctatttcttttttttaattttttgtaaaggcagggtctccctatgttgcccaggctcgtcatgaactcctgggctcaagtgatcctcccacttcagcttccaaagtgctggattacagatgtgagccactatgcccagccatgtgtagaattcttaaatacaaaagagaagtctatgagaactgataacatactatgctataagaaagctgaagccaggcatggtggctcatgcctgtaatcccagcactttgggaggctgaggcaggcagaccacttgagcccaggagttcaagaccagcctgggcaacatggtggaacccagtctttacaagaaatacaaaaattagccaggcatgatgacacatgcctgtagtcccaactacttgagaggctgaggtggaatcattttttaaatttcttcttaaggtaaatttagaattgcaagttgtatgtaagattatggtggaaatttggtgcagtcttggctcactgcagcctctacctcctgggttcaactgattctccaacctcagcttcccaattagctgggactactgatgcacaccaccatgggtggctttttttttttttttttaattgtagagttggggtctcactatattgaccaggctgatattgaactcttgggctcaagtgatcctcctgccttgacctcccaaagtgctgggagttacaggcat

SEQ ID NO: 44728 - DNA, 1049 bp, Homo sapiens
catatttgtgaggaatttagttcaaggaccttaatgataattcatgtgtctcttgcaagtttgcagtgtcttcccggttgttataaaagccttttttatacctgctttgctattaatgtgtaaaagaaaaagagtatctcttaggcagggatttaaccttcaacttctttgcctcagtttcactcgtcgggaatccactctgtccttgctgttactctagaagcagtgaatgcctaggctagtgccgttgtctcctgtcttctgagtatctcagttttaaaagtttggttcacaaaatgagatgttaaatgtgcttttgcggactacacaattaatgctccaaggtcactattttggacaaactcagtgatcttttccctgctgtttttcattgtcatgacttttctgctatatttattatttagtagtttcattttcttgaaacattctcttttgccctgtaatgtttttcttcctggttttcctattaaatttctgttttagctgtcttctaatgcgtcttctaactgtggatatatctcaaaaatttagttttggccttaattttaggtccataatacccacccatcaaagagatttttgttttttctctattatttctgtgtggattactcccagtctgctataaccagccccttattacctaccatcttgaatctttttttttttttttttttgagatggagtttcactcctgttgcccaggctgaagtgcaatggcgcaatctgggctcactgcaaccctctgcctcccaggttcaagcagttctcctgcctcagcctcccaagtagctgggattacaggcacgtgccaccatgcccagctaatttttatatttttagtagaagcagggtttcttcatgttggccaggctggtcttgaactcctgacctcaggtgatccacctgcctcagcctcccaaagtactgggattacaggcgtgagccaccgcgcccggcttaccatcttgaatcttaaattttagtggctgtaggacattttcattttgtgacacctagagataaca

SEQ ID NO: 44729 - DNA, 1103 bp, Homo sapiens
tcagtaattttttttttctttttttacatttttgttgttaaaaaaaaaaaaattactattattttgagaccagatctcactttgttgcccaggctggggtgctgtggtgcaatgatggctcaccacagcctcgaacttcccagactcaagcgatcctcccacttcagtcccccgagtagctgggactacaggcacatgccaccatgccaagctgattttaaaatttttctgtagagatgaagtctcactgtgttgcccaggctgttctcgaactcctggcatcaagcagctttccttccccggcttcccaaagtgctggaattacaggcatgaaccaccacacccagcccgtttttttcaagagtttatgaccccaaatggttaattaccactgatctaggagaaaaaatacctgtctgtctttttggtctggctgtttttagagggaagtaaatgaaatataatggtgacatttaaatatccgaaggctgtacaggtaaatgtagctgtaatattatgtacctgaatatgggcgagaattttgtgggtcacacttgccacacttcacgtgtccacacttttcagagtatgtgctgttctgttttccagatgagcagaactacattctccgagatgctgaggcagaagtacttttctctttcagcttggaagaatccttaaaacgggcacacgtttctccactctttaaggtacactttaagggaaaagtaaatcagtccaagtaagcataacacacggacctgctcaagggaactaccaggtgatttggtgggaagtgcgcctccaggggagctgggctcaccctgcatcccatttacctcttggcttccttcttggacattgccactggaggtcttcctcctgtgaaccacagcacatctctagagaacttttctttactataatgtttaaaaataagtacacaaatttaataaatacatctatgagaaataagttattcaaagaataggtttttgagtaattggttaagaggcatgttcatttttctgcttttaataaatctttagaggacatcgcttacttcgtactattgtcagtaaatgtatattcagctggagaag

SEQ ID NO: 44730 - DNA, 1075 bp, Homo sapiens
tagatcacaaaaaggatgcttattcaccatttcagctggaacaggaaggcaaggcatggccttgttcctcccggctaggaacgttcatgtgggtgactgaatcttttccagtccacgtacgtccacaaatggccaccgaagtgccacagacactgattgtgggttcataaataaatttcagaggggaggaaaattagcaaagaatctgtgaaataatgcggctcgcatgtactaagtggtatttagaaatttttttaattgaaattttgaaaattttttgactctaaaaaggtattaatgaaacataaaacttaacaatgaaggcagaagaagaacatagtagaaacaattactacaaacattttagcttccaatttcatataatgttatacagtttagaaggagatagtctattcgttaatagaaatagtaagtgtacttttttagcttctgctgtgggagcatggcatacaccagcttgggtggtggggaaagcgggtctgtaatgttccagcctctggttggctccatcggctgcttttgggcaacacccagctttagagatcttttttgttactttctgactttgcttattctttttcttttccaaccaagaacatgctaattctttgaaaattagtttgccaagcagccaatttagtgaatgaccaatttacttaatttttcaagtttcagtttgtgaaaatgtggttgttttatctgtatataaagtttacagttcctatttaatgggaagttttggttgactagcttttatttctttatggcactgttaataagtatttgctgtgttgctctctgagggttagaaagtggttgttataaacatttaatactgagaaaacatttcatattttatcttccatattttaggatttcctaagagaatttttccagtttataattattgttttttaaaaatagacaatttttagggcagttttaagttcacagcaaaattacagaaagtacagtgagttcccatataccccagcccatacccatgcacacacaccgccacccccactacagtcaccatcccacaccacagtga

SEQ ID NO: 44731 - DNA, 1031 bp, Homo sapiens
ttttagggtggaggtgtaatttcaatcatgttttccacattcttttttttttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcctgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatgttttccacattctaaattgggacacaggacaaaatatttgaaataaaaaccattttgagaagttcaaggttgagggctgcatatatataacatggaggaaaaaaagcaacaaagataatttaaagtactgaaaggattttgtgaataaagagggaaagaaaagaacaaaaaaacgatacagaggttctctccggaatattagctgcttctccccacttgcattgtcctagtgatcttttgaggtgaagactagttctgatgtggtgaagaagaacatgattcttgtatatgtttaagtagtttgattatttgacacataaatcttctggaagctactgtattacttagtagattgattgaattaaagtcgacaatattttaattgcagagtataagactacctcccaaactgaaacagaatgaagtagctaatgtccagccttcttccaaaagagccaggtatgagtaataaccttaaatttttcattgctggctttcacaggtctgctttggaaaatcggtggcaattgaggaaagtttctaaaatgttttgcagtaaataagatttgaaagagtttgctttttgctttacaactttattgggatatatttcattttaatgacataggccagtatattttttattttaaaaaaattcagtctttttctttaagtggc

SEQ ID NO: 44732 - DNA, 1025 bp, Homo sapiens
tataaaaaccgagtttaaatatgcctctaatatatcttgaatgtgcttcactataaacatccctagtgcttaaatccctgctatgtgccaagcatgctgcaagacttagggaatatgtgcgaaatcacagagacggagaaaacggaagagcagtgcgagaggcagccacacggctaagcagaggtggggtggcaaatgcaggctgttgtgagagcctgagaaaggaccttcacccatcgtgttgtggggtgatgtgttaagaaaagtctgctgggagaggtgattcctgaactgcttataggatgagtaggagtgagaattaggggggaggattttccaaatagtgcagcacagccaaaggcatgtgattggtgaaactgacaggagggtgcaaaggagggtgcctcagtgggatccacgaggcaggggttggggcaggagccagggctggtgtgtcttccaagaccttgttggtgtgccatgtggtgaagtttagatgcaggtgaagtgatcagctgtgcattttaaatagtaaagggttgaatctgagggtgaccagggagatgactgtgtggctggctgaggaaagaggcggatggcatgtgccagggtgaggaaggaagggagcagttctgagaaggacagcagcagagattttttaaaagtcagaagtgttcgaaggcagcactgagaaactgtcttgagaagtacaacaaaactcaaagatacaaaagttagtggagaaaagtttggggtttttgtcttgttttcaagttaaaagatttatccaagaggtctaacattaaataggatcttgggaacagagaaaatgaaggcaagaacattatgaaagaaaatagctttgcaactgaaggccatgtgccctcaggttgaaaagaaatgtaaggagagccatgataaggcaactgggaacattcacaatgctggtagagaaaactgttttctctcaaagacaagctcactggaggggaaacgtggacagatcaggagtctgggtgatttcg

SEQ ID NO: 44733 - DNA, 1050 bp, Homo sapiens
cgattctcttgcctcagcctcctgagtagctgggattacaggtgcccattaccacgcccggctaatgtttgttcatttttattagagacgggtttttgccatgttggccaggctggtctcgaactcctgacttcaggtgatctgcctacctcggcctcccaaagtgctgggattataggtgtgagccaccgtgcctggccttattatgtttttcaaatacaatggatgttggtttaaatataaagttccttaagtttgtatttggatatagagacaaaataatttactttgaaatggaaagaattgactgcagtagggagtttgggcacatctctgcactggaaattgtccttaggagacaaatttgatatactcagctgtgtgctctagcggtggaaaactgagaaggctccatccatttctagtgagtgaatggatttgatcactagtgagaagaattgcggagattttctgagagactttcagcaatgcaagagaacataaggacgttttacttctagatgtgaagaaaatgactgaaactttagaaatatgagacagatttagttgaacattagattgttggggggagtgtaacttaccatcaaaatcctgtttaaattgcaaatttatagtggttagaagccatgtgatgtgtatcatactgctttctatatatggcattcagtaactcagtattaatgtaaatgaggattatgacagttgtgatggaaaaatttaaacttgacattcattcagaattgtttgtagtatagcacaattacgtaattgagcaattaagattctttttcttacgttctccaggactaacatgtttccagccagaggcagatcagatggttgaaaaagtgatcggatgaatgtggtaggggttttgggaggcatctcgatggctggccttgcagatttctcctctccatccaggcctgcacctctcgcttcctcaagtggagaaggttccaggccaacggccatcttcattcctagccgggactcttgtcctgaatctccatctgttcttctccctta

SEQ ID NO: 44734 - DNA, 1085 bp, Homo sapiens
cagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatgtaagtcactctttccgaaaaaaatgtcagtattggatcttagaattggatttcacagtctatttcaatgtagtttattggttttgctttttcagaccaaataacttacaagcagtatttgtgtgagaacctgtttacttgtgtgtgtgtgtgtgtgtgtgtgtgtgtgtgtatgtgtatatatgtatatttcagggtcattgaaaaagggtaacagcgtattttaagttgaagatttaaagcagctgagtagaaccaggatgtcagtgatggagtactatccgttgaagggtttccactcttacttagtttaaaattagcaatggcagcaaagagaataatgaagtttaccagctgtacctgatttgcttataatgaacttcatggtagtaaataaataacacaaattcatgcatttgttgaggaaggcttgatttcaggttacagtttatatagcatggagcttattgatacagagtggatcttaagttttgttgctggttgttttttgttttgtttttgtttttttttttttttttgagatggagtctcactctgtcgcccaggctggagtgcagttgcatgatctctgcgcactgcaacctccacctcccgggttcaaatgattctcctgcctcagcctcccgagtagctggaatcacaggcatgtgccaccatgcctggctaatttttttttttttttttgt

SEQ ID NO: 44735 - DNA, 1035 bp, Homo sapiens
tacagaagcaggagggagtgctcacagtggttagtcctaactgattggagactgtcagagggatctgcaccttttctgcacactggagcacccatgcgcacacacactcacatgcacacgccaggcaggaccccagctttacaaaaggactgtttcttggtggttctcagtgaccttctgtcttttccccgtcagggtgttgatacaagctggagctctttgttggagtcttccagagctctcccagggagaggtagggaagggagcttgtccagcagaagttgggaagcacagagatcatctgccttcttctgacccggtattgatgcaggctgaggcctctgttgtaatgtgctgggtaggttttggggaataggtcaagagtgtaatggagagcctggctaggtcatgatttgaatctagaagactaaaaagtcctttccattctgtatctcaatcaacagtatttcttgactgcctacccatgtgccttgcactgtactaggtgctgtgaaagatctcagagaagtttaggacatcatgtaagactctttaagaaggagtgttagagttcatagtcaagactggacaaggagaaaatcctgtaagctagaatcaaggagtgtcttattgggggtggtgaggcctgaagaaggaaaagggagagtgttcctgattggtttaaaggaaagcttttattcctgggggcacagacttgaaattctagtcctctgctcctggttgctttggagtatagctgggaggacagataagcaagcagatagttgtagagtgtgagaagtatttagatttctgtccagcttgctgtgggagtacagtggtaatgccacctgagctgagtcttagaggaggaggtcggagggtgggcgcagcggggcacaggaaagcagaacgtggtgaggacggcaggtgcacgtgggggcagtgctcatgggcaggaggaggtggttaggagcagccagacaggaagggcctggacactatgggggagcctttggattttagccttgcagc

SEQ ID NO: 44736 - DNA, 1007 bp, Homo sapiens
cccagtttaattatatttccgccacaaagctcccgcgtctcattgcatattcaagtttgactaggaagcatttaaaaaacagtgtggatgaaatacccttgtggggggaagggatggggtgggttggctggggggggctgcaaatcttcatggagcgaaagcagcgagccccaacacccgcatcaccccatggatggcctcacctgcgtggaaatgtgtccaacttccgcctgccccacccgctaggcgcccagctccccccgacggcgccaggcacaaaggccattgtcacgccgggcgtttaggtatgggggctgttttgccttgtgactccagcgggtttgtatgacattcttcctctgacgtgctgtttttgtttccttggggctctgaatccacagggcgcgttcccgtctctacatataaaagatgtttttctctctgcgagtgatgagtcactggtggaatcgcctactctgaggcagtatgcagtcactaaaataaattctaaggctcactgagttcccaggggcaatgggcccggctggtctttgatcacctttaaaagaatcagaacatttaactctccatccagacctgatgttctggccttcattcagaaaggaaggcccgtcatggcaataggcctagagtggccccggagtagcacctgctaaagctacctcacctgagggggccaccaaaagcctcttcctttatagcttagtgggtgggggtgggggacactacgacagagagttgcaggtacaaattgattaccagtcctggtcctgctagatgtagtggccactcccatccaagggcactaatatttgggacaggaagtgagccacctgtagaggtggttggggctttgaccttcaccccagctcctggccacagactccattcatacctgatgagagaccagagcatcctgcctggggctcctggagtcagggaccctaggacattacttccacatacaagctgggcagcacagaaat

SEQ ID NO: 44737 - DNA, 1105 bp, Homo sapiens
gcctgaaggactaaaacactgtaaaagtgaggttccagaaggagagaataaaaagtatagaggagaggcaatattcgaaaagatgatttcacatgatttttaagaattagtgaaagacgtaaatccaaagatacaggaagcataacaagcatggggtaaaaaaaaaaataaaaaaatccacatctagacgtggtgaaactaaaaatttgaataaccaaaaaagagaagatataaaaagcagcgaaagagaaacttccacctctggccatcatggaggactgagacaggcttctcacatcacaaacaacttgaaaactggacagatttggaaacactcttttcagacattggaagacaggcagtcgaggaccatgatccctgagagaatggcagcaaacgaggtgggccttatgataacccagctttctggattgtgaggcaggaaggggaaactcaggcagaacacagtggtcttaatgatttggggccacagggatgacaatttgtagtgcaggtgtgggacatttgtgggttgcagtactggagatgagggagctaggcagagaaagagttctggaaatctgcatggagtcaccttgaatatgttgctgtagggtgaaactccacgaggacagacaaagtacatcgggaacaaccagaaagctagagtaaaggttactccagaatctcctaacagagttttagaacaatcctggaagggagtatgctgatcagcaggtaatttaatggcctgccagaacaaagtccaatattttttaagacaaccacattcggcactcaataaagtaaaattcataaaagtccagcatccaatcaaaaatcgctactgaagtgaaggagcaggaatatatgaccaataccaggaaaaaaattgatcaatagaaataatatgacagaaatgatggaattaccaggcaaagaatttcaaacagttactatacatatgctcaagaatttaaggaaaaacaaggccataatgaagaaagacatagataggaagtgaatattttagagctgaaaaatacagtattcaaaataaaatgttcaatgggtagaaataaaagtagttagaaatttccagttt

SEQ ID NO: 44738 - DNA, 1055 bp, Homo sapiens
ccttatggatgaggttttacctccccagaccctggggagaaagcaagcatctttaccctgccccatccattgatacgtggccttgtggctttgcacatcatctgcagagctcagccagtctccctgctgtgggcacaggctgcacatccggaagctgtgtgagctggactgccgggtccagtctcctgcccgaggccttgggtcacccatgtgccgcctgctgcttctttcacccttgacctctggggctttctgctctttctcttgagctcagctgtgtcttttaaaaatgttgattttgaactagtttttctgtgtgacggcagtgggagaggcactggctgcatcaatccaggcccccatattcttggaaacaggccacaaaattcaatctcaccaggactgatgttcaagcacaatttttgttttaagtaaatgacacccctttaagtggcctggagtgagtctggactttaaaaaattagttcatgtgattcattcaattatacttttccccaatgaaatgttgaactgtagcaaaattcttggcatgagcattcttttctattcttttaggcataagctaccactggggggtgagccatctccagcacagcgcatcagtctttccagaggaggatgaggctagagagctcagctgctagagattctcctcctcactgggcaacttagggttataacatttacagtatctgtctaccgtaactttatccaataatttcactctttctttccagggatccttttttagtttgttggtctttcatgtagtgtctctgctttctttaataagttgattaaactgaatatccatgaaagaccacttttttttttttttgcagcataactaaattttgaagatatctcaggaattctttgggataaatggataactacataaaactatatctctgagtatattgaacaatctcaagaaaaatattgggcactgaaaattatttgaattctctttcttttctgttttgttgaatttcattagaagcttaaattctaaaaatgaagcatctatcttg

SEQ ID NO: 44739 - DNA, 1070 bp, Homo sapiens
gcttaagaagaaagctgcgggtggtactctaagagatctgttgtataaacattatcacaaaaagagtgatgatacctgtgcttatccaaggaagagcagcccaagatggatggcaatagcggactatttaagtggaagacattgatatgaagggaaaatcttatattttgcttgtgtagagcgcaattcacagaaagtgttcaaatactagaataggcagttggagtccagcttgtggaagatggggttttcttcatgatgacactagagatcatgatattggatactagtgctggccctgtatttttatttatttatttatttatttatttatttatttatttatttatttattttgagacagagtctctgttgcccaggctggaatgcagtggcgccatctcggctcactgcaacttctgcctcccaggatcaagtaattctcctgtcttagcctcccgaatagctgggattacaggtgcccgtcaccacgcttagctaatttttgtattttttagtagagtcggggtttcgctatgttggccaggctggtcttgaacttctgacctcaggtgatccgcctgcctcggcctcccaaagtgctgggattacaggcgtgaaccaccgtgcctggcctatggattcttaatgtatcatacccataatatttgaatttgcccacctgcctagtctctaaacactgcactaatgaaagcctaggcagggtcagaatggttcttagttcaatatccttctcacattttagtatcttaatgctctcacatttctcctttgttatgtacaaaatattctcaaagcctactcagtgcctatttgactcttgtctctcttaacacagtccttgacatctaaaacaaacctaaggagcagaaattggtggcatggggttcatctttaatttagttctcaattttaaccttcaccaaaaccatctctccatttatttttcttaatcttctgtattacctttaactttctactcacacttgtatatttatttatttatttattttttctttctttattattattctttaagttttagggta

SEQ ID NO: 44740 - DNA, 1110 bp, Homo sapiens
ctccagcctcggatgtttcctcgctgcacagacctgctcgggaagactcgagaaggccaccccaggactccagctctccccggaagggcttcccctcggattgcgtcttggcccctggaaccctccctctgtatcctctgctgttcctctcttggcctccatttgggttgtggcctggatactctggctcgctgcttcccttctcttaaggatcacagccctgcactgcctgtcgtccggtgcctggaaaccattgtattttttggtctgattttgtagttgtttgagaacttaagtctggtccctcacactccatgcccagaagcagaaatgagtaaagtttgttttatcttttcttaatatgacaattattgtgttggttcaacttatgttgtactttaattagaagaaatttggccgaaaatacaaggaaaatatacaaatgcaagtaattttttttaaacttccctgaaagcagggtctaaagaaattaccaaccaacttagactggatctagaagaaaaggaagggtctttgcagtcttaggactcttccgttccgcgacgtaggtgttaggataacagccataaatggttgtaagactttgggctcagataagtagacttaagttcaaattttgacttattttacaagtgtgtgatttttggcaagctcatcttcctaaaccatgagctccttatttgtaaaggggacattagccactctccagcaacagccctggtacttcttcagtcctgggatgggacgtatgattagcctaagcgaaccagaaaatccaggcccgtgaccagtgacttgatcagggctggcgatatatctaggtaggccaaccaggtggactcagtatttttgtgggtgctactggaaaatttatttaattctaactgaatgtagaaacagcaacagacatgaaatggcagttgtattgctgtcttatcatgaggtgagggcctgaagctatggtagccaccctgtgaaccttggaaggagggttctacaggaactggcagagctgagactgggacgcaacccatgtcctggtgacgtatttgagtcctgaggctggccctcctgttagtcttttctctt

SEQ ID NO: 44741 - DNA, 1033 bp, Homo sapiens
aaatttaaatagcaacaaatcatggagtcttttttcttttttaaatgcagggaaagtgtgctcacaagaaaacttcacctttctgtgacccaaattccccactaaacagtgatatactgggctgtgacaaaagactgaagcttagaccaaatgaagaagaaggcagtgggtacttagtagaagggacagccgccagcccaccagcgccaggccctgcgggctgccacacaaaggccaggctcctgcttcccttgggaggggctgctttcagcaacggggaggaaagcaggggaaacttgtgagactgagcaaagcggtggggtcaggcgaagggttttccctttttgtcaagaatctgacttgggtgaccacagtctggggcactcctgggtgaggtttcaatctcagccggcccaggatgcctgctgtggggaaaacttaacagtttttaaagtgaatcccacctgccttcactcaatgtatgcttttcttcttaaatggaagaaatacagaaataactagaactcagaaagttgtaaaaccttttcttgaaacttattgccaagagtaagtctgaattgaataaactcagtaatagggtcctttttcattaccaccatttaatagcaatcttttctatacttaattcattctttatagaatacttttcagtgttttatcaacatatattctatctatatggagcaacattagacgtcagtatattaaagtgttatctttttaagtgtccccaaatatttgttattggcaaacattctctgatgtaacaaaaatcaaggattaagtagtggaaaacacactaaaaatggcctagaagttaggattggattccagcaggactctgatactttctgcgtcggcctactatgagtcatttgaattgtttttattccctcatctgctaaatgggcagaatgcctactatacggaattaattgaaggccctctgaaatcactaaatgttataaaaatgccaactattgtttataactaaggaaaaatctgaacatgg

SEQ ID NO: 44742 - DNA, 1127 bp, Homo sapiens
gaaaaaattttttcttatcagtgtggtacattccttgtttggcttattttaatataaatataatgtaaaattgtaatatacatgtgtggatttatataatatgcataacatatacacatatgtgcacacacatatattttgttttcatgtgttattggcaaggattggctcaagtgtgatgacagtaagtaacctagttttctttatggttttttactctctaaaacaatgtgtttttagtatttgacacatagtttttaatgtgacaaggaaatttcattctagttctagtgtctttcattattaagaatggctgttaaggccgggtgcagtggctcacgcctgtaatcccagcactttgggaggccgaggctggtggatcacgagatcaggagatcgagaccatcctggctaacatggtgaaacctcatctctacaattagccgggcatggtggtgggcgcctgtagtcccagctacttgggaggctgaggcaggagaatggcctgaacctgggaggcggaggttgcagtgtgccgagatcgcgccactgcactccagcctgggtgacagagcgagactgtgcctcaaaaaaaaaaaaaaaaaagaatggctgttaaattttatttaatatcttttcagtaaaaacggagatgctcatataatttttttcagtcatttcatactttaaatttctttccacgtttgctatttttacaggaagtaatttcaattatattttcacttctattgcataaagttgtatacaacaattttgtaattttaaaatgatttctatttatatgggtacacctccctttctgtgtatctacagaaaaccaacgtcccaggtcaagcagtcaggcagagacagagagaaagcacacgcaagagagtgagactgtgcctgtgtacacacgcaattcactttactgagtccactgattcaaatgctcagctcatctggaaatacccacaggcacacccagcaataatgtttaaccagataacctgagcatcccttagcccagtcaagttgacacataaattaaccatcacacctgggtaatgtgaaattcaataacctagttcagtaaccttttggattccattaaatatgcagggcat

SEQ ID NO: 44743 - DNA, 1035 bp, Homo sapiens
aagaaaagacttcactaactctccctgtagtagaggagtaaaaatgtaggaacaaagttcgacaagcaaaatagattaatttataaaaacagaatggcttgggctaatctcatcctgagtattaaaaacgtatccctcttggtgagatcctaaaacatatgagggaaacaaacacttcctaatcagctatgtctaaaaatatcaaactattatccctccttgccctcctttctattgattagacttctctttccccaaaggcaacttatctttgatcgaaaccaatggttcccaagtatagcaaacaagttttcacctatctgccagccaagaaagaaagaataaattcagtggagtgaaatatgtgtaaggccaaatgtctgcagtgtgaaaggaatatcctttagtgtgcggtcaggtacttttttcttttctggtgttaaaatggtctttcttttacacaatgattctgatggtacgtggtgttttgttttttcctctaacttggtaaggtaagtttaaaaagttggcactgactttgttgaagccccagatttctctcatagttcagcagagtctagaagactgaaaagcactggagtgcagaatcgagatggctggtgggtgggagtggagaatcagccactgacagagagtcaggggagctgacgctgacgtacctttaactttggagtgcgtcatgtgattgatttctcctagtaatttgtgatttcagtttttttaggttaaaaataaaatgaatttgcaacagtttaacgttcaccaacagtgagaatggagatgccacttagaaatgtagctgctggtttcacatgttattcccagacttaaaaactgttgttccccagatcattaagaatttgccatattcaatcttattaattgccacacattttgctttgtaagatttccagtttctaaaattcaaacctcagagttgcatacacatagaagtatggaaggggtgatgaggtgaacgcatgtgaacagactcaggggtggcttcccatacta

SEQ ID NO: 44744 - DNA, 1025 bp, Homo sapiens
tgagacatgagttttcttgttcggtggaatcaatgtctattagatttactcacatttttaccactgacatctcagatttcccgtctggggccattttccttcctcatgcaaggcatcctttagaatttcctttaacgaagacgttctagtggcacactttttgtctggcttttcttttgcctctcgtcttgaatgtaactttcatttggttcacatgggagtctagactggcggttaggtctctcccgacacacggagatgccatctcaccttctgccgctcccactgggaaatctgcaggtcccagggtttgccatcgtctgtcctcgttcctggccacttccaagatgactccgtgctttgtgttctgcaggctcactagacacttaaaacaaaatcatattgggcttccttgggcttcttaaatctgtggcttgtatcttcttcagatctggaaaattcttagcctttgttgcttcaagctgttgcctctgtcccacgtgttctcttttctcttcaaattctgacagtgacatcctgcgccacatcctctcttaggcaagtcacttccctggacccgctttccaggggatgcaaaacgcagggccccccttgcagacctgactcctcagtgagctgaaggcagggcctgactagaatgtgtgtgtatcaagagccaaagtcaaaacagtagagccagccgtgcttagcatccagctcctctgcaaagaaggaaatgtgtgtgccctagtgggtgggaaatacgaattgtgtgcttttggtgattccacgtatgacttaaatgctctaatatttgcacttaaaactgacattctggtgtaaagatgcactgtgaaagtcataaaatttataatttaattttttcttagaataacattaaataaacagcaaataaaaaaaactacatgaccactggagagagaggccacagaagtacatacagctttatacttttagtacttggatggcactttcccatgttttctttcttttaaacagggatc

SEQ ID NO: 44745 - DNA, 1046 bp, Homo sapiens
tgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctt

SEQ ID NO: 44746 - DNA, 1033 bp, Homo sapiens
tcagcagattctcaaaggagtctttggccctaatgataaaattacttatctgagatctctgggttgaagccactgaagcttgttttggtaggactatatcttgtttaaagatcacttcctaggctaaatgaaatggtactgtatttgaaaaataaaacttataattagatatgtattccttttaacaaagtaaagttttattaatatgaatagctgagaaactgtagccaagattgttgtcatcatctcataaccatgtgtgacatatgctgtgtactcttctggtgtctgcattttaacctttttaaaaaagctattttattgtatgttttcattaattatctaccttaaaaaaatattttggtatattactgtcttttaatttcaaacacatttgtcctgggtagaagtggctacagaagagctacttttgagatctcctgtttttatgacaatgtttgtatttggtttttctgttgtctctctaagctgcttttgtagaggctatctgtagtagattatgccattgcattggagggaggattagagttcagctcaaaggtcaactgataatgtaaaattgagtatagtcaaagttattcttgagatcacccataaaaatccttaaatcacccttaaaatacaaggtacataattttatttatacaattttatagacgattgttattacttattctaattctttgtagtttaaattttatatggcccccaaatgctctatccttttttccttgaagaatgttgacattcccattatctgtctcttgaccgacacctgaatgatgtgatttatttatctgtcagtggtcagaaaaatcctaccattcatgtatttttttccagtaaatactggacctggccatgtgctcatttaatagaatgactatttaaactatttttaagtaaaaatacttttacaaatgtgtataggtgaatttaagtaacttcaatgcatatattagatcatcctactgtatttcctgctttgtctttttaccctacaagcctataa

SEQ ID NO: 44747 - DNA, 1018 bp, Homo sapiens
caagtccccctaactccagtggttggtgctgctaatttccacacattgttgagcagctaagatcaagaatggcatcttactgtagctgcctgggtctgagagagcacataggacacaccctggagcagtttcttctcatggtttcctggctgctccttaaatgtgattctgagattaggagagtcaaggtgctctccaatggcctggattgtacagtttcccagggaaagtggaccccagaaggacactcacttacactcttccatatgggggattcattccccatttttggccccaggccacatgggctgcctgttttccttctctttttcagaattcgacttttccttttcaggaagctgcttttgccacagtttatccatttacctactgaaagacatcttggttgcttccagattttggcagttgtgaataaagcttctctatagatattcatgtgcaagtttttgtgtggacaaaagatttcaactccttggggtagatatcaaaaaacatttttcttggatcatatgctaagagtatgtttagttttcttttttaaaaaaccttctctgctgctgctgagatgtgaaaaagaagtaaaaatattaagaaatgaaaaaagaaaatttaactgtcaaagtgtcttctaaattggttgtgtcagcaaaagaaactatcatgagagtgaacagacagcctacacaatgggagaaaattttttcagtctaacaaaggtctaatatccagaatctacaaggaacttagataaatttacaagaaaaaaacaaacctcattaaaaagtgggcaaaggacatgaacatacagttctcaaaagaagacatttatgtggtccagaaacatatgaaaaaaagctcaacatcactgagcattagagaaatgcaaatcagaaccacaatgagataccatatcatgccagtcagaagggcaattattaaaaagtcaagaaacaacagatgctggtgaggtggtggagaaataggaacacttttacac

SEQ ID NO: 44748 - DNA, 1050 bp, Homo sapiens
tatttggatgtctaaatctcttgctatacttgggatcttttcaccatttattttattagatatgttttctaaactttttgatctttcttccccctcaggaatctgtacgttaggtttttatgtagtctcaaacatctccaaggcttcattcttttttgttcctttttctttatttttgtctgcctggattatttcaaaagacctgtctttcacgttctgagattctttcttctattggtctattgttgaggcttttgattatattttatacttccttatattaatttttttgtttcagaatttctggttttttttttttttaaagacaactatttccttagtaaacttcttattcacatcctatattgatttctgatctttgtactggttttcagatttctcttacatctcattgagcttgtttgaaattagtattttgagctttaatctggcattttgagggtttttttttttcagttaggatctattgctggagaattattgttttcctttgagggtgtcatattgccttggctttttcaggccttttgtatctttacattgatttctgcgcatccggagcaatagttgctgcttatttttaaatttactttcattgggaggggactttttttcttgactatgtgaccatgatgtgtttgggcaggtagggctgtttggctttgtttcaggatgtgcagtgataaaaacgctgcatgatttctttggctataaatagcctttgtggtagctgtgggtttgttggtgttatggggcggttattggtggcagctattgtgaagttgtactggggactggaatgcctgatggatcccttttcaggtttcattggtagcagtggtgggctaagcatgtctgttcttgtgccatgggacagtgtattctggcgcctgtgttggcagttccaggctatttcttgggcctctgtgtagctttcctggatgctggttgtagttgtgtatgctgaatgggtaagtgggccctcagcccccttgtaacccagggtggcatgggtcatggtggtagcag

SEQ ID NO: 44749 - DNA, 1034 bp, Homo sapiens
agttcttgtttaatgagtatagattattcattttttaggatgaagagaattctggggatgggtagtaccaatggcgaatatacttcctatcactgaactgtacacttaaaaatggttaaattggtccatttcatgttatatgtattttatcacaattaaaaaagaaaaaagagtaactaaatgggtacatactacaacatgaatggaccttgaaaacattatgttgttatattgtacgattccatttccatgaaatgtccagaataggaaaatccatagacagaaagtggattttttttggaatatatccaaagcccttgaactgtttatttttaaatagttaattttatgttatgtgaatttcacttcaataagttattttttggctgggtgtggtggcttacacctgtaatcccagcactttgggaggccgaagcgggcaggtcacttgatgccagtagttccagaccagcctggccaacatcgtgaaaccccatctctactaaaaatataaaaattagccaagtgtggtagcgtgcgcctgtaatcccagctacttggaaggatgaggcaggagaatcacttgaacccaggcagcagaggctacagtgacctgagatcgtgccactgcactccagcctgggtgacagagcgagactctgtctcaaaaaaaaaaaaaaagaaaaaagtatttttttataagtcttttactcagtagatactcagtaaatatttgtcctcttctccgtttccttggcgtggcagtctaatgccagggcctaattgtttttagtaagtcagtctttatgtgtttgcatttgccttcttagtgccaggcacttgataaggggaggcaggtggaaggacttttgaaagtcgcctttctggtgtatagagtcctaacctggggcacctcctttgtcccttctttccattcagagtctacttgttatttaagggctagttcaatccccaccacacacacacatgcacagtggaagtgtgatcttgtcatttccctgctccaaatgctg

SEQ ID NO: 44750 - DNA, 1027 bp, Homo sapiens
gagagctgagtatatgattttagtattttattgtgagagtagtgtttgtgaagtagattctaagcggatgtccttttatttgagaaggatagagaaagaagacatcaaaccaaaccaaaagaaataaggacatatttaattttccaagtgagaaagtttgactgagccataccatggagacctgtctctggagaactttcctcaggaagatcgcagccagttaccatccatgctggagggcttaggcgtgcacttctttgaaaattagcacataaggttctttcctggactctaattataattctctttcattggattttagtctgtcttcaagttcacatactctagttctggacgactaaatttaatttgcctccagattagaacaaaatgaaattgttgcacgtaaatcctcatgactaaaattgattcgatatttgcaaatacagttttccatctctaagctttggttcccattgttcccacagtcttctcccattcacctttctctatctatccaaatcttttttattctctgaggcagagtcaaatcctgcatcacacgtgaaggtgtctcagagtcttgcactttcaaccttgtattatacgtacctgtctgtattgactttctcatgaaactttatgttccttaaaggacaagacttgttttctgcatctttttatttttcacagcatctagttaataagtatttttgatgttaataagtattttgatgtcagtgggtgccaccatgttgagtgtatattgtgttctagaatagatgaactaagatactccatttgtcttgcttttgccctggtggtctttatttccatattctaagcttttctgaccaaatattttggtttgctattaatattttaaaagaccattacaacagtagccaagaggtggaaacaatcaaagtgtccatcgttggatgaatggatgatcagattttggtacataaacaataatggaatattcaggtaaaagaaggaaggacatttaagtgaaataagccag

SEQ ID NO: 44751 - DNA, 1032 bp, Homo sapiens
cctacttaaaggggagaagttattttacacacacacacacacacacacacacacacacacacacacacagctatttctttaaacttaataagtagttgagatatttagtatctagtttaagtgatcataaatattaattgatattttcaactcctcttatttactatggaagaataaacatgggatgcattattacaaaagtttagaggttttggatttctggtgctttttaaatcttacaattaacattagaaatagatgtgataaaagagatcttaagcaataatctggccttaaaaatgtagtcagaagtatccaatatgttaattattttttgcttgacaggcagagccttttgaaagtaacagctgcaatcagtaatgtaaagtgcattatctaggtgtcaagtaatttaagtattctataactatatctgtgctaggtactgtaaacatcttctagaacttacagatataactttatttattttaaaagtgtgttattctttgaaaattctgtactgaatagtatcattaagaaatcggcaaagtacactaggtaactagaatgcacaatcatttctcagaatgttactgggtttgattgtcatcctgctgtttaactgcccaatattctttctcgtttctcataacagatcattggaaattgtgtgtccatcttggttttgagctctgctctgcctgtgatgtcgagaacactgggtaagtttcagtgagaaattttcacttaaagatccatgtttttaaaaactgtctttactgaacttatttaacatttactcataaagattacctttgaaatacagtgtttcttcctacattattttacacttttacttctatactttatgtataggggcataccaagacaaatacttttatcaaataatgactacttattttttaaacacttaaaagcattctttctccaaacaacgggctggtttttgttgtattttgtttttactgacacatctataagttaggctttcgagtcctctagtgaggaaac

SEQ ID NO: 44752 - DNA, 1115 bp, Homo sapiens
tggatgtgctttcctctgaatcacagcaacatttcttgttatttttgattagcaggatttgccatgtgttattttagattttaattaaagggctacctgttctatagtgttaggggttctgttttacttctaaatattttttgctttgaacagggctgtcttcatcggtggaatacaacataatggagttggaacaagaacttgaaaatgtaaagactcttaagacaaaattaggtattgtactttttttttcttgacttgtgtattggccttggtttcttattaaagactttactgtagtctgaaatattagaaaatttatgaaatctttatgttaaaacttttgacctgcccaaaatcattaataaagactatcttacagtttggggagaggataagtttacatttattcactttttttggttttatatatatacaaaatgacttttcaaaggttcacaggttcaaagatgttgctccattgccttctcacttgcattatttccaacaagtcatctgtcatacttatcttttaatgtgtcttttttctgtatctgcttttaagatgtctttattgttgattttgaacaatttgattgtgatacgcctcagagtagttttcttcatgcttcttagagctaggaggttatagttttcaactaatttggaaattttttgaccattacttctccaaatattttttcttttcccctcatgcttcccttttcagggactccagttacatgtattttaggctatagctgaaggatgttcctttatttttcagtttttttcttgctgtatttcattttgattagcgtctatagctgtgtcttcactttcaccaatcttgtgcatgtctaatctgcctttaatctcatctagtggtttttgctttttttttgtttttctaccatctgcagttttcatctctgggggcctgtttgggcctgttttgtatcttctattatgtctctaacacgttcaatctgtgtcctccctctttgtgaaaatatagaatatagttatgacaacacttacaatgtttttgtctgctacttctaacatttgtgttagttcttgatatgttttgattgattgatttttttacctca

SEQ ID NO: 44753 - DNA, 1076 bp, Homo sapiens
atttgtaatgacatcagtttaggcattggtctacagcctcattcctgacgctgtttattcagctttgggactccttgaaatagcagctgtacccacaggaccttttacctggtgttgcatggctcacagttcacaccatcatgatgacattccttcatgcttccgctcagaggagagggagtgacaacctagccagcagtgggctcagcctcactgcttacctcagcctgcagactgtcaccagcagctaggactgcttggggtccctgctcctcctgcttgcccaccacttgggtgagcacactcactgctattaatagatcccaggagtcttctcatatcccttaagccaatctgcatgggcccctcctctttcttttccagaaagccatctattagtcccctatccttgttgccaaaaaccgtcaagaactgtgaaaagtctgagattttattctgcttgcaaactaacaagttagtctccgagtttcatggatgctagttgtaaacctgagatgtctgggtcagagacaaaggacttggttatgcacagcacataaccgagtgcacaagcttccttttggtgccagttgcccttgaacccaagccccacagtgggcctgtatcacagctggggaacccaccatatttatatcgggctgcaagcaaccctgtctaacctttgcttggaggtgaacattgtgctaccagacagtaaacaaacctctcctttgcttcagagatacactatctctaaatcccaaggccatctgctgtacgaccttaagaagacagttccaaataaggtctgtccctgcctctgcttgtgagatgtacagaaatgtgagagcgccgtggagattgtctcccagcacccaggcacatacctgaagaaaacaagtttaattactaagaaatagttcttaccagaatatcaaaggaagtctaaattttatggtgattgatttcccaacactgattatcatcctaaaaattattgttacagtgttataattatttaacattacaatgacaacttcttttggacagtgggttttaaatggttccaaggagct

SEQ ID NO: 44754 - DNA, 1032 bp, Homo sapiens
ttggtatcagaatgatgctggcctcatagaatgagttagggaggtgtcctttatttttaaatttttggaatagtttcagtaggaatggtaccagctgttctttaaatatttgataggattcggtcatgaatttatctgatcctgagcgttttctagtcagttggctttttattacagactcggtttcagaactcattattcatctgttcagggtttgaatttcttcctggttcagtcttgggaggctgtatgtttcccggaatgtttgtatgtttatccatttctgctaagttttctagtttgtatgcatgaaagtgttcataatagtccctgatggttttttgtatttctgtggggtcagtggtaatgccgtctttgtcacttctgattgtgattatttggatcttctttttatctttattagtctagctagcagtctatctaccttattttttctttcaaagaatcaactcctggtttcattgatctttcatatggtttttcgtgtctctatttcattcagaacagctctgattttggttatttcttgtcttctggtagctttggggttggtttgctcttgtttttctagttcctcaagtcgtttgttttcccatttattgacagttatacttggtattctttttaaaatcttatgtcttgattacatttttttcatatttctaatgtgtttttgctactttattttgttgatttttctagccagacatttatcagaattcttttgaattctgaattcttcgatttattttttcctacttttttgctcttttttattatacttactttaatttcctgttgtattttgttttatttatttgtttctgagacaggatttcactctgttgcccaggttagagtgcactagcgcgatcatagctcactgtaacctcaaactcctgggctcaagtgatcttcccacttcagcctcccaagtagctgggactacaggtgtgtgcttccatgcccatctcattttaaaatttttgttagagataaggtcttgctatg

SEQ ID NO: 44755 - DNA, 1124 bp, Homo sapiens
taacaatctcacacatggcatgccataaaggctgtgttcttgaagcttggtaatatttttatgatctcaagaaagatagtgataacagcttatagattttgagtacttgtatatttactagtggaagctgaattaacaaatgaaatttctgactatagtctcatcatctctcttctctctagctcaaagtttttgaaggtaaaaaatttgccaccttgcatttaatgaacatatttatctttttaaaaggtttatgtaaagctcacgcatgtggtatttaattgattttaagttggacaggttttgtctcatttaatcacagaaagaaaataaaattaacaaaagggaaaacttaactatcctagcctcccagtggattaagtcagaataacagctctttcttactatatcagttatcttaatatttcataggacaagcataatcatattaaataattttgatggcttgtaccgtggcagccttttctattagtattgttgatttactcttgtaatgtagatcgataactagaaatgagcagatttctttttgtgagttatttactgactttcaaaagaaatattgactaatttgaaataactttttgaacaatttatatgattgactacagagagttcttttggctaaatgtttctgaatggactgcttaaacatgtgagtatgtatttcagacagttcttgttattatttgtgtacctataatagaaaaatcatcgtcttggatgggtatggtggcagtaggaaaagaagggatgaatttgagttgtaattacacagtagaatcagaagcacttggtgtttgactggaccgaggctcagggtgtatggtgggggtagggtatggggttcagcaggaaaggtaggtgacaagggtgtttccaaagtatctggcataaacaacaaagtgggtaatgatgtcatgttttcaggtatgtgatattgaaggaggagcagagatagagaataaaatgatgagtttggtcttagaattaagtttaaggtactggtgagatgtctaatgaaagacggcagttggtgtatatggttcttggccacagcagtaagatttggactaaagatataaacttcagagttgttggct

SEQ ID NO: 44756 - DNA, 1535 bp, Homo sapiens
aaaataacaaaaaataaacaaaatacaacaagaagagtgataattacgaaggtattatctgacaaaaaagactttcatttctgaagcaaattctacacatacactttgatgatgaagttgatgagctgacatggcctgatctcttacaccattgaaggagctgtcttctttctttcctgttatgggtaagagcagtgtctagaagggataggaatgttttcatgcactacctgtacatgagtcctaatgaaactgcatagcggcaaataaaactagaaagtcaagctcagctgaatttaaaaatagattattcaaataaaaaaatttaacaaggatgctgggtacaaggattaatatatttaaaaaaatcaataaataccagcaacaaactgaaaatcaattataatagcaagacagcctaaggtatgttgaaataaatctaacgaatgatatttaaagcctttatggaaacaataatggaaacaaaaaatcttattgaaagatgttggttggacacagtggctcatgcctataatcccagcactttgggaggctgaggtgggagaatcgcaggaggccaggagttcgagactagcctgggcaacatagcgaggccctgtctctacaaaatacaaaataaaaaaaattaactgagcctggttggtgcatgcctgtagtcccagcttctcgggaggcaaaggtgggaggattgcttgagcccaggagtttgaagctgcagtgagccatgattgtaccactgcacttcacttttggtgataaaggaagaccctgtctcaaaaaaagaaagatgttgaagaaaacctaaataaattgatagatattctgtgttcataatttttagagtttttgcaattctaataaaaattctgcaaagttttcttatagaatgtgacaagcaggtagtaaaaatttaatggaagtgcagaaagccaagaatagccggagcaattttgaagaactaggtgatggaacttcctctatcaaatattacaagataggcaaagaaactgaatagacatccaaagtctatccaaagaagatacacaaatggccaataagcacataaaaagattatcaccatcactaatcactagggaaatgcagatcaaaactacaatgaggctaggcccagtggctcattcctgtaatccctccattttgggaagctgaggcaggaggatcacttgaggccaagagtttgagaccagcccggccaatatggcaaaaccctgtctctagtaaaaatacaaaaattagctgggcatggtggcgtgtgcctgtaatcccagctacttgggtagctgaggcgggagaatcgcttgaacctgggaggtggaggtttcagggagccgagattgtaccactgcactccagcctggatgacaaagtgagaccctgtttcaaaaacaaacaaacaaacaaacaaacaaaactgcaatgagatacctcctagtaggatgactactagccaaacccagaaaacagcaagcattggtaaggatgtggaggaattg

SEQ ID NO: 44757 - DNA, 1141 bp, Homo sapiens
atatcagcagtaaggctgttttgctttcttgtcatttgtgtgttcactggagtagcactttaatttcctttaggaacttttcctttgcattcacaacttggctaactggcataagaggcctagctttcagcctatctcattttttgacatgccttcctcactaagcttctagcttttgattgaaagtgagagatgtgtgagtcttcctttcatttgaacacttagaggacattgtaggattattacatggcctactttcaatatcgttgtgtctcagggaatggggaggccctaggagaaggagagagatgaaggaacagccaagcagaggtgcagtcaacacacacaatatttattgattaagtttggcatcttttatgggcacaatttgcagcgcccccaaacaattaacatagtaacatcaaagatcactggtcatagatcataacagatgtaataatagtgaaaatgtttgaagtattgcaaaaattaccaaaatatgacatggagaaatgaagtgagcacgtggtattgggaaaatggcacagatagacttgttcaccacagagttgtcacaaaccgtcacacggtatctgcaaagcacagtacagcaacatgcaatcggctttaggtatacttgtagtagataacttcttttttttttttttgagatggagtctcgctctgttgcccaggctgtagtgcagtggtgcaatctcggctcactgcaacctctgcctgctgggttcaagcaattctcctgcctcagcctcctgagtagctgggactacaggtgcgcaccaccatgcccagctaatttttttttttttttgtatttttattagagacagggtttcaccatgctggccaggctggtctcgaactcctgacctcgtaatctgcctgcctcggcctcccaaagtgctgggattacaggtatgagccaccatgcccggccagtagataacttttaaaaatgtttttttaaaaagactatgagatatttaattggaataaaactatcttgtgtaaaatgaatataattcgtgacacactgacctttatctttcataacacaaatgatttgaaacggtcatgtatttttcaccacgcctaaataaagcaatagattaacaaccat

SEQ ID NO: 44758 - DNA, 1596 bp, Homo sapiens
taatgcctagggtttcttctagggtttttatggttttaggtctaacatgtaagtctttaatccatcttgaattaatttttgtataaagtgtaaggaagggatccagtttcagctttctacatatgactagccagttctcccagcaccatttattaaatagggaatcctttccccatttcttgtttttgtcaggtttgtcaaagatcagatagttgtagacatgcggcattatttctgagttcttttctaaagtgcagagtcagtggctgactgggaatcagggggaggtggggagtggcagggggcagggattataaaaggatatgagaaaatttgggggtgatggatgtgtttatgttcattagcttaattgtggtgatggtgtcattggtgcattctcatgacaaaacttatcaaattatatactccatgtgtagcttattttatgtagttcaataaagctgttaaaaattaatatttcttatatttgtatatgttataattttgttcattttgtactgacaattgagaattaattctgagactacttctttagttcagcctgtgacctttttcctgagagagtcttttcctgttaacatttagctatatggattgtaatattgtttgtttatggaactcatttttattgattactcagcactgtagcaggcattgggaaataaaaaatgaggtgtagaaatatattcatgcctcatggacctttgatctagagatttgtaatcatacatttgcaagcatctctaaagaatataagaagtttaggggccaggcgtggtggcccatgcctgtaatcccagcactttggaaggccgaagcgagtggatcacctgaggtcaggggttcaagagcagcccagccaacatggtgaaactccgtctccactgaaaatacaaaaattagcctggcgcagtggcgcgtgcctgttatcccagctactcaggaggctgaggcaggagaatcgcttgaacccgggaggcggagattgcggtgagccgagattgcgccattgcactccagcctgggcaacagagtgagactccatctgaaaaaaaaaaggttaggaaatggtggaatttatgttgcctaaaaacattacagcatattagaaggaatagcttaagtttttcttgctctgggacaagggcacgtttctgaacctgaagtccgtctgtaaaacgggggaccttccctcataaaatattaaggtggtagctggctgagtgcagtggctcacatctgtaatcccagcactttgggaggctgaggtgagtggatcgcttgagcccaggagtttgagaccagactggacaacatggtgaaacctcatctctacaaaaaatacaaaaatcagcctggcacggtggcatgtgcctatagtctcagctacttggtaggctgaggcgggaggatcacctgagtctgggaagtcaaggctgcagtgagccatgatcacaccactgtctcagaaaaaaagatagcatcttaacgtatccagaacaatgcctactatgttacatacctaacagtgacaggcataccttggagatactgcagggttggttccagtgtact

SEQ ID NO: 44759 - DNA, 1025 bp, Homo sapiens
gtgagctaaacaaacccgagggaatatatcttaactcatttcctaactctacaaaatgaaatgaagagcactagaagcagcagtttatatgtagagaagctttttaaaaatcctgtgtttagaaaagataattggctgtttaaaaagtagtaacaatgtattatgaattttattatagatgtacaagtaagttatatgacaacgataacacacaggaggaaagccacggaagcacactgttgtgaagttctcatgctctacgtgaagtgttatctttttttttctaagtgacagcaagtttattaagaaagtaaaggaataaaaggaatggctatttcattggcagagcagccaataaaatcatctgaaggcagattgtgatgagttaaaggcgtatatgataaacctgaagacaaaccagaaatagcccaacagagatatagtgaataagtaaacaaaggaaataaactagaatcataaaaaatacttaatctgtgggaacatagaagaagggaagctaacacatggggcaaatagaaaacaaaaagcaagttgatagatttaaagctaactatatcaataatcactttaaatgtaatgttctaaacactacaactaaaaggcagagattatcaaattgaatataaaagcaagactgaagtatatctgcttgcaggatacccactgtaaagacaaaactaggtcaatggcagtaggagaaaaaagatacaccatgctaattttaaacagagcaaagttggagtggctatatgattatcagacaagggcaaagaatattaccagtcataaagaagatcatttcatcatgttgaagtggtttgttcacccaaagagcctaatgatacttagcatatatctgcctaatgacatatattaagtacatgaagcaaaaacggaaagtgtagtcagaatcacaattacattcagatatttcaacacccttctttcaataattgatagaacatatagaagaaaaaatcacgatatagaagatttgaataata

SEQ ID NO: 44760 - DNA, 1055 bp, Homo sapiens
tttgtaagttgtggaatttgtgaggaatttattgagtctcttttaagaaaaagttcagtttatgggtgcgttggctaaggggatcttaggttctcttctgctctgtatcttattcttggtgcactaaaataagagcaaggttttatttattttgaacagattttaattttagattcttacaattgtatctgttctgcttaagtattgaaataaatatgtattttagttcgttagaggaaagaggttatttcagtctaaaacaattctttgtctggaaaagataaaaaaaaactaggactttttttcttcaagagatggtgttttttctgaatgtggattcaaagtagcaggtattgaacagtgtaaaggaacttaaccaaagtgaggctttgcaattatttcattattattttaaaattttctaatacaacatcatttgagtagactttattttctgagtgtatcaaagaacataatagaaagaatgtgggaaaaggagaaaaagaataagcttgatgatatctgtgaagcatcttggaggcccactgtagaaatgtatactggaatagttaggttttaggaatttggggcaagagaatgaagagaacgtatatttcacaatagggagcagtattccatctagtaagagaaaactaagacataggagttgaggcttactcttttagtaataaacagactttgttttgttgttgagttgtatgttgagagaattaaacaaggggcaaggatatcaataagtatttggggaggccaacttgaaatagagtaggtaactacagttttaaaacattttttctatgatcagcaaatccattaggatagataggtagtgaagaacaagcactctttgctgatgttttatgcccagagctttttctgtattattgaggactaaggctcagacgtggagtatgaaaaattaggccaggtgtggtgagcctgtaatcccaacattttgggaggccgaggtgggaggattgcttgaagccagatcaagaccagcctgagcaacaaaacgagaccctgtatctaca

SEQ ID NO: 44761 - DNA, 1054 bp, Homo sapiens
gcctgggcaagaagagtgaaactccatctcaaaagaactaaaaaacagcagctatagtttctattttatttatttgctagtagtttctttagtcatttcaaaatatagaaggggaaaaacactctatgtcaagtacaaatagatatcatggtgtattgctttgtagtctttgggaaagccactgtcctctcaccgcggcttcctgttgtcttagttgggatgataaataaaacccagcttgtttttgcaataggaatgatgtatgtaaagtaattgtcttttagtaggcacttaataggtggtagctattatgatagttatttaggctgtgaggtgttttctttctgaagaatcttactgtttttacaaatcaatttagtgtatgtaaactgaactcttgtctctcatagaacatgctggcataattcttttttgagttctaatttatttttattttttaatgttttaattttaatttttgtgagtacatagttggtgtatatattaaaggcatgcaatgcaaaagactcacatcagggtaaacagggtgtctatcacctcaagcatttattctttgttaagattttgtaattatgttttagaattatagctcttaggaatttggatatctttcttgctcatcatacccatacccgtctctcattttattagtgttgatttgtgttactagtaactatattactaattattattttgttaatgtagttagttggtgttatcagtgttaatagttattttaatttgttatgtatttcaatttcttcatctcattttaaggtaaaagttttttgaaaattttttttcttagtaagaaccttatgagttaatggtaaaatgtcctcctttgacaatatttaagctaagttgccatttgacttaaatatatatcagagatagcttgtttccattaaatttgtattataggtcagtgaatttggaatttctgagttaacataaggacgtgttaggatctcaaatccagggaaagaaatggaataacttgcttgtgtggtagcgttacagctaagtatgc

SEQ ID NO: 44762 - DNA, 1034 bp, Homo sapiens
tttgtcttttacccctaaaagtacattgaatgacaatagggtgatgtgctgtttccttatggtagatgcccaggagcatcttacctgcttttggggcagctggcacagcacgtgcgaggggtttgggttttccgagtcacgggtggtttctgtatcctggggatgcatacagaaatcctcttcctgaaggtcagtgggttcgtataaagtggtgatacagttaagggaggggcatggggaagagggtcacctgaggaggagtctgactagtctccctcatctttcttccctgcccttattgatctctttgtcttttgctgtggtagaatgagtgagaactgatgagttagggtgatctgggttcaaattctggacccatgattaacttgagtccagaagagatggagaaacaaatattcactttctgtgtatgtaaaacagagttctcacctactttgcagtactgttgtgtggattaaatagcatttgccaaaaaaaaaaaaaaaaaatctagggtagggtgcttgatacaattaggggtgaaattaatgtttcctccaccgtagcgcttttgacctgttttgtctgcttagaattcttttctgtcagatatcccactgaattaactctcaccttatttagttttgttttgctttgtgtttttccctaagtctcaacttttcagtgaggccttccctaagtgccacacttaatattgaaacctgtgtgtcctcctccccatttccagtcttccttaccgtgttttcctgtaacacttatcatctttagtttattatacatttacatatttaatgttttattgtttattgcctgactctctgcagtccaggataagccctccttgggcaagaatgttcgcttgtgttcgttcactgttctcaagtgcctagcacagtcctggcacgggagcaggcactctgcaaatacctgtatagtgagggagccccacctgaaagacccactgaggtagaatctccgagatgggctttaacaaaagctccataggtgatcct

SEQ ID NO: 44763 - DNA, 1381 bp, Homo sapiens
ggttcaagctattctcgtgcctcagcctcctgagtagctgggattacaggcgtgtgccaccacacctggctaatttttgtgtttccgggtttcgtcatgttggccaggctggtgttgaactcctgacctcaagtgatccaactgcgttagcctcccaaagtactggaattacagacgggagccactgcacccagccttccctggattttatgaaatgattgtgtttcacctttaaacataatttttaaaaaattcagaaacatcctttgatcaaaacattctattcttgcagcttccttggtcaagtgctttcgttgcagctacttctgtaccgtgaacattaggtgattgaagtctttgtttctcctgtccatcagcctacccttagtttcagttttctcctaatctactttggtatcatggccagtcacttcactcactcttgctaataccctaaaccagtgcttctcacactgtggtcaggggcttccttgggattgatgttgaaatcctgggagtatttgatgttacctatgaagagcttgtggagtaagaatagatgggtgctcatcccagaaattacagagaagattgtttaaaggctggcaggaaaagggaagcttgtgagggagactgggagaacaacagagagggaggaagactgctgacagaagttgctgcatagagctcagcaaaaatcatgaagtgtaattttcctgttaggtttactgaccactttgagttggtcgatgagtgtgaagtttgatgagtggctggaaggagtgagtggtgaaaggtagaagtctgcaagcacaggctattattttgaagcgcttggctggaaaggggaggagagagctaggatatctgttagaatcatcaagcttctagtatttcttggggactctacctgcatctgcctcagcatctaggaatctggctctcatgttttacagcaccaccaggctgccagcactgctgagggttttagcttggacttgcctggaactttaaaggccatttaatcttaccttgactcttatttctattatatttgctccatttgttctcccatatgatttacatactccttctggaataggaattaaaagaaattaaaaactgtgtaagcaaaaactcagttgtatgtcaaaaacccagttccccttgaggaagagaaagggctggagttctttaaaattaactgcctgtttttctttctgaggctagtgagccttatctctccctttcccaggcattgtacagacactgtttctctagctgcgcagctgcaaggtcactcaacagataatctcaagtcttaaaacgtgttattccttaaaaagtaaaaaataatataacgcacatcttaattaaataa

SEQ ID NO: 44764 - DNA, 1039 bp, Homo sapiens
atcatacaaatgttgccatttcaaattgacttctttcacttagcagcaagcatttaagtttcctccatgacttttcattgctttgacagctcttttaatttttaacttttatttaggttcaggggcacatgtacaggtttgttactatgtttcacaggggtttggtgtacagattattttgtcacccagataagaaacgtagtacctgattggtagtttttccatcctctccctcccatcctcaagtagaccctgatgtctcttgttccctatgtccatgtgttctcagtatttagccccctcttataaatgagaacatgtggtatttggtttcctgttcttgtgttagttcacttaggataatggtctctagctccagctccatccatgtcgctgcaaaggacatgatctcattcacttttatggctgcatactattccatggtatgtacataccacattttctttatccattctactgttgatggtcatttaggttgattccatgtctttgctattgtgaatagtgctctgaagaatataatgcatgtatgtgtctttacggtagaatgatttatattccttcgggtctgtagccaataattggattgctgggtcaaatggtagtactgtttttgttttgttttgttttgcttttttttttttttttgagacagagtcttgctttgtcgcccaggctgcggtgtcatggtacgatctctgctcactgcagcctccgcctcccaggttcaagtgattcttgtacttgagcttccctagtagctgggaccacaggctcctgccaccacagccagctaatctttgtatttttagtagagacggggtttcaccatgatcccaggttgttctagaactcctgacttcaagtgatccacccaccttggcctcccaaagtgctgggattacaggggtgagtcaccatgcccagccagtatttctcttttaaatggtttgagaaattgccacactgctttccacagtgactgaactaattgacagttccactagccagtttataa

SEQ ID NO: 44765 - DNA, 1036 bp, Homo sapiens
gtatttttagtagagacagggtttcaccttgttagccaggatggtcttgatctcctgacctcgtgatctgcccgcctcggcctcccaaagtgctctcctttatttttgaaagataattttgctggatacagaactttgggttggtgttttcatttttcgttttttccttttaacatttgaaatattttacagctttctttttgcttgcatggtttctgaagagaagtctgatgcaattctaatctttgatcctctatttgtaaggcatttttattcctgtagcttatttcaagatattctctttatctttgattttctgcagcttgcagcatatgatatgcctagacataggtttttttttttttttttttttgtatttacgttgtttgttggtctgtgagctttctggatctgttaggtgtttgtattaattttggcaaattatcagccattatcacttgaaatattttatctgttgctttctgtctttttttctggtattcctgttacgtatgttatgccttttgtaattgttctgtacttcttggctattctgtttcttttcagaattgttattttttctgtttgcttttcagcttgggaagtttccattgacatatcttctaattgactaattgctatggtgttaagagatggggagaggggaacattgtgtagtcttgtgattaggtctcagtcttttattgagcctatgcctctggtctgtgaccttcacaggtgtctagtctactgatgagctcattaaagcattcttcatttctgttacagtatatttgatttctcccatttaaaaaaattattcttaacatttccatgtctttgctgacattacacacatatttttgaatgttgtttacttttccacctttgcatattaataattaaattcagactctcataatccccaaatctctgtcatatgtgagtctggttctgactctttgactctttagattgtgatttttgcatttgagcatgcttcgtattttgtgggaagccggatacgatgtagata

SEQ ID NO: 44766 - DNA, 1050 bp, Homo sapiens
aggggccaaacaacagctgggtctgttgcttcagaaggttcaagccccaagccttggcagcttcaacatggtgtttagcctgcgggtgcacagaagtcaagaattgaggtttaggaatttccacctagatttcagaggatgtatgtatggaaatgcatggatgcccaggcagaagtttgcttcaggggctgggccctcatggagaacctccgctagggcagtgcagaagggaaatgtggggttggagccaccacacagagttactactgggacaccacctagtggagctgtgagaagagggccaccatcctccagaccccagaatggtacgtccactgacagcttgcaccatgcgcctgaaaaagctgcagacactcaatgctagctggtgaaagcagacagaaggctatcctccgccacaggggcggagctgcccaaggctgtaggagcccaccttttgcatcagtgtgacctggatgtgagacatggtgtcaaaggagaccattttggagctttaagatttgactgccccactggatttcagactgcatggggcctgtagcccctttgttttgtccagtttctcccatttagaatggctgtgtttacccaatgcttgtaccctcattgtgtctaggaagaaactaacttgcttttgattttacaggctcataggcagaagggacttgccttgtctcaaatgagactttggaccatggacttttgagttaatgctgaaatgagttaagattttgggggactgttggggaggcatgattggttttgaaatatgaggacattagatttgggaggggctggggtggaatgatttggtttggctgtgtcccctaccaaatctcatcttgaattgtagctcccacaattctcacgtcatgggagggacccagtgggaggtaattgaatcacgaggcgggtctttcccgtgctgttcttgtgatagtgaataagtctcatgagatctgatggttttataaagaagagttcccctgcacaaactcttctctttgcctgttgccatccatgtaagat

SEQ ID NO: 44767 - DNA, 1060 bp, Homo sapiens
taatattgagatttgaggtactattccattcatcgtgctattggttgcctatataccttgtttttttttttttttaattgtatttttgttttatatgccctgtgagaattatgctttaaagaggttctgttttaatgtgtttccaggatttgtttcaagatttacagctactttagcagttctggtagttctggcttggtagtggcaaattctctcagcatttgtttgtctgaaaaagactgtatctttccttcatttatgaagcatagtttcactggatacaaaatttttggctgataattgttttgtttaaggaggctgaagatagggccccagtcccttctagcttgtagggtttctgctgagaaatctgcagttactctggtttttctttgtaggttacctggtgcttttgcctcacagctcttaacattctttccttcatcttgacttttgataagttgatgacaatgtgcctaggagatgatctttttacgattaatttcccaagtgttctttgagcttcttgtatttggacgtctaggtctctagcaaggcccgggaaattttcctcagttattcctccaaatatgttttccaaacttttagatttctctccttcctcaggaatggcagttattcttagatttggtcacttaacgtaatcccaaacttcttggaggcgttgttcattttttcttacttttttctttctcttattcatttttctttgtctttgttggcttgggttaattcaaaaagcttctcttcaaggtctgaagttctttcttctgcttatttgagtctattgctgagactttccagaaaattttgcatttctctaagtgtgtcctttatttcctgaagctttgattgttttttatttatgctgtctgtttcactgaagatttctttcctcatttcttgtatcatttttttgattgtcttaaattggacttcacctttctctggtacctccttgattagcttaataactgatcttctgaattatttttcaggtaaatcagggatttcttcttggtttggatccattgctggt

SEQ ID NO: 44768 - DNA, 1031 bp, Homo sapiens
agatgatcatgtgatttttgtttttaattctgttcgtgtggtgtatcacatttattgacttgcgtatttttttttttttttttgagtggagtctcgctctgtcgcccaggctggagtgcagtggcgcgatctctgctcactgcaagctccgcctcccgggttcacgccattctcctgcttcagcctcccgagtagctgggactacaggcgcctgccaccgcgcccagctaattttttgtatttttagtagagacggggtttcatcgtgttagccagaatggtctcgatctcctgacctcgtgatccgcccacctcggcctcccaacgtgctgggattacaggcatgagccaccgcgcccggccgacttgcgtatgttaaaccatccctgcatctgtggtatgaaacccacttgatcatggtgttacctttttgatatgtttttggattcggttagctagtattttgttaaggattttagcatctgtcttcatcaaggatattggtctgtagtttgttttattggtcatgtcctttcctggtttggtattaggatgatactggcttcatagaatgatttagggaggattttctctttatcttgtggaatagtgtcgataggattggtaccaattcttctttgtctggtagaattcagctataaatccatctggtcctggactttttttttttggtaatttttaaaattaccattttaatcttgctgcttgttactggtctatttggggtacctaattcttcctgatttaagctaggagggttgtatctttccaggaatttattcatctcttctaggttttctagtttatgtgtctaaaggtgtttataatagcctcgaatcctctcttattttcttggttaatcttgctaatggtgtatcagttttatttatcttttcgaagaactagctttttgtttcatttttcttttgtattttttttgtttgtttgtttcagtttcatttagttctgctctgatcttggctatttctttcttctgctgggtttgggtt

SEQ ID NO: 44769 - DNA, 1043 bp, Homo sapiens
aggtgggaaccaatcaccaatcttgtatgtaagttcagaatgcagttatcttggagtctgtagtcttctgacctttgtcattgccctccagtgaaagacctccaagagcacacctgtagttggacaaattgggcttattgcatatttcagtgagttccatggggaactgtggggtgtttcagtaacttttcaaatgggatttgggcttctactaggtagtttgggaagggtttaaggaagtgaggctttgatctgtatggggtgctgttaggaagctggaaaaattctgtaactggatagcttaagaaatcttttctagaaggaaagaagactggaataaagctaaagctgtaactggtaaagaagcaacagtcattcctgttagccaggatagagagttggtcatttctgtgatttggacaatgttcatgtttttttttttgcttgtgttcaggagtgattacagagtggtcttgtttagtctttatccatcatggtcttgtctgatattgatgttctctgaaattgttgatgttcagcagaagagtcagtcatcaaggcctaggtgtgtgccttgctctgagttgttagccagtttacagcaacaccaaggcccagctgtgatattaccaggccagctcccagatgtcaggggctgcatttctttttctcacgtggttgtaaagtcttctagtggaatgatgtattagaaacaaatccaatagccaacataagttgaagtgattttctaacatagaagagcaaaaaggaatgggatagaggtatagaggtttcatttgtatttgacttttctaaactgggttaaatcagcttcccctctgcggtaggcagcataatggcccctgaagttggtaatccatgtggtaatccctggagcctgtggtgtgttactttacatgggtaaagggattttgcagatgtgagtatgttaaaggagaattaccctgaattatccaggtgggctctatgtggtcacagggtccttataggagaggcaggagggtcagagtcagaggagatgt

SEQ ID NO: 44770 - DNA, 1056 bp, Homo sapiens
aactgcagctcactcactgccagaccctaagtgatccccactctcctgttccacaagccataactatagctttgattggacaagagactgatttcagtaactttctcctgataagagcactgagcatgaactggttctggccagtttacagaggctgtgcacttcagtgccttcatgtccctgcttcgccatctgactacagggcctcattgtaatccttttagatgttaagtctccacccacaagtgaatatggataagtatgtaacatacatgtttattcagcctgcatgtgcatgacctcccccactttgtgaatattcatagctcctcctataacctgttaaatatataaacttggccaacccgttcagcataaatccctgttctatcctcccttgaaggtctgtttctgtgctctgcgggaggatgcttcccagctatcaggattgccaccttgtaggctgtgactctttacaaaattatttttgaggcagagtgtggttccgtcactcaggctggaatgctgtggcacaaacacggcttactgtagcctctatctcccaggctcaagagatcttcctacttgaaggaagtctttttttttttttttttctttttttgaggcagagtctcactctgtcacccaggctggagtgcagtggcactatctcagctcactgcaacctctacctcctgggttcaagcaattcttgtgcctcagcctcttgagtagctgggattacaggtgccaccaccatgcctggctaattttatttatttatttatgatatggagtctctgtcacccagcctggagtgcagtggcacaatctcggctcacgataacctctgcttcccgggttcaagtgattctcctgcctcagcctcccagtagctgggattataggtgcctgccaccatgcccggctaatgtttttgaatttttagtagaggcagggttttaccatgttggccaggctagtctcaaactcctgacctcaagtgatcctcctgccttggcctcccaaagtgctgggattacaggtgtgagtcaa

SEQ ID NO: 44771 - DNA, 1098 bp, Homo sapiens
tgttgcccaggctagagtgcagtggcgtgatctcggctcattgcaacctctccctccctggttcaagcaattctcctgcctcagcctcccgagtagctgggattacaggcatgcgccaccgcacttggctaatttttgtatttttagtagagatgggtttcaccatgttggccaggctggtcttgaactcctgaccccaggtgatccacctgcctcagcctcccaaagtgctgggattacaggtgtgagccactgtgcctggcctcattttttaattttttgtagagatggggtttttgctatgttgcccaggctgttcttgaactcctggcctcaagtgatgcacccaccctggcctcccaaagtgctgggattacaggcgggagccaacgtgcctggcccagaatttgttcaggctgaataatattttctttttgtgtatactgtattttgcttacccattcattcatcaattgacctgagttgtttctgtttttggctattgtgaataatgctgctgtgatcatgggtatgcaaatatctattagagtccctgctttcaattcagaagtagaattgctggatcatatgataattctatgtttaattttttttttttttttttttgagacagagtctcgctgtgtttcccaggctggagtgcagtgactcaatctcggctcactgcaagctccgcccccccggttcatgccattctcctgcctcagcctcccgagtagctgggactacaggcacccgccaccacgcccagctaactttttgtatttttagtagagacggggtttcaccatgttagccaggaaggtcttgatctcctgacctcgtgattcgcccgcctcagcctcccaaagtgctgggattacaggcgtgagccaccacgcccggcctctatgtttaatttttttgaggaactgccataccattttccacagaggctgtaccattttatattcccactagcaaggagccagagtttctggttcttccgcatcttcaccaacacacattgttttctgtttttcttcttttttttaaaatggatgtgaaatggtatctgatgctggatttgatttgcat

SEQ ID NO: 44772 - DNA, 1098 bp, Homo sapiens
gtagctggcaagttttccaagtcccgaaatttgtcccatatgctgaactggaaagtcatctagtatcatagttaaaaggagaaaaaaggcaaacggccacaaattactataatatatcactaacaacataacctaaaggtattttcttattatcttatttttaatattctaaacatcaagacttttagtggtggcctcactgttcttgcctatagagcatagtcccaaacagcttcacaagaatctccttctggtgcagttcttccccccaaatcagcagatactaacagaacattctaaggaaaaggccacagcaaggggcatcagaacagactggtgcactgtgaaccgacgaggtgctcctgctggcctggccacactgcctgcatctgtggcagaagcaggtgacatgaggacatggtggacccttgacactcccctctagccctcccacttccgctcccagtgaaggtggcctggcagccagcgtggaccaggtgacggggatatcaggggcctcctgacttggggaactcctttgcaggtgggttgagccaggtagcctgtgtagaaaaaatagtagagcggacgtaactggtgcctccgcactaagctacctgaaatctcctttcatattcacagaatttgctagccaggaaagcatagaagggattgtaagttttctcttgaaggcagcaatccatgagaacgtgaatgatttctctctcctgctgatccttaagtccaagcctagaaaacagaacagcaatgactggaacatcactcgacttccaaagtttaatggctgatacctttcaggggaacatcttcccgcctggaagggtctggttagaggcgagccacgtaaaggaggtggaggcagcggcagacaccagctaggggcccagccctgtcacaacctctctggtcctcaggttctcctacaatgtggcaaaatgtcagaggagacaagaccatctagggggtcccccgtcgctgcaaaagtcgacagctgtgcccggctgacaataaactgactcaatcgtgtgtgcccttagagctggttcctgctatggcgatgacttcacattttcttac

SEQ ID NO: 44773 - DNA, 1066 bp, Homo sapiens
tgtaatatagttaattagagtaaaaattaatctccccccttcccccactctacccgatttaagaagctatttccagagctaagaaatgaacacctgttggcaaggatgtgggccttgggaattcctacacactgctggcagaggtgtggccggccacagccaccgttgagaacaactcagcagtgtaagtggaattcccgggtcatacaccttatgaatcagaaattcagtatctagaactgaaccataaattacctccattcccaaaagtacccatcccctaattaaaactatatatatatatatatatatatatatatatatatatatatatataaaatttacttctagaagactaatccatatatatctctgccctagaaaactatcaaaaaatcagaaataaacacggatcagtaggataagtaagtatataaactgaggcatacgtatacagtaggatgctacccagaacagactcacgggcgccaacgtggacccactgcaatcttagctgaatgtcagcgagctagaggaggggactaaacgcatggtgacgggaatgctacccacagggaggtgcgcagccaaacaccatcacaggcgcttgcggacccgaggacgcggcgagaccacaaaagcatggtcgaaacacagagaaactcggaatgagagcagcccggaggggcagggcggggggcatctctaaagctctacgcctgagggtgtgctcctgccacgcctctcccgctcatcggtggtagcatctgtgctgttccaggatgagcgcaatgcctgggcgagcgaaaggcaaggcaggggagcggagggggagcaacgcctcctccatgagctaagttattccagttgtcaggatttggcgtaaggctcggtgccctcattttcagtacagtggccaaacttggacaccacacagcaagggacgcagggtgaactggagccggcatgctgatgaactgcacacgacacacagaaacacacgggaagctgtggctgcggctgtcttgtgggtctgggccactgcagtcaacgcccctcaactatc

SEQ ID NO: 44774 - DNA, 1023 bp, Homo sapiens
ctttgggaggccaaggcgggtggatcacgaggtcaggagttcaagaccagcctggccaaggtggtgaaaccccgtctctactaaaaatacaaaaaattagccgggcgtgatggcgggcgcctgtagtagcagctacttgggagctggggcagagaagtgcttgaaccctggaggcgaaggttgcagtgagccgagaacgtgccattgcactccagcctgggcgacagggctcaaaaaaaaaaaaaaaaaaaaaaaaaaagtcaaattaccatacgatccagcagtctcagttctgggtatatatccaaaagaattggaaaaaacaaaaagatctcaaagagacatttgcacacccgagttcattgcagcactcttcacaattgccaagaggtggacgcagcctacgtgtccatcaacagagaaatggatgaggaaaatgtggtacacacatacggtggagcgccattcaggctttaaaaagaagaaaatcctgtcacatgctacaacacccatgaactctgaggactttatgctgagtgaaatacccaattacaaaagacaaacagtggccctgcgtgggggtgccctcctgccgtcccagctactgcggagcccaggcggaaggatggcttgagcccaggggctccaggatgcagtgagctatgatggcaccattgcactccagcctgggccagtgtgagacctcatctctaaaaaaaaatagtaataaataagcaagcaaatgaacaaaaagacaaatgccgcaagatcgtgtgaaatatcagtttagatgagtcaaactctaagagagtagaatgggggttgctagtggttcggagtggggtactggggagtcggtgtttcttggggacagagtttcagtttgggaagatgagaaagttctagcgtctgttgcataatgcacatagttaaccctccggtactaacacgtgaatggtcacaatgattgtaaaaataattttgttgttttttcttccttccttttcctcttccctctgctct

SEQ ID NO: 44775 - DNA, 1071 bp, Homo sapiens
gtcaggctcctgggaaatcaagggaagtctcgttttgaggtcataaaattctctgtgatgtaaccgtgcgaaattatgtaaataaagccgggcaggcctccttgaacacacagagaaccggatcctgcctgcgcctctgcctgtaatttgcgtaatgagaattgtcctgaaaaggcttctagtctcctcaggccttgcccctgccgcccgcaccctgaggagggggcatgccaaggaaaacatttggaaggtgggagggtccctggtgaatacacagacttggaccctgggtttggtcctgttccacctgtcctctctcccttcccttcctcccttccttccttccttccttccttctttccttctttccttcctccctccctctttccctctctcccttccttccttcctctttttctcctcctcctcctccttttctgtcttaaggaggcagtgcagggagacctggaacagcaggaccagctcttcccagacctgtttggatctgagcctgaatctctaggaaggcgcagtgaggagagggggagagatttggttctcatcactcactgctcctttattttattattttattattttttatttattgagagatggggtcttgctgtgtcacccagggtacagtgcaggggtgcagtctcgctcactgcagccttcaactcctgggcttcccggaacctcccttcctggcccccgactggcctcagttctcctcttgcctctgggtcaatccactgctaccaaagccggctcctgtggagaggaagcctcctgcgatgggccctgtttaacagggacactcagacgtctcctagacaaaaaaaaaaaaaaaaattggtctcattaactccaaactatccatttccacttggtggtcctgagtccgcattccttggggagtgggcactgatagtgagggaacagccccgccctctgcagggccaggccttggcgctggggccttgagtgtagtggtacaagcagcaacgggaggggctggggcgaggaccggagccggctgtgggcctcactgccctttggtccccagcc

SEQ ID NO: 44776 - DNA, 1049 bp, Homo sapiens
ccggcgctctcctactcgtacccgcaggtgcaaggcgcgcaccccgcgcaccccgccgaccccatcaagctgggcgccggcaccttccagctggaccagtggctgcgcgcgtccaccgcgggcatgatcctgcctaagatgcccgacttcaactgtgagtaccctgcggcccccgtggatgcgcgtggcgggagggcctcgcgcatcctccaccggcaccgcctgcccctctctgcgcttggctcccagcgagcgggggaagagctgcgaagccgcctcggctctgcccggggcctgcgaggactcgcccggacccccaggcatgagacgggcagcgaattattaaaatggccatgcgcaggccttgccttctcttcctctcttaacgggaaggggcagttggaggtgtgagactgagatctaatgattaacccgaaggctgcaggagaaggaagtcgccgggggaaggcgagccgagagcgccctgaattaggcaggcccgggaatgggggtcagggcttatcaccggggaaaggaacttgggccaggtcccccactggggcgttagagagacccgcggcccctccagggagagggagtgcttcaggagcagcaaacaagagaaatgggcttcggaggcccggggaggcaaggccaaggcccagggaacccccggctcttaccagggcgctgccctcctctggaagggcgttggatccggggtgcgatggccgaggcaggtggcctggcttgaaccagctatggggggactctcaacagtaggtgcctgccctggaatcctgggcgcccaacaaggtaacgaatgcccctccaaggtggggccgagggagcccctgttctccccaccccagagccgctgggcttcgggcagcttcctctccatccgggcgggacacctcgccagaggcctgggcccctcaggctttcctggcacacgcggactctccgggctggggctccggggctctggctctctggggctctggctctccccgctcgccccatcggggtcagctacttatgagtcg

SEQ ID NO: 44777 - DNA, 1032 bp, Homo sapiens
gtccaggtggtccacgtggctgagtgacgacaaggcagctgcagggagggacagatgagaagtcccagcaagaagagtgaccccgatcatccactcccacctcaccctccaaaccctgggaatgccagcgggcatgtcatttggtccccatgccgtgtgactggcactgagctgggaaaagatgtaaaatatctctgatagtctcacctctaactcttcaccctgaaaagtgaaaacactgtttgacatatcagctctctgttctcttctcctccaaactcctcgtttcaaagcaattggaagaggagtggtgaccagtcaacacttggtaattgtggttgactatggaagcctgaatgttctcttcccttcaccaacattttagaaatttcactgctcacaggaaggtctggaaggtggaggaggtagactgagccctccaggctcagttccttgtgagcacgtttggttggtgaagagctggatattaactttgtctcgcacatagactgacccctccaagctccgttccttgtgagcacgtttggttggtgaagagctggacaataactttgtctcgcacatagactgaccccttcaagatccattccttgtgatcacgtttggttggtgaagagctggatattaactttgtctcagacaagcaagtctttctggtatttttggtgccatcaccttgtcagttgttttgttccccttttcttgtattattgctcatgtgcatatagcctgtgggttttaggaagtgaagcatcaaaacattctactttcagtgagcacctttagaacttcggcattttcaaataaggtgctatagaattcagtgtttctcctctgcttatggaagaagacatgcatgtctccatcactgtcctaagtaacctttacagcacttgctggaactctttattcttcctaaaaacttcatcagaaaatcgtaatgagtacatcgttggcacagaatagagaatgctgctgctaagaaaagacctgctacttgggagcgggaga

SEQ ID NO: 44778 - DNA, 1026 bp, Homo sapiens
tgtctgggccctgggctgtcacctgccacagcccggactgccgtctatctgctgcacgagttggtgacgaaccttcgaggcctgacggagaggctggtgagccactttagacaccaccactttctagagctcagctcacacttcctggctggagcctggccgcctgctcccacctcctttactgtgggtgcgggtgtctgcagggggtccttgggaagggcgcagacagaggctggaggcagcagcggctgtgcaaggaacaggggctccgtcgggggagcagtcacagccactggttctggatttccctgggatgcccgggccgtgggtgtgcccgtcctgcagcagctgtgccttggtcagcggccatcacggccttcccctgcagcccccacacctccgccacagtgccccttgcagcgctctgtggatagttgggttgtgacacaggcagagagtgtcccttccatgatccgcctttattgagggtgtggaactctatttttttgtgggagggggagtgatttgactttttattttttaaaaatctgatttgctgcttaaaatgctagagccatgctagtgctttatttttcagtctctccaagttttcaatatgttgtcttttctgccttgagcacttaatgtttaaaggaaaaattctctgaccccaatctgaccagtccctgctgccatgctggccccagcgagacaagtggctgagtctataggaagagtttgtaccatctttagtatgacagatggtgggttatgtcccaacaaacccatcgtaagttgaaagtgcatttttgacttaatgatattttcaactccaaagaggtttatcctgccatagccccatcataagcggggactacctgtatatttacgacctggtttgattggatgtttgggctccagagaaggtgggtgatggtccagagagtctgcgggagaaagaggtaagctgctgtgatgcagcttggcctttggctgccggggcgattggcttaggtaaatggcacc

SEQ ID NO: 44779 - DNA, 1013 bp, Homo sapiens
aggacagagggggcctctgtggggcgggagaggagcatggaagggcctgagctcagagagagaggggccaggatgcacaagggaaatggaggggcttccaggggcagacagctagctactcctctcccattttttcaggtttatgtggacgtgaggtgggcagagtcaggcatttctgcaggtgtctgaacagcggcttttcctgttccatgggggctgcagaatagtgctcccttcttcatccagccagctgttctgaaactttgttgctcaaaatgtaacgtctccgtggcttttctgctttgggagaattactgatggttaagaatgaaatcttgggactggcacaggggctcacctgtaatcccagcactttgggaggccgaggcaggcagatcacctgaggtcaggaatttgagaccagcctggccaacatggcgaaaccccgtctctattaaaaatacaaaaattagccaggtgtggtggcgtgcacgtgtcatcccagctactcgggaggctgaggcaggaaaattgcttgaacctgggaggcagacgttgcggtgagccgaaatcaaaacttcatctcaaaaaaaaaggatggaacctgggtatgttatttctctattagcaagtacaagagactcactagaaaggtggcaggtgtgaacaagcaccctttcaagattttttaatgtacaggataataatgcagccccagaattgagtgtctgggtctgtgctagtgtgcgcctccaggtacagtgacttgaagaacagatgggaagattcgcagacgattacattagccagtaaagctacatgttttaaaatacataattcactacagagtttgtggaatgtggatttgatatacaggtttaaacttggattgatcttatgccatttaatagctaatcaattaaaagagtttacaagtgataagtgctgggactattctcacattgatgtataactggactgagtacctctgaggagagcggaagctggatttg

SEQ ID NO: 44780 - DNA, 1016 bp, Homo sapiens
ccaggatatcaaccccatcagataatccagccaagtttaatttgctcagactggagcaaaaattgggtgtattaactttcagaataactgaaatatattcttaaaggtcatttgtttaacagactactcgcaccaaacttctccccattgttttagtaaatgttgttttttcttctaaatagataaaacatgatatatttggattaattctgtacttcatgatgtaaaaatccaattttattgacttttattcttttttttcaaattggcatagcctgtcatatatgcatatatgtgtgtatatatatatttatacacacatgtacacacacacacactaaggataatgtgaagacatggaagaattgtgatttttggtaccagtatactttatgcattcttttttcatgtaggtgtcctatttctatggaaggtgattgggtaaaaactgtgccaaaaataagttgttagatgattagaagacattctcctccttttctctcggagtctctttgaatgttgcatccatttccttgaggctttgatcatctttgagcagcaagtttagtattctgccagcccactctcccttccccgacatgagggcagagactcctgcagaattttcagcaagttctcttttgatggtttatttcacaatacccagcaggtttccttgtgtacttggaggcctttggaaccaaacccagaggaaagcatgcatccgggccacggggacctcctgtaaacacagcggctaagtgcacgtctcggtcgctgctgctgctcccattagcaagtgattacaaaggcagtgacagtgtggtggcaattgctgcgatctgagggtgctcagttgactggggctggcgtgtctgcaagtcccaaatgcaccctgacttcttacccccggtgcagaaagctgagttctgacaaagagcacaggtcacgccttggttcattctctggggctttaagagaccgttctttctctaggtgagtttaatcttcaggca

SEQ ID NO: 44781 - DNA, 1052 bp, Homo sapiens
aattactgtagtgaaatctggtccaggaggatgggatgggattctattttaaggttatttctttccttcttaggcctgaatagccattgttaaccgcccgggcaccctcctggatccgtcctttggggcttaatgctccagcccgttaattctgctctttaaattctcacaggtgactgctccctgtcagcccctttgtcttaacctcatggtttagtgctgctgtcctcactcctggtgtgccctgcatcatcgggagagctctgctatgggccgttcggggttgagcacctgattccctacgctctggaagtgcacggtactcacttggtagaggatttgctagaaccacagttctccccctgctggaacactaggaatccccttgcttcctttttttttttttttttttttttgagatagaggctgtctctgtcacccaggctgaagtgcagtggcacgatcacggctcactgcaacctccgcctcccaggttcaagtgatttagtagagacacggtttctccatgttgaccaggcttgtctcgaactcctgacctcaggtaattcacctgcctcggcctcccaaagtgctgggattacaggcgtgagccatcacacctggcccttgcctccatgtttaagggtggcccaggttgagctgaaaaggctgggtcaggaccgctgggcctggacacacaagtgcttcctgtgtgtcccacaggctccccagcacccgcaggatgggcccgttctcctagttttacagacaccaggctgagagactggggtcctcatctcccacccacagaagtcttcccactgttagtcctcccgggagaggggtgggctcgcctgctgaggtcgccatggagcccacacggggctttcccgttcaggcctcttgagccctgccatcttctgggaggggagtcggaaaaggttaaggacaagagatcctcatctgtgttagtcacaggcccagagtggacagtggccagtttcctagttgagaagaggacttggccaattgggggccatgttaggcccact

SEQ ID NO: 44782 - DNA, 1030 bp, Homo sapiens
aagaaatagaaaactaaaaagggaacaaatgagtaaatatgtgaggatacatttatgaatttaaaaaactcccaaagatatgattaaataaatgagtaaaacaactagaaaacttctagaaagtctggcagagaaaagaaaaagaacacaagtaattaacatctgacaggagggagggaatgtgttccaatacagaggagaggcaacacgagagaatcgccgggaagaatcagagggggtttgcgctacccagcattgaagggtgtattaaaaagctacagtatggaagtggttaggaataggcaaataggccaacggaagagaacgagaagcacagagcacacacacttacgtgggttatttgtgtataatgaagtcatcccaaataaatggggaatgacagattttcactaagaaaagttagttctctaccttatataatgcataaaagaaatattccagatggaatacaaatccacatgtaaaactaaaaccattcaaatatcaaaagataatgatttgacaggtaaagagcttggaagttatcactgctgtccccacaacaagaaaaaagctcagcaaatggaaaatcaacaactcttctcagatccatcagagaaatgaggtcatggggcaaactgctatcctgaaaactggagagacaggtgaatgcagagaatcagaacttacctgagaagccaggaacagaagctgctgctggagccagtactgtcaggacactcacaggccaactgacaaatgtaattagcacagaaatgagaagccaggcatggtgtgcacctgtagtcccagctacttgcggggcaggggcagaaggatctcttgagcccaggagtctgaggctgcagttactattttcaattactaaagcagttttttaaaagtataatccccacttctggaaaatgatggtgtaattggtatacattgttttagggcagcattaaactggtttacattagtacatgatgacactgaaatacatattgatacatatccattgtcataa

SEQ ID NO: 44783 - DNA, 1033 bp, Homo sapiens
gatgtgtgttttgtagagataagttaccttaatcataacgacaatattttaacttagcctcattgatcttatgtgtgtatatcctttcgagattatgtaacatggcgtagtgatatttttatgctaccttatctgatattatcacatgtacccttcactttttttgatttggtaacatctcagtaatgtattccgcccaagtttttttccctgaagagagcatttttccttagggaaactaaccttcaagaacggatttagctaattccatagtgtcccacatggtgatgaagcttaaagtgtttaagtatagtcagtgtattctatacgggtgtatcatgggatttatttccaaatgaaaagtattctcacgtactctgattttaaggggcttatgtctgtgtatgctgtagaagatgcttagtaaatgagtgggttgtcaggaaagccccaagttcggtctttctcttggaaccttttagctgataatcagcatccttaattcagttctgtgctctgctgttgttaggaataggtgtggttttgctgccgcttttgaaatgagattggcctactatgacagaaagcctggggtcctcgacagaaccttgtcagcacgtgtggggttatttaactgacatctctagcttttggaagttgaatatggaagtggctggtatacccctcctcccccctgtacctttgagaactccaaagtcttgaagacagcgatgcagatgcctaggtggcagccactgtcatcacgttcgggaggaaacagtgtctgtggtgagcgtcagcaggtgcatcctgggaaagggctgagtcgtggcagcaatgctccattctcacagccaggtcccttaccagggccgtgcaaagaagctgtgagtaaaataacttttttggatagaattggaattggttttccctggaaatattttttatacacattttttagtacacattttttatagaaagagaaaagaggtacctctgacttacatttaacagcttcttgcatgtcaggagc

SEQ ID NO: 44784 - DNA, 1037 bp, Homo sapiens
gtggtgctgacagcctcctaggctgccctgacctctcgcccacctggtggatgccagttgtttcatggccccatgctcctggccctcttagtcaaagattctgtgtcacggttgatcctgtgggcccttgtggaccacctcatagttggttggaaattagtgcagcttaaattttgtgcttgttctgtcctcagcccctgagcaaaaaagtaaagaaattccagtgtttctgtgcctgtatttctctgagacggtacaagaagtggactacttactgtagttatgagcattcagggtaaggttttgccaagggatctgagaaatggaaggtggggagtggaataatattacagcttaattcagataattttgaaaatatgactttctagacatcctggctgactaaaccgtattctgaattagtgagtgacattgataacggaaatatagttctatcagatagagtcgtttatttggaagggttagtgcagatctaagactggcgacttgagtatgtgagggagagattgctggtctctcccctgttatttattctcctctttttccacagaaatactatctctgattttgtctctgggtacgtgcccctcctgaataaagaccacattcaccaacattgcttgcacctacatgtgggcatgtgtccaggtgcttccagtaagataatagtgaagttgtcatgggcaccttacaagttatctgtgtatctttacctttcttacattctgcctggaatggggttgtgatggatggagctctcactgccatgttggactgtgaggatctacagttttgagctacattcctgagccgacattgtttaagcccccagtgtctttgggagaactcagtcttgacagttgaaagccataactcaaagctagtctgaggatgaatccctgtgattgccaccgggcacttgacattttaattagcacttctgctcccagaattcacctgcaatgttccaacaccaatgttacttctgcacccagttagaggggtagggagaggtt

SEQ ID NO: 44785 - DNA, 1066 bp, Homo sapiens
agaaaaatggcctgggtttaaacccagactgcccttcccatctgagtggtcatgggcagtttgctttaccacttttgcctcagttagcttatctgttacaggataacgataaagagtcattcttgttgccagtctagacttaggtcagtgtaagtagctctttactacctggtaaatgagaacacttggccctccgtatccatgggttccacgttcgtaaatccaaccaaccatagtttgacaatatttgggacaaaaatggatggttgtgcctgtactgaatatgaacagacttttccttgtcattattccctaatataatataacagtataggataaacaatatagtatatagtataacaactattagtatagtataacaatatagacgatatagtatatagacaatatagtataacaattattaccatagcatttaccttgtattaggtattataagtagtctagagatgatttaaagcatacaggaggatgtgggtagactatatgcaaacactataccagggacttgaacatctgtggattttagtatctggggggtcctggaacacatctcccacagatagtgagggttaactgtacttttaacgtaacatttttctctaaagtatttttaaattcatgttcacttaaggagacaatattatttttgagtaattaaaaattaattttaggccaggtatggtgtctgtaattccatcactttgggaggctgaggcgggcagattgcttaagctgagttcactactagactgggtaacatggtgaaaccccatctctacaaaaaatacaaaaaaatctgctgggtgtggtggtgtgcaccatagtcccagctacttgggagggtgagctgggaggattgcttgagcccgagaggtcaaggctgcagtgagctgtgacctcactgctgcacttcagcctgggtgacagagcgtgaccctgtctcaaaaaaaaaaattaattttagattttggagggttcatgacttcctgggcctgttctcctctgtcttgcctctggctgcactgctgctgagccaggcagt

SEQ ID NO: 44786 - DNA, 1083 bp, Homo sapiens
aattgttataaaatgcactcacaagccaggtgcggtggcttacagctgtaatcccagcactttgggaggccaaggcaggtgaattgcttgagtctaggagttcgcaaccagcctgggcaatgtggcaaaaccctgtctctacaaaaaatatagaaattagttggatattgtggcactcacctgtggtcccagctacccaagaggctgaggtgggaggatcacttgagcccaggaggttgatgctgcagtgagccgagatcacgtcactgcattccagcctgggtgacagagtgagaccctgtcttaaaaaaaaaaaaattcagtcaccacctaaatcgaggaatacacctcctgaacatggtccctctctccctgtttgaaggtatcagcccaccccaatacctcagtataattttgggcattgtccggatgaagagcaaagtgtgtgtggttttatacttgatatgaggtttatgtttactgtggcttttaacaccatttcttttttgtcttttttgattgtacgtctgagactggctctgtggctcacacacagcatttgtgagtgcttgtgcataggagtgtgtgttttagagaggtggagtgccacctgatcagttcacgttcgttaattgtgttacctcaacttttctatgtttttactgattttttgttacttattctacagagacttgtgttaaatttctcattatgcttgtgaatttgtccaagtatcatatttaggactgcttttgcattatatattttatggccctgttattaggtgcatataagtttagaactgctgtatgttcttgattaattgacccttttattttaataaagggtctctctttactccactttgtcaggtactgagataacaatgttggctgggcatggtggctcgcgtctgtaatcccaacactatgggaggctaaggtgggtggattgcttgagctcaggggttcaagaccagtttgagcaacacagcgagacctcatctctacaaaaaatacaaatattagacaggtgtggtagcatgtgcctatagtcccagctacatggacagctgaggtggga

SEQ ID NO: 44787 - DNA, 1029 bp, Homo sapiens
aaaattagctgggcatggtggcaggtgcctgtaattccagctacttgggaggctgaagcagaagaattgcttgaacctgggaggtggaggttgcagtgagctgagattgcgccactgcactctagcctgggcaacagagcaagagtccatcttgaaaaaaataaataaaagtaaaaaataaaaataaaataattagccgggtgtggtggcacgcttctgtaatcccagctactctggaagctgaagagcttagttagcctggctagaggtttatcaatttttactgatattttcagagaactagcttttggtttcgtttattttttctgttgatttcttattttcaagtatattaatttatgctctagattttactgtttctgtttttcttacttaggatttaatttgctcttctttttctgttttccgaaggtggaagtttagatgattgattttagatttttcttcttttctaatatgtactttcaatgctataaattttcctgtaagcactgctttattccgcattaaaaaactttttttttctatttatctttttgtcctttttcttcccatcagtttttattttgttttgttttttgttttgagatggagtcttgctttgtcacccaggctggagtgtagtggcacgatcacagctttaacctcccaggctccagcgattctcccatctaagcctcccaagtagctagaactacagaagtgtgccaccatgcacagctgatgaaaaaaatttttttgcagagatggggtctcactatgtttgcccaagctgtccttgaactcctgggctcaaacaagcctcctgcggcctcctaacgttctgagattaccagtgtgagccaccatgtttggcctttccatcattcttgcttcccttttatgcatctcacaaatttttgataaactgtgctgtcatttttatttagttcaaaatatttttaaatttctcttgtgatttcctctttgacctatttagttgcgttgtttaatctccaagtgtttggg

SEQ ID NO: 44788 - DNA, 2011 bp, Homo sapiens
gtggtaattttagacattagtgttattcttaaaaacttacagggacatttatctaactttctagtttatctttttgcaaagcgtaaactgcatactttcagtgtaattttatacattacatataagaggtgttcgattatgtttgtggaattacataaaatatgtctctagatttcttacaaaaacaagaattaatgtatctttatgaaaattcctttataaaacatctttataaaaatctgctttataagataactagcacatggataggagaagctttgtgaggctggatttactccctttttaaaaatggcctttgttgctaagctgtgtctgtctcttacagacctacctgactgtgtgtaaagatgttgttatggtaggccttggtgaccatcagtttcagatgcaactcttacagcggagtcttggaatcatgcaaacaggtacagtcagggctgttttagagcaataaatactcagaaccagtccttccctccctccctcctttactgtgtagctcagaactctcacttttaagtgactgattataatgcaacctggcatatcccaaaaaagggatttgttaggtggttcagcccggaaattaagaggtgtttctgtgtcagacatgactacatccagagtttgtgacagggtccttgggattctgcctgtccttgtggtcagctttgttgccaggctgactttccctgtggattgggctagtggctatttcctggcatctgtgtgggaaaccatcacctttttgctctgctctggtcatgtgctcctgtggatgggggcgtgagtcagacattattgggtggtaccccaccaggacccccggaagttgctgttaccacagggaaagggttagcacagggtgacccatggcaacagtgagtgagaggacagccctcgaatcacatcagatgatgacgggaaagggtgtggggccagggggagtgcagctggggtcattccatatctccttggccttctgatcacagtctggtaaagaagagtactgctgagctgggaccctggtccctggcccctgacgcctagcccctagcccctagctcctagcccctactccctaacccctaacggccagcctccccctcagccgcttctgtggtgtagctgactgctgtgtaaacctgtttctggatggtttttaagtagtatcccaatatcccagtgctgcatttgattctcactgagatctgtaaaagcctcaacatttgatgttgacatttctttaagcctagttatttgctagaagagattgaaaatgataacatttagtaaattcaacattaagttttgaaaattagattaagttggttgtccaatttctagtggatccatctgtagtctctttcccatagccttaaatatcttcatggcagattccagaggggtctgtgtgtgtggacacccccagtgtatctgtcttcatgacgttgcaactgaagtagatgctaggagaacactggagccaggatactgggcagtgtcttagttaatctttaattataagcaaaatcatccatcatttgtttaacagatctaaagtttaagagtaaatattaaatagaccaatattatttgcttcagcttttttgtttaattattattattatttttttttttatttttttttttttgagaccaagtctttctctgttgcccaggctggagtggagtgcagtggtgcgaccttggctcactgcaacctccacctctaggttcaagcaattctcatgcctcagcctcctgagtagctgggattacaggtgcccaccaccatgcctggctaatttttgtatttttagtagaggtgaggtttcactgtcttggccaggctggtctcaaactcaagtgatccacccaccttggcctttcaaggtgctgggattacaggcgtgagccaccatacccagcctgtttaattctttataattcacttctgttgtgaaaacagcattttatacttaagctt

SEQ ID NO: 44789 - DNA, 1113 bp, Homo sapiens
tctgttttcatgctgctgataaagacatacctgagactgggtaatttatgaagaaaaagaggtttaatggactcacagttccatatggctggggaagcctcacagtcatgacggaaggcaaaaggcacgtcttacatggtggcaggcagagagaaaatgagagccaagcacaaagggaaaccccttagagaaccatcagatctcgtgagacttactaccataagaacagtatgggagaaaccacccctaggattcagttacctaccaccgtgtccctcccgtaacacgtgggaattatgggagctacaattcaggaggacatttgggtggggacacagccaaaccataatttaccagtaaatggtaaagctcattagctgggcatggtggttcacacctgtaatcccagcacttttcgaggccaaagcaggaggattgcttcaggctgggagtttgagactagcctgggcaacatagtgagacctcgtttctacaaaatttaaaaaattagctgggcttgatggcctgtgccttttggtcccagctatgcaggaggctgaggcaggattgcttgagcccagagtttgagactacagtgaactgtgatcatactactgcactcactccagccctggcaacagagtgagaccctgcctcttttaaaaaaaaaaaaaaaaaaaaaaaaaaaagaaagctgaaataatgacctgggactgagaaaccagcattatttcagaatatgaacagaagcccatataggacaccaggtaggttggcggacagggcagttgtggccttggggtatttgaaacccttagagggtcttgggattcagttaattctgagtatgtctataagaagtctctccaccactaaggaaaattgcttccttctctaagtaaagagatgatgggtgagccacacagatggaattggccatcattatcagtatacttgtaacattaacgagatattttctttttttttttttttctcgctctgtcgcccaggctggagtgcagtggagtgatcttggctgcaagcctcgcctcccgggttcacgccattttcctgcctcagcctcccgagtagctgggactacaggcgcctgcc

SEQ ID NO: 44790 - DNA, 1040 bp, Homo sapiens
ttttgggacatttaattatttattactatgtgtggttttaaacattttatgcatatgcctgttgtttccccaatggagaggtggtgtcatatggtgggtaaagcacatgctctggtgtcagccccctgctctctggggtcagagtccaccactctcacttaataggtatgtggctttgggcaagtcacttaacttctctgtgtctttctctgtaagtgtgattgcgatattgcctatcctaaaggtgttgggtagcataatgagcaaacactggttatatttcagggcaagcctacaaataatgcctgtggcaggtgatttttcagatgaggtgctaggatgttaagatgcggcatttatttccaaggagtattgtggattcttttcatctacttagtctgtatttcctaacacagcttacttaagcagtgcatactatctactgtcctaagtagtaaagttttaggaaacaatgacaacaaagtgctgttgtaatgctgttgcctgtggtgcttctgaagtgctcccttttttctttttcttttctaacttatggaaaacctgacatgcagaaagttaaagtaatagtataataggcctgcacagtggcttacgcctgtaatcccagcgctgtgggagggcaaggtaggaggactatttgaggccaggaatttgagaccagtctgggcaacatagtgagacctcgtctctacaaaaagttaaaaacaacaacaacaacaaacaaaaaaacagcccggtgtggtggcacacgcctgtggtcccagctacttgggaggcttcagcccaggaggtcaagtctacagtgagccatgatcacacaactgcaccccagcctgggtgacagagtgagaccctgtctcaaaaaataaaaagaaaaaaaagtgtaataaatatctgtatacttcttcaagcacacacacacatccctaaatgaagtcattagtattttgctgtgtacattatgtatatttatctacaattcctttttttttttttaaagattccttatttttaaattt

SEQ ID NO: 44791 - DNA, 1051 bp, Homo sapiens
ctgctagacaaagggccatgtgattaggactgagacctttggctcccagggtctttgttcactttataggtggtgcccttggtcaggcctttcagcctcagagttttgttctgtaaaataggagcaacagttactgtttcacaggattgttgttaggaacagatgaggtaatatgtatcaaaccgcagcccaggcgctggtggataagaacccctggggagggctgccctttgccatccttgctgtgtcagcaccatcgttattacaaagatgttggacacagcctgtgccccacacatgtctccaggattgttctgaaatgggagagtgaagaaattaatgatggattcaaacaataaactattttatgttgacttatacataaggagttgatgaatcgtacttgttaacttatatatgtgtgcagatatataacagacataaatgtatgtatgtgttataacctctaccctttttaaaaaattgatgtctcctttgaatttaagatatctaaatgtagtttcctaatcaatcattaatttggtcaggtcagtttccagtcattctgggtaaaccataaacatcttgtactgtactaacagattacttccagtgaatattactgtttttttttttaacttgcctgttgtgagcatggttaccctgcatttgaatcaaaatgtattgcatttctgtaggattccagttctgtgcagtggtgtgctggtaagagatgaaggtgctattcactgagagagttctagatagatgcatcttatgcactctatagagtatgaagattgtattcattcttcttaggttcagatacataatctagtagcatgcatataaattatcatcacatgatgtatttatgacttgaagactgtgtatttggaaattctagcttgacaaacacttagccttttaactatatgagtcctcagttttctcatctataaatgagaaggtgaaatgaactgggatattcaactccattcccacccacctatgctagatttaaagctttctttcatttgagactatggaa

SEQ ID NO: 44792 - DNA, 2506 bp, Homo sapiens
aagaacttgccaaaggctggacccagtggtgagtgtccctgctgcagacagagaaccccagtgtgtagctaaaaacgctttccccgcccagtgggtagtgtcccccacagacagtggtggaacccgacacgtatctgataggcttttcctacttggtcctgtatccgtcaccaccttcctgtcactgtctttctcaggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattc

SEQ ID NO: 44793 - DNA, 1105 bp, Homo sapiens
tgccattgctcaggccctctggggccttactagttctcagactacttatatcaggtatgaagagcatggcgtttaaatctctgaatttatgtttttttcctcagcctctgtttttgctacttgtatcttgaacctctcttgataggtgtgtgtgaacagccaggcctaggagacctggtcatgccgcttgcccgaccctgtctcattagataggtgagtgtgaacagccgggcctaggagacctggtcatgccgcttgcctgaccctgtctcattagataggtgagtgtgaacagccgggcctaggagacctggtcatgccgcttgcctgaccctgtctcattattctgtgttggttgttttattaggttggtgcaaaagtaattggagtttttgccattgaaactgcaattacttttgccccaatctgatacttttttacattctgttttatacaaaaggatttgtgttttgtctagctggtttttccttcataaagtgcacttctgtattctcaaaataatctatgcttactggaccttggattttaaaaataatttttaaagttccacaaacattgtcatagttatttcatttaaaactgcttttgtgattatagtttagtttgaaaagaaatatgcaatcaaccttttaggttttcctgagtagttatgtgttaatttctctgaccatttttgtatagcctgagaaaccttcagagttcttactctatttgattaaattattttatattacagccatctaacaggaataattcctgttgcagagataatgcagaaggttattatacaggaaaaagaggctgggcatggtggctcacacctgtaatctcagtactttgggaggctgagatgagaggatcacttgaggccaagagtttgagaacagcctgggcaacatagtgagatccacctctgttttttaaaaaatttttaaatgccttgctgtaaattttctttaatgtggattttgaatggagaaggcttaaaaggtacttagaaatgtattgtctccataaatgtcatgaatggaaactgtatacatcgttatgagtgtgtattgccaccattttcccaggggttaaa

SEQ ID NO: 44794 - DNA, 1021 bp, Homo sapiens
cgtggtgacgggcacctataatcccagctactcaggaggctgaggcaggagaatcacttgaatccaggaggtggaggttgcagtgagctggtatcgtgccgttgcactacagcctgggcaacgcgagtgaaactccgctttaaaaaaaagaaaaagaaatggaggtttctgattttcctgataagaattacaggtaattgccttaaaggaggtcaatgagctatgagacaacactgataacaagtaaaatctggaaaaggatacatgaacaacatgagaatatcaacaaagaaaaaccataataaaagaatcaaatatagattctggggctgaagaatacagtaactgaactggatcaatacaaggcttcaagagctgacttgatcaagcagaagaaagaaccagtgaactcaaagacaggttatttgaaattattcaatcagaagagcaagtagaaaaagaattttttaaaagtgaagaaactgtctgtctttgctaaaaattggagggtcctaagaactcctccccgcccccactgccaatgcagagtcttactctgtcacccaggctggagtgcagtggttcgatctccgctcactgcaacctccacctcccaggttcaagcgattctcatacctcagcctcccgaatagctgagattacaggtgcctgccaccatgcccagctaatttttgtatttttagtagaaacggggttttggggtttcaccaagttggccaggctggttttgaacttctgacctcaggtgatcctcctgccttggcctcccaaagtgctgggattacaggcgtgagccaccatgcccggcaagaactcctttttatgttagattcactagggtttagcagctcacagaacccaggaaaacagtttacttagctgatttattacaaaggacattttaaatattacatatgaacagccagctaaagagttacatacagcaagttttggaagcatcttaggtttaggaggtctgtctccaagcagttggggggta

SEQ ID NO: 44795 - DNA, 1024 bp, Homo sapiens
acccgcgcggcgcgggcacgcacattctcagggacgcgcgtcctcaggccacgagaacacctgaaggccccggccagcgtcctcccgtgaagacccggaccggcgtcgtcacccgccgcgcaggcctaaatctcaggtcttcaccgtcatctcccagcgatcgcagggatctcaggcactgaccgcgcccgtccctgcgcacccgagccccaccccacgcccccacgcccccacgcctccacgcccggcactctggacgcgcgcggacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggtaggtgcggggtgcagcgggcgcgtcaggtgaagacttggcgccgcaggcgcgttaggtgaagattggggctcgcgggcgcgtcaggtggggacgacgggccacgggcgagtcaggtgaagaccgggggcggcgggcgcgtcaggggaagacatggggtcgcgagcgcgtcaggtggggacggggcctgtgggagggtcaggtggggaccgggggcctcgggcgcgtcaggtggggacggggttgtcgcgggcgcgtcaggtggggacgggattgccgcgtgcgcgtctgctgaagtctgggtccgcgggcgcgtcaggtagggacgatgggccgcgggcgcgtcaggtggggtctgggggcggccggcgggtgtggagggttcattcagggagctgcgggcgagtcgggtgggcacgggggccgcccacaggtgcaccgcgcgtcctcagccgcttcccctgcccaccttctgcgaccccttcccgcccccaccctcc

SEQ ID NO: 44796 - DNA, 1057 bp, Homo sapiens
gaagaagatagggtcacatggagaatacagttagtgtgattcttgaaacttttaagatttatctgaaaaatttgtttctatggagtaccatacacagcaacagaagaatagaactttttattagggtacataggaatgtagtaatgtaattgcattttataatcatttatgtcttcatatggcttcagtcattaataatactaattttcttctaagttactaggacttggtactgtctgaaatcattgttcatatcttaaactgatttaagaaacaaagcaattctgtttgcattcacccacgtaaaagcatttcttgtcaatatagtaagtcagataattttgttaacatgtccaattatttaaattcctttaaaatcttcattttgaaatgatttgccagattttaaaaacaaaggtaatttttattctaggtttttatcgtgaaaaatggatctatgtccataaagaaagcacaaaggaagtaagtattctattataaatatgagagtatcttgtattgtttctgttgaatatggagtcacattaaataaatgtattaataaagttgcataaaacacatttcttttgcaatatcagatctatggttcacattctgacagataatagcatatgaggagcttttgaggcagtgattttccattgtgtgtgcttgcatgtgcatgtggtatgtggctgtgtatttgtgcacacatttgtgtgtgttgtgtgtatggtgtatgtgtgtggtatatatggtgtgtatgtatgattgtgcatgtatttgtgcagatactggtgtgtgggatgtatggtgtgtggtggcatgtggtatatgtgtgcagtgtgtggttcctgcctacctgtacatatctgagtctacagcagggttatttaaaccaagcatggactcctgcagtcatacgcattttctctgtgttagcatgaacccctgatgctgatgggaatgtgtcctccctgtggcgtgttttggagggcagggcatctgtgagccctctcattccacataaagagtggctaacatgaaattagtaatt

SEQ ID NO: 44797 - DNA, 1066 bp, Homo sapiens
ttacagctgaagagaacagggagaggggttccagcatatttatcactggaatcttcaaacaggaaaacaaaacaaaaggacagaacaaatatttaaagataatgttcaggaaaattctgctcaggtaaaaatagatggaagtgtacattgtgagagggcaaattttatgctggggaaggttgactgagaacaggttatgagtgtgccatatcctacaggaattattaaactctgaagatgaagcaagaacctcccaatggctgaacaaacatgtcgtctcttactgagggaaaagatcagggtggcttcaaatttctccaaattcttcagatagtggagtaatccttacttatgggatcctccaggaagaaaggatggcccatgaattttatgtccagtcaaaccatcttttgtatccagtctgcaaacaaacagtattgatcatgtgagaactcagggaatacttactgttctcatgagcagtttcggctggagaaacagtgtccatcggactggatgtcagtgaatctctgcagcatcagctgtgtggctgagggtgacggagcagagtgtgagtggagggcagaggagaaaaggtcggtggttagaggtttgttgactgtctcacctgtaatcacagggaggcactaagatgttattcactaaaatcaagttgtagaggagagggatggaaggaagaaggagcaagatgaatggcagttttatcacaatgtggaacagtaaactaacaggctaagatgtgttgtatgaggattccgaaggagagggaattacatagagttaaaattccaaaagtaacccctagtacaaaatagtgcaaacatttctaaatttcagaagaactacagagagaacgcaaagtttttcaaaaagctacaaaaacatgtcataaaattaagaccaaacatgctgtgtctatacatgtaaacacataactttatacacataacctgaaggctggtaaaagtaaaagatttcagattgaatcaaaaagtgaaacccaactccaagttgtacgtaagaagcacacctaaaacagagattt

SEQ ID NO: 44798 - DNA, 1026 bp, Homo sapiens
tccattggtctacatgactgtctttgtttcaatacaacaccattttgattattgtagctttgtcgtaagttatgaaataaggaagtgagagacctcctacttggttccctttcaagatgattttggctgtgtgaggtctcttgagattccatatgagtttcaggatggaaaaaaaaaagccactgggatattctgatagagattgcatgaaatctatagattgctttggactatggacatcttaaggtatccaatccataaacacgggattgctttctatttatttgtgttgaccttactttctttaagcagtgttttatggttttcaagtacaagtcttttgcttccttaagtttattcctaaatatttcagtttttttgttactattataatggaattttcttaaatttccttttgagattgcttgttattgtatagaaatatcatggatttgttgtgttgattttgtaaactgcagtgttactgaaatttttttttgtatatgtatggacactaggattttctacatataagatcatgtcatctgcaaacagataattttgcttcttcctttccagtctggatgccttttatttctttttcttgcctaactgctctaagactccagtactgtgttaaacagaagtggtgagacagggtatttctgtgttgttcttgatcttaaagtcctttcagtcttattgaatatgatgtttacagtgggatgttcatatggcctctattttaggttgtttccttctattcccaattgttgagtttttatcatgaaagggcatgacattgtctcaaatgctttttctccatcaatggagatcacatttttttccttcattctattaatgtaatagacattacatttattgacttgagcatgttgaaacatctttgcataccagctgtaaatcttacttggccatgatgtgtaatcctttcaatgtcccactgaatcctgttggccagtattttgttgaatattgatttaaaaaaatcttgatcaggaatac

SEQ ID NO: 44799 - DNA, 1076 bp, Homo sapiens
agctaattaactttattttcttttttttgagagagagtcttgctctgtcacccaggctggagtgcagtggcgtgatctcagctcactgcaacctctgcctcccaggttcaagtgattgttctgcctcagcctcccgagtagctgagactacaggtgcatgctgccatacccggctaatttttgtatttttagtagagatggggtttcaccatgttggtcaggctggtctcgatctcctgaccttgtgatctgcctgcctcagcctcccacagtgctgggattacaggcgtgagccaccatgcccagtagtctttcttaggctaagctcactgtgaagataaatctgcccccagaaacaccccaaagtcagatatggcatttcaggacgtgacaatggcgagcagagaggctgagctgtgagctcacagtttgtctccagagcaactccagtgcctgggtctgcacaccgcgcacttcctcctgccacagctgcatgggtcaggggctcccgaatgagacatcctgtgttgatcgcagccgtctcccagcatgtggagcaacactaggaccgtggtagatgttcagtcatgttcgctgaaggaagaagggagtgaatgaatgtcttctctgaggatagctgagcatccgtgcatccgtctggccatgagaacttggttgcgctcacatgaggatcctgagcaggtaattatctcggtccagaagcaatagcttcaggcaaagagaagacgcgttccctccctgtctgtgcatctgactttcacggttgttcctaccgttcattgctttattaaagccagtcactcctgggtttgccttcacgttgtttcacttcattaaaaaaaatggaatgagacttgagtttgaatgcaattatgtaattgaaggaactgtcctacacacgatttattaattaacattggagcacacttatgtcggcctgcttcctgattacagtcaggcgccaggtaacgacggggtgacgctctgagaaacgtgcccttaggcggctttgttgtgttgtcttcatttgtacaaatttaagggatgcaagcaca

SEQ ID NO: 44800 - DNA, 1137 bp, Homo sapiens
aaccaggtgggtcttgtctcaccaagatgggaagccgtgtgcaggatgctgtgtacagccaacagcatgggattgagaatatgagagctgtgaaccgtatacacagaagggacttggatcaacagaggagcaacgtctgcagatgtcctggagcaacagctctgaaaaatgtccagaaatagaaggaaaagtagaacctgtgatgtgggcaatggggagaatgaatgtgacttttgatcgtcacagcctcattgacttataggatgcagaagcatttgttttgctttaaaaatcattttcagtatatgtgtcctctgtttccactcttgccttacgtccaagattgactttcctcaggagaaatgcaggctctaagcccagcggacagagtcaggccaggaagcaggcaccactgtcttaacctctttgccattaatttgaagtgggggcttcttaagaacgtaacttctctgaccctgacgttctcccagtaaaatttcctttgccttaaaattgtgtgtctctgtgtgtgtctctctatttatgtctctgtgtgtgtctctgtgtgtgtgtgtgtgtctccctctctctttgtgtctctctgtgtgtctacctctctctgtgtgtctctctgtgtgtgtctacctctctctgtgtgtctctgtgtgtgtgtgtgtctacctctctgtgtgtgtgtctacagagtgaaacctctgctgtcagggtctgatttttattttctagatgttcttcgtaaatttggtttccacgactgtatacaccgttgacctgctacttagtaaaactgtttcttattgttagacgtgttgcaaaaaggtagatgggaagtaattttttaaatttcagaattgtaatgacggatgacccatttcctaatattgcaattctcaaattctttccccacgtcttcatgaaataagtcatagttaattttggcaaactaaccattaccaaattaaatgattaaataattaattaaatcataaacccacaaaaaagaaaacatgtgaaaaggagaaaataacatgaattgggagtcaagattagtgccaaacaggccttggtaaaaatccagctttctccacccagcactgagagacctccagccagcggtgt

SEQ ID NO: 44801 - DNA, 1089 bp, Homo sapiens
tatatatagtcataaaaatgtatatacaaaaattaaaagtatatgtaaaaaggggctggatgcggtggctcacacctgtaatcccagcactttgggaggccgaggcaggtggatcacctgagttcaggagttcgagaccagcctggccaacatggtgaaaccccatctctactaaaattacaaaaattagctaggcatggtggtgggcgcctgtaatcccagctacttgggaggctgaggcaggagaatcgcttgaaatcaggaggcagaggttcagtgaactgagatcgcaccactgcactctagcctgggcaacaagagcaaaactccatttcaaaaaaaaaaaaaaaaaaaaaaaaaaaaaaaaaaaatatatatatatatatatatatatacacacacatatacgcaaaaaggagattttaatgaatatataattttgtcaactaaaaaatacagaaaaaaaagaatggctaaaaattattgggtctacaactttagaaattgaatagtagaacaaaccaaaagtatattgaagggagaaaataaaaataaggccagaattaataaagcaggagatagtaattccatgggtacaaatgacagaatggattttgaaaagacagaaaaattggaaacctctagcaaaatgatcaaagggaaaaagagacagagaaaaagcatggaggtgcagaccaacaatctgagacgtgacttcagagtgtccacgcaggaccccgcagaagtaggtgagtgtggccttcccaggtgaagggggctttgcagatgtaaggagaggatctgaagggggagattgtcctggatcgtgtgggtgagtccagtgtattcccaagtgtttttgaaagtagaagaggaggcagaagtgttcaggggtgggcgacagcatatggactcagcccagcattgctgctttggaggtggggaaggggctgcaagcccaggagagtgtaaagtgcaaggcaagtcttctccctggagcctccagatgggaatgcagccctgccactgccatttcagctccgagagagccctgctagattgtgacctgcagatacacaaccacagaca

SEQ ID NO: 44802 - DNA, 1065 bp, Homo sapiens
cgtcctggccgccgaggtgagtgcgggccccgcggaccgtgggtcccctcgcgggcttctggtttcctttgagagttgcacttctgcccggctcccccgaaatcgctgggtcccacccggaggtggctgcgcccccgaccccctgcgcagatgtttcagggaaggggctgagaccccctccccccgagcagctcccccttccgcggcgcccccggcccctcaggataacggcgcgggcctgggcggggggagcagggactggcagcagggacccctggccccaggggcaggagcgaactccgatcggcggaaggagcccgaggggcgagctggcttcgcctggggggtcgtgcagtaacttagattttccggtaaaggagaagaatgcggtccgcctcaggatgcagagaaggaccggtgtaaggaaagccggcgtctttcccccgcaccctacctgtccccctaccccaccagttccccgcaccccgtgtaccccgcctgtccctcagcaccccctgttcactctgcactccaccagttccccgcaccccagctgtccccccgcaccccacctgtttaccctgcaccccagctgtcccccgcgccgcagctgtcccccccacaccccacctattcccccgcaccccgcctgtccccccgcaccctacctgtttattctgcaccccacctgtcccctcgcaccccacctgttccccctgcaccccacctgtcttccccacaccccacctgtttactctgcaccccagctgtccccccacaccccaccagttccccgcaccccgtgtaccccgcctgtccctcagcaccccatgttaactctgcactccaccagttccccgcaccccacctgtcccctcgcaccccacctgtcctccccacaccccacctgtttactctgcaccccagctgtccccccacaccccacctgttcacccgcactccacctgtccccccgcactccacctgtccccccgcaccccacctgtcccccctgcacctcacctgtccccccgcaccccacctgtccccccgcaccccacctgt

SEQ ID NO: 44803 - DNA, 1026 bp, Homo sapiens
cagagagagacagaggcagaggcagagacagagagagacagaggcagagacagaggcagagacagagacagagagacaggcagaggcagagacagaggcagagagagacagaggcagaggcagaggcagagacagagacagaggcagagacagaggcagagacagagagagacagaggcagaggcagagacagaggcagagagagaggcagaggcagagacagaggcagagagagacagaggcagaggcagagacagagagacagaggcagacgcagagacagagagacagacagaggcagagacagaggcagagacagaagcagagacagaggcagaggcagatacagaggcagagagagacagagacagaggcagagacaggcagagagagacagaggcagagacaggcagagagagacagagacagaggcagagagagacagagacagaggcagagagacagagacagaggcagagagacagagacagaggcagagagagacagaggcagaggcagagacagaagcagagacagaggcagagacagaagcagagggaggcagagacagaagcagagacagaggcagaggcagaagcagagggatgcagagggagacaaagacagaggccgagacagaggcagaggcagagacagaggtagagacagaagcagagacagaggcagagacagaagcagagggagacagagacagaggcagagacagaggcagagagagacagaggcagagacagaggcaggtgcagcgacaggggcagagacagagacagaggcagagacagagacagagacagaggcaggggcagagacaggggcagaggcaggggcagagacaggggcaggctacagcccggggccttcagccgctgccactgcatccgccccaagcacggccctcacggctgcctctggctcttctttggcgccctgttaccgcctccaagcccccacccccaggatgctcaccatgctctctggtctcttcccagccctgggtcagccccc

SEQ ID NO: 44804 - DNA, 1031 bp, Homo sapiens
ttgggctgggatccaccgggggtgccgggggtgcctggtgccttcctttctctaacaggcctggactccatctccagcgatcctgatgcgtgaggtggcattggccctggtgccagcgtcccagggaaagatgacatcaacctaaactcttgaggactcatagctgtattggagcattgttaattttctttgttgggagatgctccagccatggaacgtactcttcttccatccgtctctgaggctgcagagtcatccaggccaggctgacgaatgaaggagtcttctccttcccacagccacccggcacccgcccagcctggggagaagccatccctttctctgcactcagggcagcagtcagcgtctggtcctgctgctgtgtgcacgccggaggcagtcctcttcagacctcatgtgttcattccttcaaagagccacgcactcttcagcacagttggtgttggctgaatatttttgactgaggctaaagggtcattttgggttttgtcagggtctcagagccagtgtggtcctctctgtccatgggatccgattgtcggaagcattgatgccatctggcgtggaggccgtccaccgtggggactgtgcagcgtgggggccatctggcatgggggctgtctgatgtgggggacatccagcttggaagctgtctggcgtggatgccgtccagtgtggttgctgtctggcatggaagctgtctggtgtggggactgtccagcgtggaaggtgtctggagtggaaggtgtttgatgtggggaccatccagtgtggggctgtctggtgtgggggccatctggcatggaagctgtctggcgtggggactctctggcgtgggggccatctggcgtggatgccgtccgatgtggggactgtccagcgtggaagctgtctggtgtggaagctgtccgatatggggactgtctggtgtggaagctgtctggtgtggggagtgtctggtgtggggactgtctggtgtggaaactgtctggtatggggactgtccggtg

SEQ ID NO: 44805 - DNA, 1029 bp, Homo sapiens
cactcctctgctggggctgggggtgtctccatagcccctccctctgcccagatttcgacccaggggagagtatgacaggtccacgccctctgggtgcagctggactggccaggccgtccttgggccaaggctactggatccagcctcagggctggtcactagctccaggctgcaggaatgtggagctctccacagttcgccactgttaacatttcacccaggagggtgtcctcgggagaccctggcgggagcccgggagccgcggaggggctgaggagccgcccagccctctggcgggttgggagcgaggcccctgcccttgctgacaggccacatgaccttggtctttgatacagaaagccaccatttaatgacagtgctctggcttggaaacttaggtgagtttctagccaataacttttacgacaaatagaaatagggataatggcctggtgtcttttctgaggattctgtggtactttaattataatttcccccattattaagtcaaccgtccacttaaaagtgcccctgaagatcaggatccagcaggaagttactgcgacctcatttcttccctgcgtggggacacagttggtgctgttactttagatcatcacttttctggtttttttccccatatttcttttctacataattgtagtcattgaatataaatttttaactttttttttttgagacggagtctcgctctctcacccaggctggagtgaagtggtgtgatcttggctcactgcaacctccacttcccgggttcaaggattctcctgcctcagtctcctgagtagctgggattatagacacctgccaccatgcccagctaatttttgtatttttagtagagacagggtttcaccgtgttggccaggctggtctcgaactcctgacctcaagtgatctgcccacgttggcctccgaaagtgatgggatgacaggcgtgagccaccacatgtggcctgatttttaacattttgagtgtaggtttttataccgcgttaacatttgtgt

SEQ ID NO: 44806 - DNA, 1046 bp, Homo sapiens
ttgggaaacacagaggtttcagaatagacggcctcctgtgcgttttcctgttgaagtcggccagagtcctcggaactcaccacggtctgcatgatccacgctgctgttgtcactctgtgaccgcggagcatgagaaccccctggaaatgagggcgtgcagagtgtaggattcttggctgaaggaaaatacgtttgttttaaagtgattttcttattttaaaatattatttgattatttaaaataattgcatatcatttaatttatttttaaaataacttagcatgaatttaaaacaatttgcttatttttgttctgtcaacctagagccagtaataaagccttgttctaataaagactattttaagtcccggagtagaggagcaggtggttctccggttgcgttttgatcattgaatgagggatgtgaacgcagacctccttcctgggaggtggaaaagcgtggatttggtgttaggcccggtccccagcctggcccacacttcctgcctggtggcactgctggcttttctgttccttgctctggagcctccctggggcggggcggccgcctggctctgcagggcttccccgggacgtacagcccagccaggatccccaggcctgcggtgggaggttgcagagccctgcctggagctcccagctggccaaactgggatgaccagattccgttatttttcctgcctaccgaaaccagctctcaaagacgtccacaggcaggtcctgctcttgtttacgcacgggctgttgtggccagaagcctctgggtgcgctgctgctcggagctgtttaggcgactccctggccagcgtgtctgcctccttctgaccttgacagactcagtttgcaccttaatttcccggaaggcggaggaaagaagagtttcctggggtggagccctgagagggctcatgtgtgtgctctggggatgggagtctgtgctcctggacacccccgtgggggagacatttctcaccgtgcagcgagattgctgctgggcagcacgtcctgcctttgtccctctgca

SEQ ID NO: 44807 - DNA, 1722 bp, Homo sapiens
tcacttgaggtcgggagttcaagaccagccgggccaacatggtgaaaccccatctctactaaaaatacaaaaattagacaggcgtggtggcgggcgcctgtaattccagctacttgggaggctgaggcaggagaatcacttgaacccaggaagcggaggctgcagtgagtcgagattgtgccactgctctccagcctgggaaatgagtgaaaactctgtgtcaaaaaaaaaaaaaaaaaaaaaatcagtaaaccataaaagattagaacagcaatgtagtatgattgacttgaaggtcatatacagatctttgaagcaagtagttccagaatatgtatttttttaaacacatgaaatattttaaaaaattaactatatagtatgcctcaaaacaaatattaacaaatgccaaagaatggatgttcagaccttatttcctcataataactgaataaaatcagtaaaaaaaaatcaatacaaacatttagaaattaaaaatgatatactactctgtaactcatggtcaaagataaaatggaaatgaaaatattttgtcttgaataataataaaaacattacataaactatatgggatagattttaaagtctaaggaattatagacataatggcatatgttaataaaacagaatgggcgcggtggctcacacctgtaatcccagcactttgggaggccgagccgggtggatcatgaggtcaggagttcaagaccagcctggccaagatggtgaaaccccatctctactaaaagtacaaaaattagccgggcatgatggtaggcacctgtaattccagctactcgggtggctgagacagagaattacttgaacccgggaggtggaggttgcggtgagccgaggttgcaccactacactccagcctgggcaacagagcgagactccctctgaaaaaacaaaacaaaacaaacaacagagagcagtgaactgagtatccagccagctgcacgaaagagcagcagagtcaaaggaagtggcaggaaaaaaataatgggcaaggcaaaaatgatgaaataaaaatccaggaagcaacataaagtattaacaaaaccaaaggttggttctttaaaaatagtacaaaaatagacaagcctctggttatattaagatgacacagagaaagaggggagagggatggaagaaggaaggaaggaaaggaaggaaggaaaaagttgatcaagaggatgtaactgcagtagaaatttgtaaaaatcataagaggatgctataaataactttttatcaaaaagttagatgaaattaaaaattgccttgaagaatcaactatacccaaaataaaaaccatgaataaacctataatgatccaacataatgaatggtttgcttaactactgtgcagaacagcccaccaggctcagatgtttttatgctggggtttattgagccttcagggagcggacaaacccctcagtcgcatgcactgttccagtgaatagcagaagcaaggatgaggtgagaattagtttataatgttagcagaaacttgtaaactccctcacctgcgaaggttgatgctacatttccttccagaaatgtcaggaagttgaatccagcatgaccctaacaagtaagcaagagcctgttttaaccttttacattcatggcagcagttcaaggatcctttgagaagctcttgtaacacgatttccccaaattgatggacat

SEQ ID NO: 44808 - DNA, 1091 bp, Homo sapiens
tgggatgtcagagctgtaaggcgtgaattctggaattgggtggttgtgagtcatggaacccaggaaccattcagctgaggcacctcccaggtctcggtggtgccaggccgtgccaccggtgttttgttagagttttttttgactgtttgtaaaaggatagatttgtgctcatctacagtgatgtctgtgtactttctgtgtgaggctgagatggaagccacacgcagtccttgtctgaggctggcgagtcccgtgttactgatagagatggtgaacggatgcccgccatagtgacagttgtcgataaccggtgttatccctccggtcccctagtaacccccagtaagcggagatttcattcctggacctagctgccacgtccctatggtttacaagtgattatgggctgcctacaattctcatattctgtgaacctggctcgtgaaactcaaggagaatctactagatcttggcagtcagctcacctacccagtttcattcacaagttcttccaggaattagatcttttctgccaccgtcatcattacaactgcgatttaaacaaccgatgaagctgcaattgtagtttttcgggttttttttttctttgaaatggagtcttgcctgtcgctcaggctgaagtacaatggcgtgatctcggctcactgcaacctccacttcccagattcaagtaattctcctgcctcagcctctcaagtagctgggattataggcaccttccactaccagctaatttttgtatttttagtagagacggggtttcaccatattggccaggctggtctcgaactcctgacctcgtgatctgcctgcctcagccctccaaagtgctgggattacaggcatgagccactgcacccggcctgcaattgtagtttttaacagctgataactgaggtgatatttcgcttgctgtagctgagtcagacacttgatttaaactgagatttaagaagagtgctgggctctgacatcacagatggaggctcggtgtgtgcctcggagcgtgggttaaatgctcttcagtttcgccttcatggtgggctgtggacagaggggccaggccactg

SEQ ID NO: 44809 - DNA, 1032 bp, Homo sapiens
tcacagctcccttctccagtgtgtctgtgtctggtctaggatcacatgaaaaatgattctcgcctctgtgcccagaggggatggacaagcttggaaagctaagaatagatttaaacaaaacatacccatcactgatttaacagcaaatcaccgaggacagggagatgctgcgatggtgaaaacactgtccactggaccctcatttctctaaactaaggattctcaattggatacctgtggctgtgaacagtaggcctgttctgagtgctgacgtgacgtctcacagcggacggcctctaggtcacgtctgatgcagtgtgtggttgcccgctcgttttccgaccttcccacataacctggagcccaggtgaccctgtaggctgcggggctcagcacccattttatttaaatgaatgccatgcctccagggaggatatttcaaaggagagtctatgctggtttctgcctgtgttgatttttcaatgattgctcagcttgctttttctaattaaatcagaggactttgcttggactgcctgcttattagagccgattaagatgaactggtggagtcatcgccagaaatgaactggcgcctgggaaatagtgtgaagtccccttccattgaggttatttttatttttgaccaaccaaatccatggcacattctttttaaataaatgtagtcatcaaagtatgaaaaaggatacatactaaaatatcgacatgggctctttccatggttaggttgatggctcatgttaattttatcctctggcttatatttttaacaatgtgcagtttgcctgtattacagcattaataacaaaagctgttttttcccaagatcaaaatattcaaagtgtgttttatttctttagctgacaaatatgtactgagttctaatacgtgcgagacgctgttggcttccggcaagcagccacagacgtgatgaatgagcttcctcgtgtgagggagtctggcgcttgggaggaagggggtcaggccgcctgttagacattagttattcag

SEQ ID NO: 44810 - DNA, 1045 bp, Homo sapiens
cttttggtcgtttcagcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaagtaagtgatgctttctctcacgttcgtgccgtggggccagggtaactctcacgttcatgctagctgtggggccagcgtaagctccaccatcagcaggttcagggtttaacatggcaagtctgcagaggtgatccagtctctagaatctgtatgctgtctgactaacatggccaagtcggctgctcatcactgacttgtcccacgtgcagctggggctccttcgggttcgggccgtgcacctggccagtcagaagtggattccgtcttcccggtccagtgagctcagttttgcgtttccagttaaccaaatcaggacttggcagtgctggtctcttgagtgtgtggagctggcgtgcaggaagtcatagagcttgaggcggtggtggttccagctcggctctttgctcacctgctcacactgctgggcagcgttgtgatgtctttactcagtttccccatggaggcagtgcttgtccatgaacttcccaaggtgaaaggagaggagtcagaatgctttggcaatgtcttagcattgcacatgatttatgattattattacctaacattgttcagactgcagattttaatcttagtgtaaaaatcattaccttctcttcattattaaaaaaaaaatccaaagaacgactggctaagttttattcactttttgggctctacccctgaattgtagaacaatttaaaaaacacgatgcatgggaactttcagttaacctttcataggttaaatatgcatgaatttttcagattattttgtttctgacatgttcagaagcaaggaaaccacgtgagaacgtttaaccttttctgattgaatttgcatattcacctggat

SEQ ID NO: 44811 - DNA, 1074 bp, Homo sapiens
cacggaggggtctgagcagcgcgtccagccacagccctgagggttctggacacagtgaccgatgtgggaccccaggagtgacgggttagccccgatttctctccctggcccctgcccgatgcactgcatggcctcgcctgtaggcagggacagtgcctggtctccaacgtgtcctctccagagtaaggtacttctgggcggcaagggtcactgttcttgctccttatgcctgtaagagtgaacttcgttttgaaggtgagaggacaggcacagcggaagcccaccatggcaaagctgtcgtgttttgaaatacacagcagtcgaaatgaaggaaacagaacaaaatgcctctgtgctccattgctgtgggaagggctgcttctgcgtcatctgaacgttgtactgtaaaacagcacgtgtgtgtgtgtgggagatgaggccaggactcggcgctggttttcctgtatggcgtgtggatttgcaggtccttcccacgactcaaaagtgtcattataacccttgaacgagtactgagagcaaacacaccacctggccaaaggtagcagggaggttggctttccacactgaataccgtggatagtccggaaacagtcttcagtagctttcctgcaatgcgacactgaggtcggcgtgcctgtggaatgtgacaccaacagatgagcccctcactgggggagcggatgcagctgctcattactgtgaagctgctgacctcctgccaccactctctgtgtcctgtgcccctgtgtgctcatgcggcgtgttcagtgcagatgaacggcctcccttcgtacagacaacatctgtatgctgagaaaggccttcaaacatacatagggagtaaaaccacaaagagctctcagagaggatgggcgctgactccggatggaaggcagagtgaaaacagggtaggcgtgccatggcttttcagggatttttgatgaaaatggcatctgaagtgaatggagcaaaacagtcacatcacagattctgggcagtgggtaaaaatgtgtccatgagttattctacttttctacatttaaagagtatttc

SEQ ID NO: 44812 - DNA, 1057 bp, Homo sapiens
ttcttggcctttagcagtcctctcaccttgtgctcccaaagtgctgacattataggcatcagttaccacaaccagcctatacttgtgttacaaggttgtgtttatagagtttatcatcaaagtttgcgaatgaaagcaaatatgtgtgttatgaaacattttaaattataagcattctgtaaggataaataaagttgcgatgtgtaactactggatcagtttgctctttcgtttttttttgtttgtttgttttgatggagtttagctcttgttgcccaggctggagtgcaatggcatgatcttggctcaccatgacctcctccgccttccagcttcaagcaattctcctgcctcagcctcccgagtaggtgggattacagcatgcaccatcatgcccagctaattttgtatttttagtagagacggggtttctccatgttgatcaggctggcctcgaactctcgacctcaggtgatcctcctgccttggtctcccaaagcactgggattacaggagtgagccactatgcctggccgctccctttgttacgaaacttcatgatacttcaaatgcagttagtaattgcatttgtctagatagttgatacaaatcaggcttaccatgttcataaataccatgtaatcatgtcttcaacataaagtgcctgcaaaattataaatggttatgctactcctcagttatatagtaaatatttttagatacctatatctgaaatctttttattggaaatatgtaggttctttcagttttgacatatatatgtattatatctgttatatacactaaaagaacaagctgcataatttgtgggacgtagcatagaaggaaaatgcagagtcctttcctcaaaattattaagaatttcaggatgtccaggccaggcacggtggctcacgcctctaatcccagcacttgggaggccgaggcgggtggatcacctgaggtcaggagttcgagaccagccttgccaacatggtgaaccctctactaaacctctactaaaaatacacaaattagctgggcatggtggcaggtg

SEQ ID NO: 44813 - DNA, 1100 bp, Homo sapiens
cgccactgcctctcacttctcacatccacagctcctgcttggtcagtgttcctagttgagtgtcagaaattgaacaacccaattagctggtatttcatttgtaccaacctatgaatggaggagtagccttaattcccttgggggcttccacttctaagagaactgttttccgtccaggtaggcagacctgtcatggctgaagcttcatcacctggcctggtcatagcccccaggccctgtaggcaggacaggggcttggcagattggcatccttcccacaaaagcatgaaagtaggatgtctgtatgtagcgacaacaaatacaagaataaggagagtttaacaacattctcaaagttggtggaaaagaaaaagaatcaatgaaaacatcaccctaaaccagctagtgctttctgtttacagggatcagaccccttcccacttaaaaaaaaaaagacaaataaatttaagtttaaattgggaaactaactgtgctatgtgttctcgttgtagagattcaaacacacaggaagttcatgtacactgttgcagcaatgctactttagaaattccacggcaggcgtggtggctcatgcctgtaatcccagcactttgggaggccgaggcgggtggatcacaaggtcaggagtttgagaccagcctggccaaacatagtgaaaccccgtctgtactttcacatagtgaaaccccatctctactaagaatgcaaaaattagccggatgtggtggcacgagcctatagtcccagtttctcaggaggctgaggtggcagaatcgcttgaacccaggaggcagaggttgcagtgagccaagatcatgccattgcactccagcctgggtgacagagtgagactgtctccaaaaaaaagaaaaaaaaagaaattccacagcataccacatgttgacttccaatgagctacttgggatgcattcttactgatgtttttcctatttgaaaggtttattttcttagcctaggtcattgaatattagtgttaagttattaaaattgataataatctgcttcttaggattttaaattgaggatagatgggcccttaccttcatattgtgatgagt

SEQ ID NO: 44814 - DNA, 1030 bp, Homo sapiens
gagagccgcctccctgctgcctgtgttcctaccactctgcactcaactctttcatgaagcttcgtggaggaatgtgtgttgataggactttttcatataatctggatttttttctgtttttctaatttctattaaatgcaatagaaataacatttctattacgtaaaatgtattttatgcttatgtcccccttttttcccctgggtttactagcgagcatctctccagcctcttacttggctgcattgctgtcctgtccactgtggagccccgtgcagggctgtgttttcgccttgtcagacgcgttgcatgatctgtaactgagatctgctgaacgtgtctcttcgcatctttctcaccaagagctgtccggcgtaccgtgtgggagcgtgcgaggcagcctgcgcagaagcgcatagcctgccacttcgttcttggtggtgagggacgtggctggctggaggcctcggcccgggcagagggagggggaggctgcttcctagcccctcactgttgccagagctctgagctttcaagggacttaaaaatgtgaaattctgtgggcaatttccagatttttaagtgttagttcaaaacgtcattagcgtgtgcctggttccggctgcgatttgggatcctgctgagggctctggcctgggacacatacacagggagaagtcatcccaagaaagacaagcccacactgcagaatgacccacccaggtgctcagagaacaaagttcagttgttggaagttaaaccttaaccgagggaaacgtctgaagtaggccatcgtgtcattgatctttgagttctcgtttcaaaggaatggtgctattggtaggacactgccaagccacacctgacagccaggatccaagcacagtgggcggtgcatagagagagctctgacctaggattcacaaccctgcgttcttgtgccactccatgcccttcagagtgtgtgaatgtcagagaaaattgtagctctgccctgagcccacatatttctggaggttgccgtgtgccg

SEQ ID NO: 44815 - DNA, 1101 bp, Homo sapiens
gcctttccaggacagcagagctaagaggaggcacagactcagaaccagggtcaggctgcaggcaggcagtggggccccatgccatagcttggagacatcgaggaaggttccagcaggttctgatgggcctggggggatggatcctgtgcctcccctcgccagcctgcccatgtctcctttaggacacaagctcagtggcccctcggcaggcgcaccatgcctgtgtctttggaatggccattttctgggctcacaaaggagccaggatgattggaaaatggcaggcagttgggttgctggtgtttggttgctggagacgcctgtgatttggagcaaagcctgctactgtgttgcagccactgaatggcgctccagctggacgccacgtggacccaacaggccccactcagactcactccacggggctagcagacttgacctctcgatttcacagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccaggtaaggggacgggacggggcccagggatgggacagcaaccggggacggacgtggggggtgcggagcgctgtcagcccaccttagcgcttcccagtgcaggacactgttcacaacatgctgccaggtaatggggtgggacaaggcccagggacagacgtgggagtacggagcatggtcagcccactttagcgcttcccggtgcagggcacaggtcctgaaggagccgcgtgctgggaggagccgcgtgctgggaggagccgcgtggcagtgccatctctgtaggtcagagtgggtgggagacgatttctcatcatcggtgcaacaaggccctggggaagccaggacctgaggctgaagaacacagaacaggaggcctccctttggctgggagggctgttggggagaggccaacagaggcctatgtttgtgaatgccctgttgctggtgggtgtcactgaagtttctgggcagg

SEQ ID NO: 44816 - DNA, 1048 bp, Homo sapiens
tattttatgttgtgaagaaggaagccgggatctccgtcgttcctttctgtattttatgttgtgaagaaggaagccgggatctccgtctttcctttctgtattttatattgtgaagaaggaagccggggatccgaaaaggctccattgtgctattgcaatgtcagtaagagctcaggctggaacacatggcctttctggacacagtcccgttagggattggaggccttaaaacatgcttgtgtgtctggaatcaggattcccaatccagggaattggcccaggaaacagcctaagctaggaacaaagtatgatgcaagaagacatttgccacagcatttaatttttaacagcacgaaacaggaggtgacccgcagttcgtaatgacggattgggccatttaataaaatggtggcattgccggtaatgggtagaacacagccagcagaagtggtgtgtgcagagcctgcagtgacgcggaaaactcctcgtcctgttaagttcagtaaaccacagccttagattctatgtgggttactatgtcagccagggggaaatactaacagagaaaacgctttgcaggaagcttgtagagcagaactgttcctacgggctccatttctgtgatttcctcccaggccgacctgacggtggcttccgtgcactcagattttggcaggtccacccacaaggattaaggaattctagttttgccattcatttcctaatttatgtttttattatgatatatgggattgtacatgttgaggaccccaaatccaaaaacaaaatgcgaaatgctccaattttttttttttctttttgagacgtagtctcactctggcacccaggacggagtccagtggcacagtctcggctcactgcaccctctgcctgccaggttcaagctattctcctgcctcagcctccctagtagctgggattacaggcaccagccaccatgcctggctaatttttgtatttttagtagaggtggggtttcatcatgttggccaggctggtctcgaactcctgaactcaagtgattcgc

SEQ ID NO: 44817 - DNA, 1039 bp, Homo sapiens
ttccattgccttcagatttgctccagcaacaacctcgtgtgtgcagatttatggtaactggcattgcaatgctcccatcagggcataactaagtaaaaattgtaatgaggtaaagcctttgaactttccatgtcagttgcacaggcattgctggccatagcattggacagcacataataaaatcagttaaaagatgttgcttacattatagtgatgtgtagcacagccacgttcggatcaattacagaccgccaagttgacggtggtcctgtaagattataaaactgttttccctgtgtctttttcatgcttagaaatgtgtagatacacaaacaccattgtgttacaattgcctgcggtattgtgcacgctgcacaggtgtgcagtctggagcaggagtctgtgcagtggagcacaggtgtgtagcaggctgcaccgcctaggtgtgtaggtgccctgtgtgatgtttgcacagtgatgaagttatctaactatcatttctcagaacctgtctgcatctgaaccattcgtgactgtatttaagccagcattgggcttgggaggaggggagaaagcttaaatgttgtggctctgagactaaagaaattcccagggagcaggactctgtgttgactgatgtctgggcctaacttgaacctcagagcaccttgctctgggtggatggaagaatccggaaaggtggtttggagcttatcgcatcatttgtaaactccaatacaaacccgcttcaatggggtttccatatgttccggtacaggtagcaaccttggcagtgggagcccagcaggtcccgtctttgtccctgtgctgatacagagagactctccgtgctgtggacgcctccatctgggcacatgtttcagttgttttctaaataccaagagcacagattgctcagtaataatagctctcctgcaaatctggaatcacttaggcagctgcagtgcctctaagcctccttgcatccaaggctgtgatcaaggaggactggtgtctgagtgggcttgagaagggcccg

SEQ ID NO: 44818 - DNA, 1003 bp, Homo sapiens
atcagtggtcccctgggttgtcaggccttcagctttggactgagttattctattcgcttccctggttctgaggcctctgacaataaactgagccatgccactggcttctctggttctccagcttgcagatagcctgttgtgggattctcagcctcaataactgtgtgagccagttcccctagcaaatcccctctcatctaccggtctatctagcctttctgttggttctgcttctctggagaaccctggttaatacagctatggtaatatgttaagggatatacagcacaaaaagctgtcatttgtgacatcaaaaacataaaatgggtggggggcaggagttaaaagtatagagttattttattgaatcagttaaatcgtcagcttaaaatagactgttacaactataaggtattttatgtaagcctcatggtgaccacaaagcaaaaacctacagtaggtacacaaaaggtagaaagtcaagaatcaaagcataccacaagagaaagtctaatcataaaggaagacagcaagagaggaagaaaggaacaaaagacctacaaaacaaccagaaaacaattaagaaaatgggaatagtaagttcttacctatcataattaccttgaacataaatgcattcagttctccaatcaagagacatagagtgcatgaatgggttaaaaaaacatataagaccccactatatgctgcctacaagagacccactggcctttgaggaaacacaggttgagagtgaagggatgggaacagatactccacgcaaattgaaagcattagagagcagagggagctatgcttatataagataaaatccacttcaagttaaaactgtcaagcagcactcagaagctttgtacaatgcaagcagcattttataatgccaaaggggccaattcatcagaagtaaacttttagtatgagttgctgagcacttttttttttttttttagacaggatctcactgtgtcacccaggctggagt

SEQ ID NO: 44819 - DNA, 1044 bp, Homo sapiens
cttgctctgggggagagaaaccgggctcagctctgagtacagcaggaaagtgggagtgagaccaaggagtagggtagggcggatgggaaattactagggggagatgggggtgagggggttccggccgagcctccccagcagggttctggctgaaggcaggctggggccatcagacatccctggggatggaggggtgaggagcccatctgctatcgagggaggggcttgagttgggctgagctggtgggattcttactgttgagggcccaccaagcctggggcctggttgggaagagggttgaaaggagctgtctccggtttagtgagggagggggtctctgtccccatccagcctggtgtttagtgagggagggcgtctctgtccccgtccagcccagtgtttagtgagggagggtgtctctgtccctgtccagcccagtgtttagtgagggagggcgtctttgtcccctccagcctggtggttagtaagggactagtctttgtccccgtccagcctggcagaaagttgggctctgcctggcttctctccctctgtctggctcctgccctgtgccctcccccagcatccttaccaactcttcctcttcctgccttcccttcctcctgttcccgactctacctggggcggtggcttcagccagctcttcctgatgctcatcctggtggcctgagcatggcttctgcccggtggtgcccctccccgagtcagggggtccaccagctcctctgtgtgtgggactccctcctgcttcctcctcccaggagcctgcatggggcctggggcctttgtcctgctggaatggtccaccctctgcagattcactagagttgggtgttgaaaggcaataattgagattgaaatttgcagggcatcctacctcatttctccagataaatccgggtttctctaggaaagctctccttctggcgggctccttggccctgctcacagagagcttgctgtgtgcctggtgctatcctggatgttcgagaggcttcaggggccaagacaaggatgccgcc

SEQ ID NO: 44820 - DNA, 1050 bp, Homo sapiens
gtcccactctctggcatcaggaggcaattgatgagtgaaggacacagccagccacagcagctgtgggtgaggggagggggctgtggcccgttgtggtgtgaaatagatgccaggtggaccttcatggagatatcacatgagcaaggcttgaaggccagtagaggacccagagctgtggagtgggtgggccccctggcacaaaggctctgagaggtgcattgggggtcctgggctggggggttggcaggggacaagctgtcacaggcatagccagtggccctgcagatcacggggaccccgtgggccattgtaaggacattggctttgctggagggaggcggggagaccccagagggctgaggggagaaggaaggatgtaacattgacctctagaggatcactctgactgcagacaggctgcagggcctggcaggcctggtgggagcccttgctagaatccgggaaggaacacaggcctgggagcgggagggagcaggggagtgggaagaagtgggtgctctgggcagcttttgagggtagagccagcaggatttgctgctgggctcgactgggcattagtgaaagagaggggtccaagtattctcagagctgtggccatcacagcggggtaggcctgggttgggcagtggagttaggcacaggctgcaaaggatgcctctcctggggccctctccaagtttttcagagagaaactttctctccttggatttccaaaagttgtgggagttttaatagaccgtaggccgtcatgtctagaaagagaccacctgccttcattttggacagctcatgggtgtgtggggctgtctgctttctaccctgtgtgtgctgtgaatgtttaggggtaagtaggttggtctgagttccagatcagcttgttcccaagctgtgttctgataattgttttaaaaagaaaagaatgatatacctttctcaagaatgaaaaacgttgcgttgacatcggtgttggcaacatttaaactttacattgggcaccacatgggcttcgaacggaatggactaatttgt

SEQ ID NO: 44821 - DNA, 1049 bp, Homo sapiens
aaaaagaagctcccccttggtactattttattttaaatttgtaattgacactgttttatatgctcataagattttcccatgggactcatgatgtgagccctcattcttcaaagaatatgatgttctcatatttttatgaaagtatttataatagaacaatctatctggttttctatcagtaacatgctcactccccattcattctttgctgagtgattttagggtgaaacgttttttgtactttatttttagagcttgatgtttaaattttgatttaattaaattataaatccagcgtcatcaccacttataatttgaggacatgaggccccagctgcccatgagaattgatatggcacttaaccttatggctgcccatctttaagacaggacagaaccagcttctcccaggaggttgttttaggggccttcaaacagagactctgggatgccaaagggcgccatggacgtttgtataaattgagaccagagaagactctctccatctattctgggaacctgtcagaacaggaaataaaacccttgcctctccctcacttgcttgcaagttctcacagcatgaagcaaaggctggaattagactgggggtgagctgagtgcctgtgtggggcctcgggaaggggaggaagacgggggtcctttggaaactgcccatgggccaaagctgtgatttgcctccaaatcccaagtggacacaggctaagctgaggaagtctccgcgagagtggccgcccttcctcctgcatctgctccgtcgtctgcccaggccccctgcttcccggcctcggggcaggcagggggcaaaccctgggaggcagggcaagggtgcccttacctccctcccagggcaggtctttgcgtttgtttataacctacacagggacctgtgttccaacacacttcatacagtatgaaacaaggtcgaaagagaaaaggtgagacagcgggaaccataaacagaaggcctaacttacccgtgcccaccgtgggggtgaccgcgagctccttagcggggcgcctcctgcatg

SEQ ID NO: 44822 - DNA, 1050 bp, Homo sapiens
tacccacaatgtgtttattatatagtcagtagataagaatgatcgggctggtctcatgaaggcaccagtttggaaggagaatttgaggctggcagctgcaggtgtgtaaaagccttggcaggccaggcacggtggctcatgcctgtaatcccagcatgttgggaggccgaggcaggtgaatcacgaggtcaggagtttgagaccagcctgagcaacatggtgaaaccctgtctctactaaaaatacaaaaaattagctgggtgtggtggtgcgcacctgtaatcccagctactcaggaggctgaggcaggagaattgcttgaacctgggaagcggaggtttcagtgagccaagatcacgccactgcacttcagcccgggtgacagtgtgagactccatctcaacaaaaaagagcctcggcaactatttttgccctggattttcttcttatttcttcttattgcccagtgtttcttcttattctctattcttctcattgcccaatattgaaaaaaatcctgaatccaagacaagtagtttcaaatgaaaacatttttaccttgacatctcagaatattatccaattacatagaggtagtaggagaagctctgcctgaggccccggtacccatgagttaagtggctgcgtaaggttcatgttgggcttcgtgcctgacaggtgtgtgatgagctgagtctacactgacaccacagtttaaaaacggctaaaacacacggaggaagaaatgtgcagcacacgggggagattccagttgagagccgtggggcgcagtgtgaacgctgttgatgttacttaacaggcagcagcagggttttcaaggggttggctggagccctgtccatgtagcccacactcccgctcctcgagtacaagggtgggtcaaggcgttcacccttcctcactgaggaactggtcatgacggtgacctgctgggcttggggacagcccgtgccctggtccagccgggtcacatcccgtgagtcctgccctggtccagcagggtcacgtgcagcggttcctgcacgggaa

SEQ ID NO: 44823 - DNA, 1046 bp, Homo sapiens
cagaataagaaacttaaaacatgattccagtacagggaaatggttagtgaatatttattgactatatatgataaataataattgcttacacggactgaatatctatcatacacaaagcatctgtgctaagttgtccacctagagttttccatgtagtgcctgcaatagtgctgtggggtgggaattatcatccccatcttacaaatagaaaaacaaagtcttacaggggttaaggaggttgattaagaccataaaatctgtgaggtttcaaagtcccagtattcgagcctagtccatctgacttccaagtcttggcctgtaaccactgcagtgtaattactgctaattaagttttacatacacgggttcttttagataagaaatggcatactgttggataatagacctctgatccagaggaggcccagaaagtacaaaagcaaaggtgaactcacagaacaagtggctttggcaccacgtgtagtcagctcctgctataattaggtgctgtgaccttactgtcggactctacatgttgagctaattaactagaattgaaaatgaaggatgtatgttatccataaaaattttttatggcgcgttcagggtgatttttgcttctgctgcaggagagaaaaagtggagcctggcagttctgaccctgatccctgtgtttctcaggttcgtggtgcacggcttaaccacgggagagcagtacatcttccgagtcaaggcggtcaatgctgtggggatgagtgaaaattcccaggaatcagacgtcataaaagtgcaggccgcactcagtaagtcactcacaggctgttgtgtgccgattgctcccatacactgtcatttctgcatgaataaacatttgtgatgccatttggaatgtcattgaaggggaaaaggggactaaattcctgaacagagaacttgagtttctttgaagcctcttggttggctgcttgtcttggaaatgacagtgtgagagggagaaatgataatacactaataaaacgcaaattaaaaatagaaaacattgttag

SEQ ID NO: 44824 - DNA, 1061 bp, Homo sapiens
atgagggtgtgtggataaatgagtgggagagtgaacacgtgttatgtgtgtatgtgtggatgggtctgtagataaatgaatgggagagtgtgcatgtgttacgtgtacatgtatgtatgggtatgtggataaatgtatgggagagtgtgcatggattatgtgtttatgcatgggtgtctgaataaatgagtgggagagtgtgcatgtattatgtgtggatgtgtggatgggtgtatggataaatgcatgtattatgtgttcatgtatgggtgggtgggtgtgtgtgtaaatgaatgggagattgcgcatgtattgtgtgtatggatggacgggtgtgtggataaatgagtgggagagtgtgcatgttttatgtgtatatgtgtatatggataaatgagtgagagagtgtgcatgtattatgtgtatatgtgtatgtatgtatgggtaaatggataaatgagtgggagagtgtacatatattatgtgcatatgtgtatgtatggatgggtgcatggataaatgagtgggagagcgtgcatgtgttatgtgtttatgtgtatgtatgtataggtatatggataaatgagtgggagagtgtgcatgtgttatgtgtatatgtgtatgtatggatgggtatatgaataaatgagtgggagagtgtgcatgtattctgtgtatatgtgtatgcatggatgggtgtatggataaatgagtgggagagtgtgcatgtattatgtgtatatgtgtatgtatgtagaggtgtatggataaatgagtgggagagcgtgcatgtattatgtgtatatgtgtatgtatgtagaggtatatggataaatgagtgggagagtgtgcatgtattagtgtatatgtgtatgtatggatgggtgtatggataaatgagtgggagagcatgcatgtgttatgtgtttatgtgtatgtatgtataggtatatggataaatgagtgggagagtgtgcatatattatgtgtatatgtgtatgtatgtacaggtatatggataaatgagtgggagatagtgcatgtgttatgtgtgcatgtat

SEQ ID NO: 44825 - DNA, 1251 bp, Homo sapiens
tgtaattgagaaattagcaatcgttttactttatcctaggctgaaagcatgttttaactaagcttcaagaatgcatttttttgcctccaatttaccagttataaaacgatatattcaatgggtttgccagaggaactggtaagagggatccataactctaaatagaaaggaaatttgggagcagactggatatatctactataaaacatagagcttaattaaattactttcaaattctttaattgacttaggctatggataaaagctaagaataaataggacacatgctcactgatttttttacgagctcgcctgtgaagtggtgaacctgttccctgctgtcctctgcctgctctgtccagagcggcgctcatgtacataaaggcttgtttctaaacaaacgattgaaggaccaataaatgtaactgagtgtgacctggagcccaccgtccgagggggtgacatgactttcctttttctaactcttccttctccaccaacctcttccgtccaaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcat

SEQ ID NO: 44826 - DNA, 1110 bp, Homo sapiens
gtggaggcagatagcacggagaaaggacactgtgaggtctcagcaaagacagcccttgagagcttcccagaggttgggttcctgatggggatggtggctacattactgtgttcatttggcaataattcgtagagttttgtatatatattatatatatatgtgtgtgtgcctgtatatatatatatatatatatagcttgttcactttccatgcgtgtgttatttattttaaaatactttatttatagagtagttttagtttcacagcaaaattgaacgcttcttctctacacactccctgcctcactcaggcacagcctcctcgttaaactgacatggcacactggcgggcgtgtctgatcaaaagctgcttgtgccccaggggccgtgttttagctagtcctcaatgtggtccattgtccaagccccacctctggagtcaagttccacctcctacttcactgttaatgaaaataataattgaatcatcttgaaaaagaaatctccaaatgatccagttacactgtttctcatagacatgcgcttgggtgcctaatagtccttgtaataagagggttatttttcacacctcgctgagacctcctgacccactgctccctagtgggtaatggagaggacgtggggaaagaatgtgggtcccagtcttctcatcacagcctcatcaccagctagtcctgtgaatttgagcaaatcctaaataattttgtatcacatttgtcagtcatgagaagggaatagccatatgtagctctgtgtttcattggatgtatgaaaaagtcaaatgagaaaatcacacaaacatgaagtataatatgtaaactatcatgtggattaaatgatacagtgagagctaattaggatcaccgtacctgcattaatgtaatgctgctgcttcttttttttttttttttgagatggagtctcgctctgtcgtccaggctagagtggcgaggtctctgctcgctgcaacctctgcctcctggtttcaagcgattctcctgcctcagcctcctgagtagctgggactacaggtgtgtgtggtctcaatctcttgacctcgtgatccgccaacctcggcctccccaagtgc

SEQ ID NO: 44827 - DNA, 1036 bp, Homo sapiens
aacagtaaggtctgggcctgacatttttatgttttcacttgagagccagcctacatgctatttctgtagtgaggaaaatgatttgaaactcagatgtgtcccgtggccctaatgactttattttctttttagttttaaatctgaagtagcacttgcaggtaatgtcctatctgggcagccctgcagacaggactgtcagtcgatgagagctgtcagtcgtgagttctgagtaatgtgaaggtgccaggtagaaggtacaaaggcaagaaaggtgggaaggcctggagcctgtgcgaagagcagcacggccttggtgtggcccggggatggatgcagaaccgcgagaagagagaggctgacttcagccacggccacgggctctggggttagactgctctcatctttggttttctgtaggttcattgtgattgttgtaccagggtattgtttttgttgtttatttacttgagagtcacaggccgtcctgtctttgatctgttctggaaacttctccactgtgatttcttttgcctgttttctcacgcctccattgctgggaacgcaatctcgtgtgctatcctttgcttctatagcccatgtctcatgattttcctctatttctttcctcttgtatctccttatttcattctggatgtcttctattggtttcttttccatttcacctttgactctttttaagtctattctgatgctaaatccatatactgagttttaacatgtattatttttcagtccctgctattccatttattttttttaattattttttgtagagatgggggtctctccacgttggccaggctggtctcgaacgcctggtctcaaacaatcctcctacctcgtcctcccagggtactgggattacaggcgggagccttcatgccctctatttgatttataaaaaccatttccagttctctgtcaaaattattaatcctatcttttatttatttgaacatattatgcatatttcttttgaaataactcccttttctggctcccctcaatttctgtt

SEQ ID NO: 44828 - DNA, 1027 bp, Homo sapiens
aaacagtgctcagaagaatgcagttccaagatgatctgtattgtataacataagtgttctgttttccagttatttactgataaacttgcacataacattcttggttgtgacagcagcgtctgtaaactgtcagtctgattctcagcctcgggttcatctttgcataggtgttctgtctaatcacaattatggatgtttagggtcttgctttggtccgttaagtgatgcaagtttaagtgataaagtttacaggctctaatctggagcatgtgggtcccgtcagcaccgagcacacgccctctgtggtggaagaggacacagtgcgcagccgtgactttcagtgcactgggcttaagtctttgaaaatagttcgagacagttcctcaggtggactgggatgtttagaaatctgctggtcggatcatcatggttgtggccttgagcgaatagcctgagcctttccagtagtaccatttaatgccgttgaacttatttgtgttctgcctctgtggatagtacattccgttcaagttggaaggaccacatgcatcaaaccaccagcctgtgaaagtaaaacacagaaggaattaggaactaggtgatgccagctcccaccacgaagacagcaatactcagctaaggcaggaggcacactgcaggcgtgtggagtaggcacatgcagatgatggtgagtataggatgtgcactggcagagggattgttttccagccatacacccatgacatcacagttccattacggcaaatgcttttacaagccttcttccaccttttcccttgtgctgtgtggagaggcctgaattctccacagtcctatttggtaagcccacagtgtgtacacacttacagcaggagtaagcaaacatctgaggcacagttggaaaactctccttcaaccaggattactttgcagtcccagcaacatggtgggctggactcgctcaggctccccttgctctattaaatgattttttcggttgaagtttaaactaaaatattaagtactc

SEQ ID NO: 44829 - DNA, 1057 bp, Homo sapiens
aagctgtgcttttaaagtcattgtgtatgcgtaactccagatacttagcgtttagtttctttttttttttttttttttttttaaataatctaatgatgggaaccattcttccattccctggtccaaagtataagctcgtgagtgcacaaaccatgttttcttccttttcacatagtgtaacaaacattgtttattacattgaataattgaaagatgattataaaactggttctggtgccctcctttaaaaacttagaattctttatagagaaaccattcgtggagtcagtcatcagacatgatttcccccaaaatgttaaccactaaataattctgtgctttctgtctttaagagtaggaaaataggatgggaagggtagagtttctctcttagagcttctttgttgatgcatttcatagattgtgtcttgtgactggtatcagatggttttaggattaggctggaactataagtttcctgtttccgatgccccctcgccatcgactctgccccacttctctaagctcccagctccctgcatgcccctcagcctggtcactaaggctgcctccctggcagtcgttctcccgtggatattggatgggtcagatgagcaggatgcatgagaggcacagtcagccctccatctgtggcctccacatctacgggttcaaccacaccatcaatatattttaaaaaaaaaataacaatacaacaataaaaaacaaaaattgtaaaacaatacagtatagcaactatttacatggcattgacattgtgttaggtattctaagcaacctcgagatgatttagagtatacgagaggatgtgtataggttatatgcagatctaccctgttttacggaagaggcttgagcaccgtggattttggtattctcgggaatcttggaatcagtcccccacagacatcaagggacagttgtactagagctccaagcatgtgtaaaatcattttgttgaaatgttactcaagccatccacccgcctcagccccccaaagtgctgggactacgagcgtgagccagcacatctggc

SEQ ID NO: 44830 - DNA, 1031 bp, Homo sapiens
ttggagtaagggagacagtctgaatattcaagggcaacccagcagtgttcaatgactgtcagccactggaagaattcatagctcaaagcagttcaccgtttcaacagtatcagcttgtacctctgtaaagctaggtttttggtggttgctgtttgtgaaaagcaagtgctacaggaaaattagcatagagcgtaaaatgcaggtggcagtgtccaatttgattccaaagtttgagaagccaggtgtgcctaactggcaaatatattccattcatacgtcactggggttacttaagaaagaaaataaaggatctttttttaaaactcaatttatatgtatattggtattttcaaatagctactaaattgtcagaacataaatacttaaattatttggagctaaccgcttaatacaagcaactgttggcctagagataaatagagaaaaaatagtgaatcactaagggtcccatgagctgagaaagtttgagaacaactagcctagaagcttgcacttggtaggatataaactcaacgtaccctcttcctccccttcccccaatccaagtattgcctttaattgtaatctctatgatttgatatgtttatcggaaagcgagtaagtcaaaaagaactaataaattgtgtaagaccttcattaagatgtacccttccgtgttttcctaacttctgaaatcactaggaaaaacagccatgttccttgcaagctggctggttagtcctgtcttctttcaggtgaacagcatttataaccacggtgtacctcggaagaagcgttctcagagcaacatgcacgtgttccgtgtgtaccgtggttgccttcgggctaatgcgtttttggaagtgtagataggtgccagttttacaaaactcatgtggcctatttctgcttgtaatttatagtttgcctcctcaccatcctcacttgctctaaggtgaactagttttataccattagattatacagaaaagtcaaatttacttgcatgccacagcaattcgggaagtaaa

SEQ ID NO: 44831 - DNA, 1083 bp, Homo sapiens
acatatatacagggagagatagaatggtttgcctgctgacttgccattaagtaccgtaaacatcctggaaattgtgaacagctaattggaaaacagtctgtccgtgttcatgattcattgtatgcatcctctagatctcaactcaggaaatccacaaagctgaccaggccctgctgtcattttgtggccagatatggaaagatataaaccacctcctttcttccctgtcaaaacagttgtgccacgtcctccccctcttcctcatcttgactgactccctcacaggtggtgtctctgtctctcctgcccctgcccccacacgcacctttagttacctcagtctttcaaattttgctctttgttcctaagtacagtcttccttccaacctctcgtcatgtcatttttgggccaggaaagatcctgattatgctataatgccactgtacgtgttttaaaaagaaggaacgctgtacatttgatattaaatttggcattttaaataaagggctggtaaaaaaatctctgagtgctaatctccaagaaagggatggaagactggggaaagagaatctacttcctatttccaccattttaatagcctgacatatttttttaccttgcccatatcttactttcataacatttttgttttattttttaaattactcccatggcggtagagttgatttgaactcttgtttttcaattttaaatgtacaaaatttcaattattttatggattaaaataagcaccccagaccatcctgagcatctgatcaccaatggtaagaccattatccttctcaagtttcatctacggtaactggcttacagataaacttgtggattacaacctgtttgacaactgtaaagagccacattgattaaaatcagaagattttcagagttcagtatttagactatatggattatctagtgtctcaatagaaggtaaggttatggaaatccatttcctagttctaaactctgcaagcaaacaatcatctccccatagtgtgatatctaaatagttaatccagtatgtcagacaaccccatttagtaaacaaagactacttgacc

SEQ ID NO: 44832 - DNA, 1035 bp, Homo sapiens
gtttgggttctgttctaaggataaatggaagtcacagaacgattttaagtgggaggattaggctgcggtatatgtttgtttactctgtttgtgtttatttttgttttaatggatacagagtctcccaatgttgcccaggctggttttgaactcctgggctcaacggatcctcctaactcggcctctcaaagtgctgacacatgtttttttaatggaagcagagaaagcagtctcggacctttgcagtggttcaggtgattagtgatgggggttaggaccagggacgtatcgatggaggtgttgtgaagttgtcatattttaaatatacatttcagagccaggtgcactcgctgatacattggatgtggcatattagagaaagaagactcgaaggtggcacctagtcttgtgttctgagcttccagaatgaggcatctagaagccaggacccgggagaagcacggaaggagcagtggtttattcagtctgcagaagcagtgcctacaggactgctgtgtgaaagaggacacatgtgatatgagcagatgaaaatcacacagcaggcagctctgggctcattatgagaaacgactctaggaatatttgtaacctgctgggctctactgctaagggctgccttaagccatgaagccgcagaggctgggtgaccaccgtcccacagtgagggagctgggcaattccttaccagagtggagatgtggctagatctcctagccctaacatgcttacttattttgataagcaaagatgaagctcacatgggtcccgtgtgctcttgaacttctgtacattgtaccattaaccacacttggatgctggcaatcgcagttttagttaaataaagtgacttgcccaccatactataaaaaattaattttggtagcatgttgattctgtatcctaaccataagaccacacagagccatggctagtaaactttagcttgtgcgtaaatgcctgccaagacctgctaaatactgttgcttacatttaaaaaaaaaaaaaaaaattttt

SEQ ID NO: 44833 - DNA, 1048 bp, Homo sapiens
tcgtgaattacctgtcctgatcccttaactgttttgaaattgggttatttatatttttcacatggttttacagcaatgtttacataatatggacattaaacttttgttgtgttataaaactctgtctctttagctgtgcttatggtgtcttaagtattaccaagtttttaatttttaactattattttttacaaaattaaacacctcttttcctccatggcacctacccttgtggttttgcttagaaaggccttcctcaccctctgagctttaaaaataatctcatattctcctatttatagttttaaaaaatatttagacctttaatgcatgtgcatttcacttactgtataatgtgaggggaccatgttgtttttaataactaatttattgacactgacctatattgccccctgtgagtcatctcttacattcccacatggtatgggtgtgtttctggttattctcgtccattgatctgtttgtctattctgtgctgacctctattttactgctataattgtacagactgttttgatatctggtatgtcaaattttttctcatcatttctctttttaaaaatcatcttcctatgcatttttttctttcctataaactttagaataaacatgtcgttttctttttgaaaagtttgaaatttttggattacattgaatttctagatgaatttggaaagagcatcattttttctgcatttttttatgatttttcaaaactgacacctagtcagaaaactaagtgtaaaaattgaatccatagagtttttacaacctggaagaaaatacaaatgtggctgaatgactttaaaccctgagtatcggaaaaggcttccacctacctatgactcaaaagccagatgcaataagacaaagtgttgatataatttgaatacataagaaattgaaacttatacatggcaaaagtttgcataagaaaagtcaagccaggtgtggtgggttatgtctataatcccagcattttggaagactgaggcacaggaagattgcttgagcccaggagttcgag

SEQ ID NO: 44834 - DNA, 1026 bp, Homo sapiens
atatgttgtacttcattttaccctttcaacaatcctattagtagcttactgtgggtctgcaaagccttactcaaaacatatagggctagaggttctcaggattctgaattttaaaaaaaatttgtaaaggcttatggctctcaccactgttattcaacgttgcattaaagtttctacccagagaaggcaataaaaggaaattaaagctatacagattggaagtgaagaaataaaagtctttattctcaagaatacaagacactatgtatagaaattgtaaggaatgcaaaaaaaaaaaaaaaaaaaagccctacaagaacttataacaagtttagcaagattgcaatatacaatcttgcaatcttcctaaagattatatacaaacctaacagaattgtatttatatatactgtcaataagcaattcaaaatgaaattaagaccacgattccatttaaaattgcatctaaaaataaacaaaataggaatagacttggcaacagttgtaacatctgtatactgaaacctgtaaaacattgctgaaagaagttaaagacttctttaaatagagacatatacaaagttcatagattagaagatgcaatattgttaagatgatagtcctcaaattgacgtatagattcaatgcaatccattaaaatctcagatggctttttatagaatttgaaaagctgatgctaaatcttttatgaaaatgcaaagaacctctagtagacaaaacaatttttttaagagcaaagttggaggatttatagaacctgattccaaaactgtcagtaaaactacaataattacaaagtatcagccaggtgccgtggctcacatctgtaataccagctctctgggaggctgaggcgggtggatcacttgaagtcgggagtttaagaccagcctggccaacttggtgaaaccttgtctctactagaaatacaaaaaattagccaggcatgatggcacacacctgtaatctcagttactcaggaggctgaagcagaatagcttgaac

SEQ ID NO: 44835 - DNA, 1036 bp, Homo sapiens
aatcagtaggtgtgtgtgtcttttacgtctcaggaattgataagctcacctggaaggagaaagcaacagagccccaagctttagccatagggaactccaaacattagatctggtaaatgtagagaagctgtgtctggcaaaagaaatacttcagctgagttaaatttaaaggaccttcattgggtaatgaacggcaaatcaggcagcccccagaatcacagcgaatttagagagaccccagcacagccgaagaagatttatagaccaaacaaagggaggtaatgtacagaaatcaggggtaatgtacagaaacaactgggttggttacagctcagcatttgccttatttaaacacagtttgaacactcagcagtgtataaatggttgaagtatggctgctgggattagccgagactcagctattgttacaggtgcatactcctaagttaggttctcaatcttgtctacctattaagttagattgcagttcgtccacaaggactcgaatataaaagtactggagtccttctctggccatatttagtttgctttaacactacccaagatagagagttcaaagtcacaaaatctaagaagaaaacatatttcaagaagtcactggttagttaactgttgaaagctagctgagaacaatagatctgagtagaacctctttaggggatcacattgctgagaagtaaagctctttgtcaaccaaaaatcaagatcccaaacatctctcatctctgctcccttccctccaatgtgattgttcctccccttctttgcttctctttgttctttaaatttatttttctatattcaactcaattctttttccttctcttccacctcctatgttcccttcctttctggaggcccaaatgatttcattaaaatcaaggtgtcagcagagattccttactttctggaggcgctgggtgggaatgcgtctcttgtctcttctgggatctaaaggtaccgccttccttggctcatggccccttcctccatcttcaaagccagcaacggcagg

SEQ ID NO: 44836 - DNA, 1051 bp, Homo sapiens
aaaatttcaataattcaggctaattttttccctttatatggtaactccaccaagtttgtctaaatgtatgatttttatcatgattaagtttttacttccacatcatgtgacaactggcctgggatgggatataagctcagaacacaaagtcattcacctcttaaaaaaataattctatctgtggcgggttatgttatttttgttcaaagaggacacaatatgatgcagaatacaccattgaaggattttttggtttggcaagttcttatttttttaaatggctgtaaaacctagcagtgtttctgaaattgcataccttacctgatgttcagagatccgatttacttcttgatttcccagcaagtgattttgaaaacatttaatctaatcattccccccaccgtctgttcaaatcaaaggaagtggcatccagcactaattttcatgcatttatgaaaggatgcctgaggacccttaagtataattcaaaattttgtttaatgtgtgttccttgatgaagttctttaggagtcgtagaacgaactgattgcccactgatcatcaaatgcaagttatgaacatttaataaaaatttaaaaccaagagtttcttgttcctgcatttttatttttattgtatggaggggacaaataattattttctgtttagtaacagagcagggtattttgaatttattagggtctttttctgcaatctgggtttcctgtgtacacaaagctacctttcaatattttttattgtttctgttaagattaaatcaatagaggaataaatagctatcttcaaacataagacccaaaggaaaaagatttatagtgatgttctgtcaccttattttttacctgtgactttgtaccattaactttgtcactgagatgttttgattaaaatttttagcttgcttttcttgttttgttaggacactctttttttcttgaattgtttttatcagctttcgtttgcaaggctagtgatgattctcttgttctgtataaagtattgttgactcatttctgaagggagttttagt

SEQ ID NO: 44837 - DNA, 1463 bp, Homo sapiens
ttccttggcttggggccccatcactttaacctctgccttacagtccttgctgccacctcttctgtctcacatctcactctccctttctcttagaaggatgcttgtcattgggtttagagcccacctggatattccgggatgatctcttcatctcaagatccttaattataactgcaaagagcctttttccaaataagaaaacattcacaggttccagggcttaggatgtggacacattttttgaggggctgcccttcattcccccacaacaatgaactccatagttctgcctattcagtattttgtagttatttcgtagtttaacttgccttatttctttaggtatttacgtattaaagcattttggtctctgctttctttaacagagaacctggttttctgtaataagtttacttactttcccataatcttttagtttcttatttacagatttaccttcacatatcccttaagtagaacatttgattaactgttttattttcggaacaaatctgcattctgtataataaccaacttattcatatttcggtattcttttaattcttatctgattctgaaattaccatcttgtgattatatatatatatatatggaaataactgaaatcctgataaattaaaggtgatataacttctaagacaattaattatgtatgatgtggtgaatatactggtgtttggtttgtttgccacttaaaagccctatctataggataggaagtaacttgaatgtggaatgcttagagactcagagtaagaggccgtatatatatccttgagctggagtttaaggaaaacttatgggaaattaaaaggaaagttggagtactgacagaggattgggtaggactcatgaaaaaggaatgaagttaccttaaattctatcatcgtgagttaacgtgaaactagatttatgttagtttatagcctagaattctatcctaggaatctagatatatcctaaatgttgagatagctgcataaacaataactgtaatcgttatgataaataatgacaaatctttttagcatgttctgtgaagctgataaatgttaataggatgtcttcaaatgtcagaattcttttttctttgcttcttttttaaaaaatttcttttcccccattcctatgcaatacactgaaaactgatcattgaaatttgtaggccaaaaaattaatcaacacgtaatagattggggtttgggtttttttgagtcagggtcttcttctgtcacccaggctctggtgcggtggcaccatcattgctcattgcagccttgaatgcctgggttcaagtgatcctccggagtagctgccgtgccattatttctagctaatttttaaaagtttttgtagaaatggggtctttctgtgttgcccaggctggtcttgaattcctggcctcaggtgatccttctgccttggcctcccaaagtgctggg

SEQ ID NO: 44838 - DNA, 1029 bp, Homo sapiens
gaacctttatcattttattatacttgcagttctcttaaattccctgcttgataattccaacatctgggccatatctgagtctgcaaattttgattactttatctcttcagattgtgctttatcttgcctttgtcatacttcctaagattttgcctaacgctgggccttttttgtaagacaggagaaatggaggcaagttgtcttgatacctggaaatggatagacttgtctttctgcttggcctttagtgttgaggagtggagtcagtccactgaggaggtgcactgcatttgggttttgctcatgtgctttttctcacagcttcaggtttctgtagaactcattactttgtttgtaggttggggatgtcctcccgctagagcttttcctcagtgtctatttcacactcagcgttttcacatagcaccttggagtggctctcttctttatgcctttccccactatacttcttggatacttgttactgaactctcgctagtttggtggtagaaggagagggaagggaagtgtcttttcattcttagggagaatctcaggggtggagccttctctgatcctgccttgcttctggctgtaagtctgtgcccagtatgtattcctgcctttactaagagtttttccctgttctcttcacccagcctcatcgagtattcatccgtgccccatgggtagcagggttttgttgcccctgttcatcagtttcaggctgctgttccataggaaaggtagaaagaaggatgtgggctgggccctgagcccttcccacagggctgcttttccctcccacaagcctacatccagtcttccctgaccgcagtgtgttttcctttttctttgtcttgtgagtacacaggaggtctgtgggtcgagcctgtgaaatgtgctgcattctccttgtgtctgtagcccaggggttcgtctgttccactggctcatacttggctttctgcaaaattgttaaaatttttagctaaattctttttactggtatctgttacattggccccc

SEQ ID NO: 44839 - DNA, 1028 bp, Homo sapiens
gtaactactgtgagagatcatttgtttatataatggaaacaaagatgaggaaagaacctggcttagatcagagaactgatgtatttagattcttttttttttttttttttaagacggagtgttgctctgttgcccagactggagtacagtggctcaatctcggctcactgcaacctccatttccctggttcaagcaattatcctgcctcagcctcccaagtatttgggattacaggcgtgttccaccacacctggctaattttttgtatttttagtagagacggggtttcgccatgttggccaggctggtctcgaaatcctgacctcagatgatccacccgccttggcctcccaaagtgctgggattacaggcgcgagccaccgcgcctggcccaatgtatttggattcttaaagaacactttcaaattaaatatcagttgaagagaactagaactaaagaatttctgtgtcaaactgtttagcaaatgtaagtagaagctgggagatgtgtcctggaatgaatgaatacatcagtaaaataccatacgtatgttatgatgttattgtttccttgccttggttgatttggttttactgtgaaataattttcaatatagaattgtgatcgttggaatttggtcatctagtagaaaatgagaaagaagttaatagctatcttccttaaagatttctgaggttgggattaaggtagtgttcccaaggtgttctaaaacggcagcgagagctgtgcactcacttcacaaatttgaattcctgctctgtgttaggcgctgtgctaggggcttagcttagcacagttatttccagaggttcctgtgtatggtgtgaagaaagcttcacaaagactgtagtgaagccaaagatatagtagggaatgaaagcaaggcatcaccacttcctgtgaggacacgttactgcacaggcacccgagctgtgtcatctctaccatgtgccttgttcaggttttggcagagcccctaagcatatgcccaggaagggatctatg

SEQ ID NO: 44840 - DNA, 1083 bp, Homo sapiens
aggatattggtctaaaattctcttttttggttgtgtctctgccaggctttggtatcaggatgatgttggcctcataaaatgagttagggaggattccctctttttctattgattggaatagtttcagaaggaatggtaccagctcctccttgtacctctggcagaattcggctgtgaatccatctggtcctgcactttttttggctggtaagctattgattattgccacaatttcagagcctgttattggtctactcagagattcaacttcttcctggtttagtcttgggagggtgtatgtgtcgaggaatttatccatttcttctagattttctggtttatttgcgtagagttgtttgtaatattctctgatggtagtttgtatttctgtgggatcagtggtgatatcccctttatcattttttattgcatctatttgattcttctctcttttcttctttactagttttgctagcagtctatcaatttggttgatcttttcaaaaaaccagctcctggattcattaatattttaaagggtttttgtgtctctatttccttcagttctgctctgattttagttatttcttgcctcctgctagcttttgaatgtgtttgctcttgcttttctagttcttttaattgtgatgttagggtgtcaattttggatctttcctgctttctcttgtgagcatttagtgctataaatttccctctacacactactttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagcttgattgctctgtggtctgcgagacagtttgttataatttctgttcttttacatttgctgaggagtgctttacttccaactatgtggtcaattttggaataggtgtggtgtggtgctgaaaagaatgtatattctgttgagttggggtggagagttctgtagatgtctattaggtctgcttg

SEQ ID NO: 44841 - DNA, 1034 bp, Homo sapiens
gtttggttttctaggttaggcagttctgatggggtttctggaacaggcagttcacactggagtccctccttctggatcacatggaggagagccacagggaagctctgagcagggggccgctcggctctaagctggtgttggcctctttagtttgattgtcttcctgcaagacaaactcaaacttcaccctcttcccttgcagaaggagagctggttgtaatgaagtttcttcctctggccaaggctaccttctcatctctccccttatgcagaacactctcctcgatggaccaacttttctcttttcccactagacgtgttcctgggacgtttccaaagggcactcctcagaaagtgagcccccagtgtggcccttggagggtgagggtctgggccagcttgggcccaccctgcagagctacaactgccagattggggtgctgttagcgactctccaagtatccctcaggttttccttgattctaaagatttaagaaacattttatttattactgattttcattgtaattctgtgagcagctttcctgatgtctcagtggcttatttgcaagcagcagacgctggctctcgctgaccaaggaagggaagagtttattcggaggatatcagggttggtggggggtggtggcattgctggagaacccagcttgaggctcagtttccaggaatgacatccaccctacactgtcacggtggtccaatgagaaccccatactgcagccacatggcatgagacacccagagtggagtgaccctcagccactctaccgctggcagaatgccattctgcacccaaacatgaacctgccgtatactcccacttcaaccctgccagagaaagacagagagagatccagaaagatggacaaacaaaaacagagacagaggaagagacagagacatgcagagagacagtagagagacacagagaaacagagagatagaaacagacagagagagatggaaatagagagagagagagagatagagagaaatagattcagagagacaga

SEQ ID NO: 44842 - DNA, 1050 bp, Homo sapiens
atcggggcttggtggcatgcgcctgtattctcagctactctgaaggctgagatgggaggatagcttgaggccaggagtaatttgaggctgcagtgaactatgattgtgatactgcactccagcctggactggagagcaagaccctgtctctcatacatacatacatacatacatacatgcatacatgcatacatacatacacacatgcgcacatacatacatatccaggctatacctctggtgattctgactcagtagggtggggtatcccctagggatcctgctgttcagcctggtctgggatccacttttcattgggaactgagacactggctgtgagcctttctgtcctgtgatgtagaggtcatggcgacgcaggttcaagcttaaggagacctgactgtgcgttaggtattgtgctgaacatcatctcttactctcacagcaacatccttagaaggttaatgatgtgtccccgctctacagatgagaaactgagctttgagaggagtttagcttgttcaaaacttattcttcctattggaaaatttgtaccctttgagcagtgtctcctatccgctacctttcctccaccccagcccctgataaacactgtcttactctctatttctgtgagttcaacttctttagattccacatataagtaaaatcatgcagtattagtctttctgtgcctggcttatttcacttaacacaatgtctttcaagttcatctatgttgttgaaaatgacaggcttgctttcttttttaagggttaatagtattccgttgtgtgtatatagtacatttgctttatcctttcatccactgacggacacgtaggttgattctatatcttgggtattgtgaatagtgctgcagtgaacataggaatgtagggatcccttcgacatattgatttcgatttttttttgtctatacccagaagttgggttgctggattatatgctttgaaatctataacacagcagcgtgactatagtcaataataacgtatctttcaaaataactaaaaggctacatttcaa

SEQ ID NO: 44843 - DNA, 1050 bp, Homo sapiens; identical to SEQ ID NO: 44842

SEQ ID NO: 44844 - DNA, 1050 bp, Homo sapiens; identical to SEQ ID NO: 44842

SEQ ID NO: 44845 - DNA, 1050 bp, Homo sapiens; identical to SEQ ID NO: 44842

SEQ ID NO: 44846 - DNA, 1050 bp, Homo sapiens; identical to SEQ ID NO: 44842

SEQ ID NO: 44847 - DNA, 1050 bp, Homo sapiens; identical to SEQ ID NO: 44842

SEQ ID NO: 44848 - DNA, 1079 bp, Homo sapiens
ctcctgcctcctgagtagctgggattacaggcccatgccatcactgtctggctaatttttgtacttagtagagacagtatttcaccatgttagccaggttggtcttgaactcctgacctcaaatgatccacccgccttggcctcccaaagtgctgggatgacaggcatgagccaccatgtctggccacagtgaggcttattcttggtcacgttgcatgtctgggctgtgttagggcattgtggggtggtctgttcattgtgttcactcagggatccaggctgacaaaagccccatctctgcatgtgtccttgatcaccacttcaggggaaagagaatgtggtggatcatagagcctcttaacacttccacctggaggtgactcaagttgctcctgctcatggttcattggacaaaacagatcaaagagtcatgggcaacttctctgtgcctggaagaggaaccaaaatatgaatatctacattgactttccctagctattacacagaaggtctcatttaaatgcagttacttatttgtgttttgaagctaactgtagtccatcaaacttcacagaagatatgtgcacttccaagctattactaagcacaattttttttttttttttttttttttttttttttttttttttgagacagagtctcactctcttgcccaggctggagtgcagtggcatgatcatggataacagcaacttctgcctcctgggttcaagtgattttcatgcctcagcctcccaaagtgctgggactacagacaaccaccaccgcacctggctaagttttgtatttttagtagggatggggtttcaccatgttggcctggctggtctggaactcctgacctcaggtgatccacctgtctcagcctcccaaagtgctgagatgacaggcgtgagccgctgtgcccggccttgagtatgatttttgattgggaaggtcagagttagggttttagtctgaggacagtatgatgtgaaggtgaaaagcagagcttggctgtgagtttgctgggattcctgtgctgcttctacagctctttggctgtgtgaccatcacct

SEQ ID NO: 44849 - DNA, 1079 bp, Homo sapiens; identical to SEQ ID NO: 44848

SEQ ID NO: 44850 - DNA, 1079 bp, Homo sapiens; identical to SEQ ID NO: 44848

SEQ ID NO: 44851 - DNA, 1079 bp, Homo sapiens; identical to SEQ ID NO: 44848

SEQ ID NO: 44852 - DNA, 1079 bp, Homo sapiens; identical to SEQ ID NO: 44848

SEQ ID NO: 44853 - DNA, 1079 bp, Homo sapiens; identical to SEQ ID NO: 44848

SEQ ID NO: 44854 - DNA, 1048 bp, Homo sapiens
atcaagcacttcaacaacaataacatgtgttgtggggttgttgggcatttgtccaataggtaacacacactacctgcttcacaaggacctggtgcccagtcctcaaagaatacttgacagggccaggcgcagtggctcaaacctgtaatcccagcactttgggaggctgaggcgggtggatccgaggtcagaagttcgagaccagcctggccaatatggtgaaaccgtgtctctactaaaaatacaaaaattgggccgggcatggtggctcatgcctgtaatcccagcactatgggaggctgaggcgggtggatcacctgaggtcaggagtttgagaccagcctggccaacatggtgcaactccatctttactaaaaatacaaaaattagcggggtgtggcagtgggcgcctgtaatcccagctactcgggaggctgaggcaggagaatctcttgaacccaggaggtgggggttgtagtgagccgagattgcggcattgcactccagcctgggcaacaagaacgaaactctgtctcaaaaaaaagtacaaaaattagccggacatggtggcgcatgcctgtagtcgcagctacttgggcagctgaggcaggagaattgcttgaacccaggaggtggaggttgcagtgagccaagatcgtgccactgattccagcctgggtgacagagctcaaaaaaaataagataaaacatagatacagaaaaccacaaaggaaaaacatagcatattgaatcatcacaaggcagccaccccttcatagccacacccagcccctggccaccgctgacctttgctccatcaccagaattctgttgtctcaggaatgttggataaatggaatcctgtgtggcctgagatgagtgtctttcatgccgcatgacaaccttgaggcccgtgcaagcttttggcatgtcaacagttagctgcttctcattgctgactggcaattggtcctgtcatggtttatttggccatgtggtggatggctatttgtcttctaagccacttgccttctgattgctggactga

SEQ ID NO: 44855 - DNA, 1035 bp, Homo sapiens
cagcaggctcggtctaagataaaaccagacggtggacaacaggccaggtaagacccacatggtctgcactccctggttctgttattgtgtggaggaatgtcttagtctgttgctcctgtgggtgtagctaaagcacaaaccaggagtcctcatccttagaaagcagttagacagacatctgagaaccaatcccaaactgcagccttccacagaaccttctggaaccttctggaatgcaacttattactgccagagggtctttgatgagagtctactctccaccatttgtcttcagagagaatacccacctattctctttccgtggaaaggtaagttattggagtttatgcagtctggtatattaattgagagctttacttcaaagaatgtcacgtttatggttcagtctcacagactgggttaaaaaggcagtgttgactattaagttgtaaattactatgatgatcattattattgaagcaagctgtgagaaatgagcattatcttacaatatctgcattttagtgaacctgaaggaagagtgtattgctggaattacagaagcctgagaaccacaggggaattctcactgcagggtattcagggtcaaaagctgattctattttgcatgctcaatccttcgtcaatttatttttatttctttctttattttttgagacagggtcttactctgtcgcccaggctggaaggccttggtgcaatctcagctcactgcaacctcgcctcccgggttcaagtgattctcctgcctcagcctcccacgtgactgggattacaggtgctcaccaccatgcctggctgattcttgtacttttagtagagacggggttttgccatgttgcccaggctggtcttgaactcctgacctcaagtgatccgcctgcctcagtgcctaaagtgctaggattataggtgtgagccactgcacctggcctaatttaacagaatttaactgagcaaagaatgattcacaaatcagactcaaaaattagacacagaaacaaaataggttca

SEQ ID NO: 44856 - DNA, 1075 bp, Homo sapiens
aaaagaaaaatagatacaaatgaggaagtaattactgaaaaagaaatccttttttcataatgagcaagaaaaagcacaaaaactttgacctctgagatctaggactagaaaccctgaccctctccatagttcaacctttgcatctcactgggagcttccagaaccctgattgcctgaatcccttccttcactggtggtggtgttggatccttgtcactagatgacttaagctcctttaaagtgttgctttccccctccttgctgcaggctgttgggacaacatttgctatacgttctcagaagcaaggaagctggtgtcatcattcagcacccctgttcaaacactccctttaataattcctcctgtttcgtctggctcattgggtgttgcccataaaaacagtttggcttttgtaattacaattagagcaggcggcatgactaatcagtcagttcactgcatctcttgttatcttctgtgaagtgagtcagtttcaactttgcctttgtgcttatgtgtcattctctgctctttgatgttcaagtctatattggttccagactctgttttatttaatctgtttgttttctttctaaaaacatattctatattcccgttcaagagtggagctaacttcacaggatttgggaaaattctgattattctagcccatacacagaatgcccaggacaaggaagacaccacttctctgaggaattgtgccaagaatacaagtcggtgaagtcagcatgcacatgttgaatgtttacaatgtgccaggtactttcatatactattctattaaaaataagcagtatatggccaggcacaatggctcacgcctataatcccagcattttgggaggccgaggcaggcaaatcacaggaggtcaggagtccgagaccagcctggccaacatggcgaaaccccaactctactaaaaatccaaaaattagctgggtgtggtggcaggcacctgtagttccagctactcaggaggctgaggcaggagaattgcttgaacccaggaggtggaggctgcagtgagctgagatcacgccactacactccag

SEQ ID NO: 44857 - DNA, 1049 bp, Homo sapiens
tctatttgtcctgaaagccttggagagtggttggaggatttaagtatgagagtgatagggcggacccgatttacgttttaggaagatcagtctggcagcagtatgtagtatgcgtggaaaattgtgagacctgagatgggaagacacttagggagctgtggctttcagcttagaagagatttctcttttccctcctctagaaatccagtaagccgctaggttcaggcctataaaaagagaaccactggggatgatcttaaatcttaattttgggaggattatacttttcagttgaaagtagtcccagtacttggttatgaaatttttagaatttcttaaaaatgaaactttaggtggagctaagccaaggaaaccatgaatttaaagtatcagcctttctcatactgtttcttcccctccaacttaggtctgggtattttgtaggtctacgtgaagctgcagccctgatttttgtatattttacttttatatcctcaggatcaggtagacagagctgataccttccctcaggtactaaaaaaagtaattgactggatgaaattgaaggaattaggaacaaagtataaatactcacttttaacagatgggtaagtatttaggaagattatttttttatatctactttttaaagattaaagatacccttatttatctgatttttagaataaccacaaactattattagagaccctagagtctcaccccacagggaatagtatttttcctttcacctaaggatgaaagagaggaagaaaacagtggtcacagtccaatacaggactagaacactacagaaagttaaaaatatgtaaagctaaaaagactttgctaaaactctgttttttcatgacacttccttactcaaaaaagttcagactcttgagcttggccttgaagcctctttcctctcatcccacgctacctgtttaatctaattcacctgccattaatcctctttagtcagactggcccaggaattcacatggtttaccctttctctgtgtagttacttatgcctccctctgtac

SEQ ID NO: 44858 - DNA, 1027 bp, Homo sapiens
cgtgtaaatgtttaaaatattattgcaagacttacaatgaatggcagtcttctgccatagccttcaccagaactggttcctgttctgaggcaaacactttcaacttatgtaaagctctgtttttgtttttgtttttgttttttttcaaatatttacctttgtatttctaagtttcatgcttatactacttcttgacttttcagtttgcgatctattgaattcctgccctgaaagatcaagattgagttcaattaagttaccactcctgcttgtccttcccttcctgcatcttcctactatagctctattacctttcagtcagagcactcagtgttcatactcccgtgactatggagagtgtccacaactttcccctggatgtaataatttacttccgcggttgtttacttatccccttactctccattcaaactgtaagtcacttcttatgactgagaacactcaggtagtctgtcaggttttcttttttcatctgtttttcccttgcagactatcttcctggagcctttaatcctgttctaatctgaactgttagttcttcaggcttcttttaaaatcatcttaggggatttcctttaattctcatgcattagatactatgtcatttttctccctttacagtttcattttggagaagcatgttctaaagtagtttcatgagaaaaggtgcttttccttacagactcttctgttttaacagtcttttaaaactgagaagtatgcatgcagaaaagtagagttttgccgattgctataaagcaaatacccttgtaacttccacccacttaactcccttccttcctcctggagttaaccctaattcttcctttcatggtaatcattttcttattattccttatagctttagtatttaaatgtatatccttatattatatagttttgtctggctttgagcacgatataattagtattatactggctatattatttgttttttttgtttttttttttttttcaatattatgcttgagatccatccacgtct

SEQ ID NO: 44859 - DNA, 1236 bp, Homo sapiens
cctgtgttaaagaaaattcatttaaaaattaaattaagaaaacaaattcccacaggtaactgtgatccttagatctggagaccttggctgagaggaccgctgctgggccatcagccatcgccattggtcttgctgatggaatgtgaccagtgaggttctctgtcctgagaagcggttctgaaagatgctagttcttctgagcatatctcttgagtggcagtgatgagtctgccctccgagtgacagtgacatttctccttgcagcctggcagtaaaagccagtcagcagagagagacatgagcagcacatatgcgagactgcctagaggagatgaggcagagcagccctgagacctctgcagttcctgaggccacactgcacacggccacactcctctccttgcttccatgagatgctcctttatttctttgagaaattcccctctccggctaaggacagcacaagttggtttctgttacttgcaattaaagagcccagtgactacgactcttactcaaatagcatccctaaagaacaatgaagggacacactttaaacatgctaggtatgaaatatcaactttctccccaaacaactctggaaatgagctcttgctcaggaaggaaaaagcaaaaacacctttactattgagtcttttatgcagctattagcttggtacaaagaacatccccttaggaaaagagaaattcaagatgctgtctggattggaagaaatggaagaaagcagtggaagttccactctcacaagcagggcccacatcggcctccccttgggaagaggaaatacaatcagttttgtggcacagatgagctccaggcagagccaatttcacacacgctgattgcagcctgtaccttctgcctcaccctccgaatcagcctgaggctggcagaggtctgtgaactgggctgagatttttttgacctgttaggttttagcatatggcagaaacaatcaatactgcccaagaaccgaataaagcacggctgttcccaacagggaaaacaggcaagctgctctttcccagaaggagcactccttgccaagcctgcatgccctgaccatcttcctgcacagggcacttagatattcacctacttaggaaacacattccagcctctagccaccatcccacacctaaaaatcaaacagagacattcatctggctggggactgggagtttatagcagtgcctttcgggtgagttggtgag

SEQ ID NO: 44860 - DNA, 1052 bp, Homo sapiens
tatattttattctgtttcatttttagcaaatgctgcttgtgatccattaatgggtcgtgaccagtggtatgagaaacacttaaaggaaatcattgttaggtcactggattcattattgatatacagacactacttattaggaatgcagtgaattgaatcagaaacagacttttgcctatttgtttgctcaagggtcttgcttgttttagatgaaatagcatttctttttccttaggctaaatgaaaggcctaagtctgattttattaatcaacagaggtgtctacttttgcatactttattccaagtttgcctattttaacaaattgcgtcacaaatcatgtcatttctcaccatcccactttatgcgtaatcaccaataaatgatagttatatttatgtgtattaatgtatttaggataagtcacacaaaatagtgcttgtttctcaaatcacgtgtcttctatttgccacaatagttacttgttattctgtttcagagttttatgtatatccagataagctagaagataaacaatcaaacagtaccgtaattatgttgtagttatgacaagctaaccttgaattggctttttaagaaagtttttagctcagttgtggaaaacacagtaataaaattctcgatatgaaaacataatgtcctgtagtcagtttgccacgcttccgtgattgaattcgtaacattaaagttttattaaactttagtcttctttatcatgtataggctgagaaatgaaaaaaattatcagttgactggttattatgatagtaattgaattgtcacggaatagctgttttaaagatgagaaattggtacaatcccttggatggaaaaatttaaaaactgcagtttatttgttccagaaatattttagtgtgcttagatgatcgggtgttaaatactgacacaattgtgtaatggcaagcagcccttaacccttatggagcttacagtctagtggggaagcataaacaacaacaacaacaaaaacctataaagtatctagtgtctaatctagagtgataggaaacg

SEQ ID NO: 44861 - DNA, 1063 bp, Homo sapiens
cactttgggaggctgagatgggcagagcacgaggtcaggagatcgagaccatcctggctaacacggtgaaaccccatctctactaaaaatacaaaaaaattagctgggtgtggtggcgggcacctattgtcccagctacttaggaggctgaggcaggagaatggcatgaacccgggaggcggagcttgatgagctgagattgcaccactgcactccagcctgggcgacagagcgagactctgtctcaaaaaaaaaaaaaaaaaaaagtccatttagaaatcttgaacccatgtgtttctttcatagatgctatttaccatcaaaaagaagaaaattcaaactgagattattttaaaaatcaacttgaaatgcttgtataattaaacaaactacttaagactgtggtcttgggaatgttgatgacagtttttatactgtaatgttgaattgaatttacttcagaaatcaatacattttctgcctttagaacttatttatctttgcttctccctacccctcaaatatagtctccaaaaccactaaatagcttttctgaatatatgctatatgattttttttttccttttttgagacagagtcttgctctgtcaccaggctggagtgcggtggcgcgatctctgctcactgcgaactctgcctcctgggttcaagtgattctcctgcctcagcctcccaagtagctgggactgcaggcgcatgccaccattcccagctaagttttgtatttttattagagacagggtttgaccatgttggccaggatgctctcgatctcttgaccttgtgatccgcctgtctcagcctcccaaagtcctgggattgtaggcgtgagccaccgcacccagcctgtatggttttttgagactgttagtgcttgagaatttcattttaaaagcaaattataagcatacttttcatggagtctgatataagatctgggagtcggagggtgcggtggctcactcctgtaatcccagtactttgggaggccgagatgggtggatcacgaggtcaggagattgagaccatcctggctaacaca

SEQ ID NO: 44862 - DNA, 1028 bp, Homo sapiens
acagatgttcttttagctatttcttcatcttactggctttagtagaattctcatacttttcatattcccggtattaggagacaggaaatacaaacagattaaagactcaaagactggtctttatagttctagtatattgtaaacttcctgttcttcttggcgtctagaagtagagtagttctctgtgcactgagtatgtttactttctaacacagccacaggatgaggtgccagattcttaaactgaatcaggtaaggtgtgaagttaagcatgtaccacgttctctgtggtaggaactaacaataatcttgtccactttcatacgtattcttattgtctatcactgatgtctaattatattcaagaaacgtgtgtgaagtgacaaagcagttcactggaagaaggcttgattctgtctgacttttttttatattactctgtgttacatggataaggaagctgagtaattttctacttcttgattaggtgatatcttgagattcctttattttaaagcaatgtgaacttgcagtatgtcagacacttcaatattcatatacaaatataaaacacattttatagtcatatgcaaattatgtttagattatcttccatttgtcaagtaactgcttattcttcattaggatgggcagttgaatattgattctgatcatgcattaacttttggttataatgggttttccacaaaggatagtaaaacattttttcttgttaacttacagattaaacccatgaattgcccctcttgggagctgaggagttgaggtagggagggataagaaaaaataaggtgatggtggtaaatttataaaagttgctgtggatagttgatacgtaatattgtaaagggttttccctcgaggcctctcaaaggacttagccaagcagtgtcactaatatttgtgtcctgtgtgtgaggcagatgattcagattacctaccagtttaccagtgaagaaggagaaagttgttactttgccacagtctgtagagctgatagaaagttg

SEQ ID NO: 44863 - DNA, 1061 bp, Homo sapiens
ggctcactgcaacctccatctcccagtttcaggccattctcctgcctcaggctcccaagtagctgggattacaggtgcacgccaccacacccagctactttttttattttgggtagagacaggttttcaccatgttgaccaggctgggcttgaggactcctgacctgaagtgatccgcccgccttggcctcccaaagtgctgggattacaggcatgagccaccacgcctgaccttaactatgatttttaaaatgcaactaaaaattcagattatcagtttctctagtcacgtttcaagaatgcgatactcacatgtggctagtagctaccatattgggcagcataactctagaacactgggaagttactaaccattttattgctaaagagaacaggctaagaccacacaaccattacttctaaacttttctcctgacacccagttcagttccctgttcattgtactagaatacctgttcttaaatctctattttagaagagctttatgagtaaggcacaataggctgtacatgatatgatgaggttctcataggttcctccaaaggatattaattaagttgaaagaagaaccctggtttattaagtgaatgtcaccgctcattcagtgctgaagataccattgtgcatcaaagaaatgtttatcttatgttctcaagagaaacataatagcacgaggatattaagagagaacagaactcatcactctttttgtgtctcaaatttaatctggtatacagagtcagtgattattttctttgaatggtagaagtcaaagaacttcaatgagtagtttattcagaggtgaaactcttctgttaaaaaaacaaagatgttaataattgaagaggattctaaaaagaaataaaaagaggaagtaaaattctttaaaaatgcgaaattttgcaaatgaaaataagtactacatttatatcaaagagttttgatttgtttttgtttctctgatttggctaatcagacatagattatgccttagttgcaggatactatatatgcattataggcacattacctcagtgtag

SEQ ID NO: 44864 - DNA, 1053 bp, Homo sapiens
ataactattctgaggagaggaggcatttggaaattcagcagtaaagcagcgacagcaacaagcagccacagtggtagtaaagagagggcaggttcacagttagcatatttcacagtgtgagccagcgagcacatagcttcccatactgctgcttgaaggaggcaaaccaaaactctacattgcaagatttttctagtttcatgtttatgatgttaagtcatgtgataatattgtaccataagttgccaacttcatttcactctagagaggctcctttgctgcagtgcttttttgctttttttctttttttttcttgaaagagaaaaaatttgtgcaatgtatgtttatgcctacaccatgccgagacgacacttaccagtaaataatctctgtatccccgaggtaagatactgtttctgctttccctgcacagtgctgctgcagcacggagctgacccaaacattcggaacactgatgggaaatcagccctggacctggcagatccttcagcaaaagctgtccttacaggtaagaagacagagagctaccgaatgattatatctgtgtaactccttacttgattttataaaatcttgttatgctgaatttttcttttcactgatgaagctaagcaaatatatctgccattatctactactttattattgatttgatatctgtctcattaattgctatgctgtcgtaagcataagcagtaagattgttggtctacttagaatgatagcattaaatcataacatctttcactcgtattttagtcatttttatggtttatatcataatttttctgtatctcatcctctcagttgtttaagacctttactgttgagcaagcaagggcatttatattactataaaagtagttttgattggaaagacaacctgctgcctgctgccttatttcttggatcgatagtcaaataaaatatgccgctgcctctcccttgccaccccgtttatactttaatcatatgttttcacttttaccatgatagctaagttatttttaactgaggcgtttattatctttt

SEQ ID NO: 44865 - DNA, 1950 bp, Homo sapiens
agctctgttcttcaagatttttattaaacttttattttgacataattgtaagttcccatgcaattgttagaagtaataaaaagaagtcccttgtacccttttcctagtttcccctagtggtaacaccttgcagaactgtagtgtaacatcacagccaggatattgacattgatgcagtcaagatatgggacatttctgtcatagaaatacatacatactgttttgtacttttctctacttataatacctttaactagtttttttaattagggtaaacctggccttatagaatgagttagttttccttttattttctggaagagactgtaatgtgttagtaatacattcggccctaggtgtcctcaggggtactggttccaggatcccctgaagatgcagatgttcaaatcccttataaaaagttacatagtataacctatggaggcatatcctcccgtatactttaaatcagctttagttataataactaataccaagtcagtgctgtataagtagttttgttatactatattttatttgtattattattattgctatttaaatctgtagttgcttgaatccataaatgcagaacccacagatacatagggccaactgtatttctccttaaatgtttggtagaattcactagtgaaaccatttgggcctaatcatttcattattattattatttgattcaattttaagtaggtctgaaactaattgggttatttatttcttcttgtgtgagtcttagttatttatgtctttcaaggaattggtcaatttcatctaagttgtcaaatttgtgcatagagttgtttttagtttctttttatcagatatttggtgcctgcagggtctgtagtaataatcccgtttcattcctgatattggtaatttgtgttttctccttttctttgtcaattttattgatcttttcaaataaccatttctttatttcattattcaaattctttttctgttttcaatattgttgatttttgttttttattatttccttttttctgcttattttgggctcattttgctctttttctgggtttttgaggtaggagcttagaaaattgaccttttttcccctttttcctaatgtatgtatttaatgttataatttttcttttaagtactgcttttgctgtgattcgcacattttgatttgttccattttcatgttcattcagttaaattttgtatgtttttaaatttctcttgagatttcgtctttaacccacagactatttagagtatggttgtttagattctgtttggagatttttctgctacctttctcatgttactttctagtttgattccattgtgcttgaacaatactctgtatgatttcaatttttttgatttttaaatctttatttggacaaaggtaggacaaagttcatggctcaggacatggactatttttgtaaatgttccatgggcatgtgaagagaatgtattttctgatgtttttggatggagtgttctataaatgcctgttattaatagattctgttggttgatggtatcattgagttctatatccttgctgattttctgtctggttgttctatcagttgttgagtagtgaagtttctaactataattgtagatttaattatttctcctttaacttctatcagtttttgtttcatatattttgtagctttgttgtttgtagctttgttgcatacacatttaggattgttataaatgtgattgaccctttcttcattttataaaaactctttcataattttctttgctctaaattccactttatatgatgttaacatagccactcctgcctttttaaaattgagatttgtgtgacacagatttttcgattcttttactttcaacctgccaatatcattatatttgaactgaattccttttagatggcatattagttgagtcattttttctcat

SEQ ID NO: 44866 - DNA, 1065 bp, Homo sapiens
tcgatagatctttctcatgatgattctttctcttctgctccacatccagctatgagaaaggcccaggttaagtcctaggatttttactcctccccatctaactttggggtgatttcatcgagtccattttaaatggcatctatgtgctaaagacccctctcgttcagacctcctaccttccagtttatagctctagtgttgctctgccctcttcagaggtacatatcctactacctacttgacatttccaaatgagttgtctggatgtctcaaccttaacatggccaacacagaattctttatctccctatccaaccctattgccatgcccaccaaacttgaaccccattctttccctctcgggaaatattaccacaagctacccggttgctccagccaaaaacctacaagtcggactttattcttctcttgttgtcttaccttgtgttcagttcatcatccagttttgttggttttacctccaaaatctattccaaatccatttttcttagttgttgtaactgccagcaaacattctgatttatactaggtctcaccaacgtgtagtctgtaggctggtttcaatgacctgtttgtttctggcctgcaatgaggtaaggggctggcactagaatataaatcaatggtatcactaagcacacctttagtttacttgacttctttttctaatagcaagacttccttgttgaaaaagcagtacattctgatgcagactcctaatcttgccgaggagtgacattgcagcccagctgtagactaatagctgatagccctctgactgctgtacgtcaggcttccttaagtctgttctctacatagcagacagaaactttttaaaaatgttaactagtttatttcattcacccccttaaaaatcttttcacttggaaaaacattcagacttttaatctggcccctatctacctgtctgactgcaatggttagtgcttttcctgttgctcctgtattccagccatagttgcctccttgctgttactcaagttggtttctctcttgggttctttttctacctttcttctcttc

SEQ ID NO: 44867 - DNA, 1029 bp, Homo sapiens
aaatattagccgggcgcggtggcaggcgcctgtaggcgcggccactcgggaggctgaggccggagactggcgtaaacccgggaggcggagcttgcagtgagccgagaccgcgccactgcactccagcctggacgacagagcgagactccgtctcggggaaaaaaaaaaaaaaaaagtaatgaactgctcaaagaaataatggagacacatgaaaagaacataggaaccatcctgaaggggctcccaatgaacatatccgggatagtttgactatcaaagtgtatcataatagtgatggattgtatagcccattgtatgaaataggaattcttcagtggtaatacatgaacgaatggggagggacactttcttactgtagaatgcctactaatcaatgtggagggactgttggaattggaaaatcaccatttgcaaccatgatagtaaagactggttaggacaacaatcgttagtggatgccaaatctcaggggcaaagtttgatgagcagctgtataattatatgattctcagcatgattgctcatagattgataattacttgggagaaactatacattgacaaaatctgacaatactttttttggatatcaaaattaacatcactaatgagaatgaattaagcctgtgtgctggcagatgtaatacctgagaaggtcacaacatttcttatgttgtattctggctagggaggcatgactaaatctcatgagaaaacattaaacaaattccaatttaggttcattctacgaaatagcctgtatttttaaaaaatgtcagtgtcttgaaagacaaaggctgaggaattactccaaatcaaaggaaactaaagagacatgacaactaaatgcaaaatatatgatcctggactagaggagaaaaatgctataaaggctataataggaatgactgacaaaattggagcacatactgtatattagatgaaaagtattgtaccagtgttacttgaatttaattactgtactgtggttacatgaaaaaagtattgt

SEQ ID NO: 44868 - DNA, 1032 bp, Homo sapiens
aatgaaacatttattttttattgaaatgaaaaaataaatatggtcactttaaaatgtatacatagataattttgttttcactatataatcttgtttatctaagccttttttttttttggctttctggtttttcctgagtagctttcaatcttgtatcttttcattatgtaagagactgtaaaatatatttactatgttttagatatttattgtagttcagtaacttttgtatttatccctgacttaattaaataaacttaattttaactactgaggctattcctcagcaactgtgatgagttcttgttatcttaggggattctggtttgtgctataagtgtattagggtgaaagggttagttgaaaagtgtggggaagcaaaagggcttctttgagtatttgcagctctattagactctttcattcactttcctttaaaacacatatatttctacatatatcttccagtaaattgtgtgaagcttatgttccaaaagactaatcgggacggttcaagaacagtgggaattgtgcttttacttactcaacgaaggataattgtagaaaagcatcgtgggctgctataaatcttttccactatgtgtgaactctttagctaaaaagtgcctatacagggaatatatcaaggggtctttctggcaattttgatagtctcatatcttgattataccaaagttagggtttccttaaataaggaaatccattttgtgttgctgtaacagtataccatagactgggtgatttataaagaaaagaatttttatttctcacaatttctcacaaatttggaggctgggaagtccaatatcaaggagccagcatctggccagggccttcttactgtgttattccacggcagacggcaagacagaaaaatggcattaatccattcatgagagcggagccctcatgacctaatcacctcttaaagttcctccctctcaatactgttgcactggggatttttaacatatgaactttgggggatacattcaaaccatatcataaagc

SEQ ID NO: 44869 - DNA, 1365 bp, Homo sapiens
ttggagaactaatatcataataacagcttgactaaaagtatgtaagtactgtatttctttatgtactattgttataaagtaactgattatactctacccccataatagtaaggagagattaatattttacctaatttttatatacttttttaagtcagtggaaggaaaaccctaatctactttattgaatataattgaatatgagaaattactgagatggggttgcccgtgtttttcactcatttataaaagcttgagaagtccatttttattaaaaatttactcattagacataatcttggaaagaaatacataagaacttcggcagtgccaccttgcacccattaggatggctattgccttagtccattttgtgctgctattaatagtataacacagactgggtgatttataaagaaaagaagtttatttttttcagttctagaagctgagaagtccaaggttgagggacccgtgtctggttagggcctgtttgctgtgtcatcccatggtggaaggcagaagagcaggagagcaagaagggactgaatttgctttttataagaagctcactatcgtgataactaaatggcttctgcgataatagcattaatccattcatgagggtggagccctcaggacctaatcacctcttaaaggtcccgcctctcaaaactattgcattggggattaagtttccaacatacaaacttggagggacacattcaatccatagcagctactattaaaaacaacaaccaccaccaccaccatagaaaataagtattggcaaggatgaggtgaaattgggccccttgagcactgttggtgggattgtaaaatggtgtaagcactatggaaaacagtatggagactcctcaaaaaattaaaaatagaattcccatatgacccggcaattctgcttctgggtatatgctcaaaagaactggaagcaggggcttgaagtgatatttgtacactcatgttgatagcagcagcatttgcagtaaccagtaggtaaaagcaacccaggtgtccatcaagagataaaccgataaataaaatgtggtatggaatacaatggagtattaatcagccttaaacagaggaagggaatctgacacatgcatagcatggatgaaccttgaacacattttgctaaatggaataagacagtcacaaaaggacagataatgtggattccacttatggagttacttagaatagccaaactcagagacagaaagtaaactagtggttgccagggcctgaagagaggggggaatggggaattagtgtttaataggtacattttcagccttgtcagttgaagagtgctgtgaatggatcttggtgatggtagca

SEQ ID NO: 44870 - DNA, 1069 bp, Homo sapiens
tactcatacttttttagattatcagggtttttttcaaattaaattagatagaaaaaattaaacttaagcatttattaggttttagtgctatgcatataagaaataattaacaattgctcatctgtgtggtttgaattgaataattcctatttagatattattctcatttacggcacagagtaattcttattaaatgtaccagttgcagtaaagccacagggtgttaaatgttctgggtgctaatggagattgggacaagatcccttggttatgtcagtttgtttttattttcttcctgttgttatcaagaaaacaaatctagctgctaaaattacaagtatctgtcctagtagatatgtagtccttttttagaacatttctatgtgtttatttagaattagaaagtcagattgtgtattaatgagatgataaaggtactttttcatatgtagtaaatcaggcatataaagtttatttcctgaatttcattttagaacacagcgtagaagcgaatccttttttggaagtttcctaaattactgtattattgcttaactgagcccttttcttagtttttactacagttcctggtttgtaaatttaaaaagcccatgaaaatgttaattttgaaatgtttttggaaaagaaatgtctcttatacagtggttagtaggtggggaatttgcctagagatatgtgggggtttgagactttaggtttttttttaatgtaatatgtgggattatacaatgagagtgtaaattttaagtactcttaattctatactgtgacttgatgattatctaattaggtaatatgtgagaagttaatattttgtttcccaaagacaattgttttcctaacctttagaattctgaaaattataaaacatcaataaggttttatacagtttatattgttactatgcttttattttacacataaatcaaaattggctcctggctacactagaaattttattggctttttttttccctaaaagcagaatttttttttgttctaaaatgctaccttttgttgttgctctaaaatgatacttttatgcaat

SEQ ID NO: 44871 - DNA, 1049 bp, Homo sapiens
atgtgataatacatctagacatactgatagttgtcatgattttattgctcagtggggaaatcaaaagatgtagtcattaaatttttgtgttccaggcacataacagtatataggtcttccaaagcagatagctacattatgaatccataagaacttttaattctaatattaatccttaggaagattttaccttccatcattgtttggatttattaagaagatatgtatgaaattaaatattcatattttgttactgacttaattttttcagaagttactttaattctcagtggttctagctaactgataattgtggcatttgagttgcatgaagtggagtggagtgaagaaaggggagaggaaaaggtgaagttggaaagttgtgggatgggatgtagtcagggagattgcttatggccttctagaacattttaaacacttcagtttcttcttagagtgagatgaagacccactggaagattttgagcacaagatttgtatacctaacttaggttttaacaggattactctgctgtcatgttgtgttactctaaggggattatactggaagcaaggagacctagtagaaggctgttgccactagccagctgagagaggatactgtcttcaagtaggtgacagtagatgtggtgagaagtgattggattctggatatattttggaggcatagtctccaagagaaatagtctgatgggttgagcatagtgtgtgggaaaaagatgggaatgaagaaagactcccaaagtttttggcctgagtaactaaaaggatggcgttgtcattaacaagaaattctgcagcatatgtttcaagggaagcactagggggagctccattttagacaggagaaaagcatgagaagtcttacatatatcatgtagtgatgtcacataggcagttggattatagcatatgactatatgtcatttactccatatagtaaccagtaacctccacagtatggaagttagcaaagaggactaggttggagatataactggggagttgtcagttcatgggtgctattt

SEQ ID NO: 44872 - DNA, 1027 bp, Homo sapiens
attcatcttctgtaaagtcatttttgctgctcagttagaaatgaaaatacgtacactaaggttgcaatctctagatacaaggaaaagtgggaatatgttttacctctaaaactgccagacatctattattctgactcctgaatggataggtcaagccagtcttaagcatttaattaccacagttgaggggtaacattaaatgtaggagtctctttatttgagacagtttctgtaacctggtgaaaataatcactttagtgctgaatgttaagtattttttagtgacatcaaatcatgttcccatgcttcaataagttggattgggagttcccattactataatagaataagttagtatgtttcttacccagtttccagaaaaatgttaatgattagaatgttcacaattttagatttttcttttgtgctgaagaagtaacaaagaaatcaaaattcaagttagtttggtagcttgtgttatccattgatacatgctaatggctgtgcttttttgttggtatgtatcagcagtcatttttcttctggcaaatgtgatagagttaaatatgttactatttcatgggagttttgtgaaagaccatcaagaatttgtatgaaccctttcctgagtaagtacaacagccttactggtaatgataaaagactggcgacagggagactagttgtcttttatcctttcttttcttaatcttgtatttagtgggtgtacacaaatattttcaataatcaaccagcatataattgagaatttactgtgtacctttagcaggagctttctagaggacccagaaagtctgtgtgtaacatgcactcatattctcaataaccttagtttaactcaataaacaaaaattaccccagtattatattttataagacagtaaagtgctaaattgacatagatgttcagaaaaggagtaatcaaagtcttcaagaaatcaaggaagacttcttggagatgaggagacttatctacactggatctcaggagccataaaggcagaaa

SEQ ID NO: 44873 - DNA, 1089 bp, Homo sapiens
ttttctcagaggttcacacatttattctaggaaagcattcctgtgatccctcaacagtggaattattcatatgcagaagatagattttttccctgtgtagctctacttgcttcaaaaattttatcagtctgtatttgtggtatagaaacaatggttgtagttttattttttttcaaatatagtcatattctaatactaagtatgcttttttaaaacacacatttcccatctataatcattcacttagggatgaagttagcaaaagttttttgtttggagattggtcttttggggtttgttttttgttgttttttacgagacaaggtcttgctgtattgcccaggcaggcctcaaactcctggggctcaagcaatcctcttgccttaccctgcctactatccaagtagctgagactacaggtgtgcaccactgcacccagctttgcctttattatttttatcgaaaagttaatagcaaatttgctattgacactcagtactttttacgacatactgtcaactttgtcacctcttcttaagcaaactttttgcgatttttagcaaactaattttagcattcttgataacatatactggttgaaagtgacggtaaacacgttttaagctctgttgcctagaaattttatttttgttttaatatgtgggcacttccaggatcacatccaacttacgatagcatctaagttatttaaagaataatagtaaattttagttgtgatagccactagggagaaatttttatgttgtcttaaatctaaaactgtacattttttcttaaaaatgcttcatcacttgaaatgtattctaataaaagaaaattcttaaatataagacgattaggcttcctttcagagcatgatcatctcagtgcttgaattgctatatgtgcttattataattaatacatactttatttttaaagcatacagttttaaattccatgtgttttgtatatgataagcagatgtatactacagcttttaggtttcttaaacaatccattcacagtgaaggcctaatttattttgatctgtggaatggaagtagcaaaagaaaacaaagcagcaca

SEQ ID NO: 44874 - DNA, 1031 bp, Homo sapiens
gcatgtcactcctacatttcacagccttaggaataatctatatatttgactggctcagtgctgtgttaaataaacacagattaattgactaggctgaggatgaaataataatctgaggtagctgtgaaattacatagttatttacttatgtagttatttattgatcattattccttcatacttatttacttttttcccctagagagctcaatctgctctgtgtgtgtctttgagccttttttgtataaaaagaacctcagtttttccaaatggagaaaaaaatacatatttatttaagaagcatcaataaaaattacaagttgcatgagagttgatattagtggtagtgtgccttactgtgtcggtgttctttatataataatgccttgtgttatatttgaatacatgtttatacaagacagttaacttttctgctaagtcagtaaatggcattgatacttattaccacaaagcatgtaaatttatatcttataagagtaaatcaattgactgattcattttctctcaactgtttttattttccagtgctttctctaaaatggataacatttggggaatttcatgacataattgtaataaagcctctgtacaattaaatggctttaactgaagccaagcatgtttctctttcccctacttcccacctttttaaaattaaaagcttcccagtctttttaggttgtatttgtcatttaaagcattttgtattgcagctggattctgaaactaggttaaattgtctgtttctcctggaaacattccaacagagatcagtttcttttctggaccttctagttcaatactttgctcttatatactgtgttgaatagaactgaactgctatttattggatttgtcagccttaaattccagttactatttttgcctcaatggtgtagctatttaaaagaattaaacagcttaagaactgtatttttagtctatttgggtagtaatatactccttcctgttcattgttctttcagacatttgtcagaaaatttcacaag

SEQ ID NO: 44875 - DNA, 1030 bp, Homo sapiens
ggctggaaagcagtggtgcaatcttgactcactgcaatctccgtctcccagattcaagcgattctcctgcctcagcctcccaagtagctgggattacaggtgtgtggcgccacacccagctaatttttgtgtatttagcagagatggggtttcgccatgttggccaggatggtctcaaactcctgacctcaaatgatctgctggcctcggcctcccaaagtggtgggattacaggcctgaaccaccacacctggcctattttttgtttttgggggcgttttttgctttgtattattagagcaaatgtggaagctttccttagtagttggctgatctgtacttttgtttttagataaatgttcttcactttgttttcagaaactactatttctaaaattaggaaatacagatatttatattacataaagttaaatactacctcagaaaaagtgcctgttctttttgaagtgagtgtcttcaagagtgcagggaagacgatatcttaaggaagatagaaagtgacatgcattaagttgcatcttgggatctttcttggccttccctgtcttttcccattctcataaatgtcttccttaaaagcctcaatgtgtggtagtcgagcagcagcatgagttagaaatttattttcaatagatgatgtgcttttgagttaattatccaaactgaccaagttatgcccagaaatgtgtctgtaagggacacaaatgtgccagttgcaccaaattatagcatactggagttgaaatggatctcagaaatacttaagtgctaaccagcctaacatcctaaatgtatttataaaaatatacaagttatttttaatattcttaaaaagcctatttgttgaatcagtagtgcctattgtgtgatcgattgtcttagcttattttataaggatttttgggaagaagctgaagccttttgctatgtggagctcttgcttgagtgaacctggtctccatggaacttgcttctgtattggcttttatagtcctgctcctttatagtt

SEQ ID NO: 44876 - DNA, 1047 bp, Homo sapiens
aaattaaaatatgacggcgccccatggttttcacatcataagcctaggttttctaatgcatggggcccatctgtctttttattctggagattttcttgaatctcatgcaaaataaataaggagcctattacaactattttcttatattgttacagtgccacctaagaatgacatagaatgaaaaactcttgcctcatagagagcaaatatgttctcatccttgtttttatgcagttataaatgtgactataaaataatatgcctaatcgtcacgtatgcttctgggtctgcctcattattctgcataacatttttccagtcacagttcttctgagcccctatgaaggctgtttgtgtaaccctcctggtggtcagatgccagtgagactcctgctccactgacggcttatgcataaacaaacagcctaatgccattgttataagtaagctacccaattgtgttatgcacatacctaggcagaaaaaggtatgcctaattcttgtttgtttgtttaattagtgctcattttattttcattcccaggctaggaacttgcatagggaactcaggaccatgaccccagggctgtatttcagctcatacgtagcgcatcaggaaggcatcatggggtccggtgtcttactacctaattctcctagcagttagtacattttgataacaatgtcaaaaatgtagtgactcttcacaagtggagcagtaaggaagagaattcattttttttattgagttaattctctgagaaacttagatctttaaaacatttttcttttccataattatttttaatttagagagtagtcagaagacagttattccctttagtagtacattatagtcaatgtcccctggtctgtgtaaatatacttagagatcccaagctgaagactattgagataatatggaatatttcacctacagaacaaatattttttaaaaattgtttatttttagcatttgtccaacgggcatttaaggagtttttgtttgacttaatcagagtgttagttcttcttctcaataagata

SEQ ID NO: 44877 - DNA, 1078 bp, Homo sapiens
aactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacatt

SEQ ID NO: 44878 - DNA, 1027 bp, Homo sapiens
ctctctggccgtcaatatcttaatgaaagtgacattccgttggccacggtccactctgtccacgtggagggccgggttccagcctctgcagaagtgcttgttctcagcacagaccagctactcattgccttaaaaatactccatagtcaagaagatgggtaatttcacgagaaaatcaaagcttactaatttaaaagggtggaaaatggagggcaggggattccaagcttaatttgtgaagattcttggtacaattaaaaaatattttatataaaatattagctgggtatggtggcatgcacctctaatcctagctacttgggaggctgaggcaggagaattacttgaacccaggaggcggaggttgcagtgagccgagatcgcgccactgcactccagcctaggtaacagagcgagactctgtctaaaaaaaaaaaaaatttaaactttactatctttgaacataaatttgtcatccaaactaggatacattcgagagtaaaaagagtgctgtgaacaattatactgaaataatgaaataatgagggataaacctggagggttttaggcaattaggatataatgtccccctttaacgaggttgtatattataacgtattgcaccaagaataataaatacacaccaagttaagtagaaatggaaaaataatgaacttggatagacaaagtgaacaaatggaaaaaattgcaatgacatagattggattgtatataatgtcacatccacactagtagttacgctaactttggaaattatattcaataaatattgttgtgttcttcctgaataacttcagtttgaaagttaatgcgtattcataaaacctagtttgtgatacttcaataagagtgagggaattgatctgattttacagttgcagttttaatattgtactaatactttccagggatgtagggtaatgaattctccattacttgagatattcagatggtagagtggtcatccttaaccagtttggaggtggggctatgtagcctttaaaac

SEQ ID NO: 44879 - DNA, 1047 bp, Homo sapiens
ttgagaaaatgtcatggttatctgtttctttgttcccagggaaatgggtaagttgcatgctagaagcatcccttctcggtctgttgtattctctatgctgcaatgtttaaaacccatctgagtaccgaaagactgttgttttcaccaacactgaaacatcatttatttgcattggaaaaccctaaatagacatgggtaaatgtcagttgatatgttatggtttggggattacatagctcttcgtctttaaaaaattttttttatctgtgcttttgtttaaagcatgaagttatgatttaaaatgcccatggaaaaaccctgaataattcattgacttaccttagtcaaaaagaaaaatcccccctccccaccgtatgcctagcaatagggataaaattcttcttagtccctttctgtagctttgaggttaaaattacgggtgttattatgaactctaaataagaacctgtgaaataaatattttaaaagtgcccatttctgggaggcaggcacccatatttctgtgtatgcagccacgtagacagctagatcttaggcataatggtttagttgcatgtgggtgattattttcatttccacttattactgtgtgctagactccctgtgtatgagtacagattgccctttcttgcactgtatttagaaatctctgtattacccttgggcatttgttcattaatagggggtggggaaaggaaaagcttgtaataatgggctttacatattaaactgtgtgcatccgcatttgggccaaatggaaaatctggtttgtatgactgccctctgctggctgtaggcctttgctgcagtggcaggatatgagtccctgggtggagcccctgtgcagatgccggtatcagtcttttattcacttgcactgagttccatccaagtacatcagaaacagcctaagattctacctactgcccaggttgatggtggaagacagcattcttgtgaggatcaaggagacatttttgattttagtagaagtacagtagaagtatagacacaaaataatcctgg

SEQ ID NO: 44880 - DNA, 1081 bp, Homo sapiens
gagctccgatgggggcttgtaaaggcttcagcccctttgaacgcgctccttgtcattgtcacactgtggtggcctgggtttgtcctccttgcatgtgccagcagtgattgatgactcacaggggcaattccattgtcccagagcctggagctcctgttgctccggggtcctctttggtgttgaagagaagcactcatcccttcgtcagaagacacacacacacacacacacacacacatacgcacactccatgtaggcttagtaagcccagccagtcagtgcccagtcagccgtcccccttccttgtggctgaaccgcaggaggtgggggtgcatctgctctgcaccactcagccagagatgcaggagcctctgcccagctcagaatagatgatgttttcttactagtggctttatttaaaagccatcccagtcatttcacattttttttttaaagttttgattgacatctatttggtcaacctgtgctccctatggactaaaatagctgactggggcattgtctgggcttattaaacctgcatgttgtgtgtgtgtgtgtgtgtgtgtgtctgtgtacacgcacgtgtgcacacgcaggacaagcatagcatggaatttgatggagtggatgtggagggaattgaagtggtctccgtgcagaagggggaaggtaggaaccaagtgaagtgccttgtacaggcgtcctgctgccgctagagggcgaagtgagtctagaatccacatgcccgcgtcctgcctgcgagttttcccctaaagcagctgtgctggctcccggacagcagcttcaagttgacctcttagaagcccgaccctaatttccgatgggctcagggtcataaattagatttctgttctaggaaactaatttcataccaccacaatactttaaaaagtgatcacaaaatgaaatacacatatacgttttacaaataattacatgaaaacctaacacttaaggctaaattcctttggtgggtgtaggggatggggattgcttggagaagacataatgaggcttgcagtctgatgaggtttgaactgcaggtaccctctttctt

SEQ ID NO: 44881 - DNA, 1102 bp, Homo sapiens
agtgagcagctctgggaacagaactgacatgagtgtctgggaggggacatgggaaggatctgcatacaaattgaagatccaattcctataaattttctatacaattgtatattttaatatataattataattgattttaagtctgtctctggaaatataagctttaataatttacatcttcacttaatcacttatgaaatcattttataacccttaataaaattagatagtgtaacttgtcaaactttgttctcttataaagttgcttttggttatccaaggtcttttgcatttccgtatgaattttagaatcagtttgtcagttttctacaaaaagaattctgctgggatttcaagggtttgcattgaatcagaatcaatttggaaagaatttacagtttaacagtcttaggtcttctaattcatgggcacaatatggctctccatttaattaattaaatttaattaatttatttgatttatcttaataatgctttatagttttcagcatccaggtcttgcacatctttggttagatatacccctcagtatttcccatttgtatggcattgttatagtattgtttttaaaattgtagtttccagttgttcattgctactttaggcaaatctgatggatttttgtgcattgattccgtatcctgccgcaatgctgaactcacctatcaattgtggtttctttttttggtagattccgtgggattttctacgtagatatgacgtctgcaaatagagacagttttacttcttgtttccaatctgtgtacctttttccccttcccccttaccctgtcgcactttatctccagtacaattttaatataagtggtaagaggggaaatactcatctgttctgatgttaggcttgtattagtctgttttcacactgctgataaagacatacccgagactgggtaatttataaagaaaaagacgtttaatggactcaagttccatgtggctgcggaggcttcacaatcatgacagagggcaaaaggcacaccttacatggcggcaggcaagagagaatgagagccaagtgaaaggggaaattccttataaaatcatcagatctcgtgaga

SEQ ID NO: 44882 - DNA, 1134 bp, Homo sapiens
cctctcctatgcttatgcatacactccccaaacgtatcaatccagttgctattgcccaaggaacagaaggctcatcactccatggagggtttttcctgcagcccctacctaagaccttctcactttctctgacagtcctatcatcgtgtcgtaaaaggcctgcccacttagtccaacacactggaaatggatgattgacaacatgtttatttacccatcccctgggggaaagtctcagattttgtgaggttgttgcccctgcaatgtgctttaaactcagctttctgttgcttgtgtctctgggtcagaagaatttgtcagtgataatgtttttgttaaagtcctatgcccagttaatgccaactcagcgctctcatcccctagggctcctgtaatcatttttcttgccttctcttacagtttctgtatgttatagaagttcaaagaagacaaactctagccaagagcagtgtgaagaaaagaagacgctatattaatcacagtccagggatgccttctggcttcctggcagcaattccggcctgagattccttctctgtgcatacttcctgtcaacattgtgtgatgtcaagctgtggccgtcacaaaagtactgtgaacacctgtaaatcccaactatcaaaaatcacacccaggaatccaaattagcattattatgtcaaaagaaaaacctgatttcttcactgtctgataactgctttctttattgtcctaaactagcattccctaacctttgagtgagatagtgacactttagtttcttatattctaaaatgttttcaggggcagctggtggcagaggagagggcagtggggatagggcagggagacagatacctgcacaaggaaggtatggggatgaggtgggagtcaagatgatgaacggagagagggatggtaaccgatttagtcacccatttgagagggtctccagacttgcactgctggctaaagactcctgtcctaagtgagaaagcatcatgtcaggcaggggctctatcccggtggttatgggtggacattctggagtgatctaaggaggcttcccgagtctcactgttggctctccctgaccccttctaaagctttctttctagcttctgctgccctcca

SEQ ID NO: 44883 - DNA, 1077 bp, Homo sapiens
catttgaacacttacaggccattgtagggttattagttggctggcctaatgtcaatattgttgtgatccctggaatagagagtctccctgaagagagagtcaaaggaacagctggttagtggagcagtgagaacacacacagcatttgttgattaagttcactgtcttatatggacgtggttcctgatgcccccaaaacttgtagaagtaacatcaaagatcactgatcacagatcaccatagcagttgtaataataatgaaaaattttgaaatattgtgagcattactaaaatgagacagagacacaaagtaaaacatgctgttggaaaatgggtgccagcatacttaattgacgtgggatagctgcaaatctcccatttgtggaaaatgcagtatctgtgaagagcaaccaagggaagatccatgaacgagctatgcctgcaactgttattatcctagttctgaagatgacttacaaacatggaaggatacgagtgtagaataagagtgagaatagaggaaattgcctcgtattaaagctctatgtagtgtatatgtacatgggtaaaaactgacagtagtaaccaaacccgaagcttttgtgtgaagttggtggtttttattttttccaaagtttccttcattgtttcaacagaaagggtagaagaaggggaggggagaagatgtagtaaatttagttttggtgttttctttcattctctttagaataatggggtcccagacacttctgagtctcatgatgcagtggtatctttacaactgactttctagattgacacttttatgtttgttttttttcctgttgtcgtgtttctcaaagtgtggtctaggtctcattttccagattgaattacagtttatgaaggtgtccttatagtcagctgatggtggaaaggtagagtcaaagtcagaaaaataattttagtgtatgtctatagttttgatgagaagaggctttaaccaacgattaaagcagaaagggtaaatgccttctgtgttaagagctgctttttggttttgaaaagggaaagaaaaattcagctaaaaggttctgt

SEQ ID NO: 44884 - DNA, 1044 bp, Homo sapiens
ttaatacctatgtattgttaaagcgattctgtaatagaggcagtattgctgcgcggtggttaagaagtaggttttctaggggagtggtgcttgcggtagtgctgtgaagcactcaccagcttttggcatataaacagcaaaaaatattaggtacttataatagtggaataagaagaaccaactccattacgaactgtccgtgttgttgaactaaaacttcacattcaattaacaatttgttgggtgcctccttcatgctttccctttgtggagaaagagatgaatacatttgtacctgttttatatctttagggtttcctttcccccgcagttccagtcttttcaatttttaaattaaaaaaaaaaaacaaaagcctttttaactgtgaccattcattattttgctttcgggaattggaattgtctttcagtctcgaatgttctgggaaatgttgtctctgggcttcctcaatatccctttgcacttgctgaaataagtgactgtaagaatccaagttgttggctgggcgcggtggctcacacctgtaatcccagcactttgggaggccgaggtgggtggatcacgaggtcaggagattgagaccatcctggctaacatggtaaaaccctgtctctactaaaaaaaataaaaaaaaacaaaattagctgggcgtggtggcgggtgcctgtagttccagctacttgggaggctgaggcaggagaatggcgtgaacccgggaggcagagtttgcagtgagccgagatcgcgctactgtactccagcctgggcgacagagcgagactccgtctcaaaaaaaaaagaaaaagaatccaagtgcttacctggtttcaggtgccagcagtggctacagttagtgttcctgtaagggttgcttgaggaaaagctcaggcctttcccgtaatgtggcccatcctggacacctgcctcatcactttgggcctgtgcagtaaaagcagagatgtgccatggtgagaaggttctcttctactcgcttatttgagaacattagctggggtgaaggg

SEQ ID NO: 44885 - DNA, 1071 bp, Homo sapiens
ctatttgcaagaaacctgtaacttgtccgatttgacgtccacatggttagtgtatggatgagggtttcagaaccctcttcaggaggcttagcagacaccgttgttcacttataaacatttggactctacttctggttttttttttttttaattacaaacaaaactttgttaggttgttgttttgtgtaaagtttgtccttgtccccccaaggacaatctaaagttctttctaggccagtctccccatctttcttggggagagatggggaacagaggagatgagagatttcttgggtcccaggcactctgcattaacgccaaacttttggacttacaaaaatatgcttgcagaataaggtaacattaaagtccttcctgacaagcaatacaaaaatcattgaccaagatcacaaccaataactgcacaccaaagacccgggaagcccctggtccctggggcgcctctccccaggcttgcctgggccgcctgacccaacgcctggacaaaacaaaggcccctgcttcccggcaccgcgcggcctccggagctgcacccccaaatccccgtggcgacttcatttgaagcgtggaagaagcaaccacgcaagtggagagtgggttctgaaagctctgggatgaaccaccctctctctttctgtcgttcctcttttaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgc

SEQ ID NO: 44886 - DNA, 1076 bp, Homo sapiens
caatgaagaaatcatctgatgccagggactttgaagtctttctccaagaggtagatacgatgatctctgttttgctggaaagaaagctgatacccagaaagagcctgtaatctcaggtccccgtgggtagtaaacagccctggtttggaacccaggtaagtccaacctgcaggattgtactttccccctttccccacactttgtatttgccaaatctgatatgagggcacttggctcttcagaaccagaagctatgtgtgattgaagggctctattaaaccttaggattttccatgacttgtcgctcccatccgcttcctctccccagggtagcttcttgtctgagtttccgtttgcttcccaccaatcactgtctctctaggagcaatgtcgtcctacggaatcttccgtatcattcctcaactgtaagctctgcagttcaggaatgcaatgttaggaatcccagtgttgcacaaacttcctttctagccgttggattctggtgtgcagagaactaaagagacttcccaggattcagacccttccaatgggaggattctcctaactctaggggaactgttggctgcttaagagcaaaaccatatggctcactcaaaaatccctttcctaagagaaatctataactgaccctctgtgttcccttttctctgaagatttcaaatatatttgtggtaaaagcagagaaagaagaggagaaaatcataataaaagcacaataatgatgattttagtaaagataagaatggggcatggatcaagacaatgactaaaaccccaggcaggaaaagccccgtggaattggtctgaactgaatgtagcagcccatcagtggaagttttcttgtttctggcaggtggcctatgcttttatctattactgctctgtaatcagaattgagccacgatattcaagtttcttatctgaatgatgggaatttggttttctggccttctgcattttgcaggagcccaagaattgacctgatgttttaaaatatattttccctccaaaggaggagtaaaatccagacaggtgggccattctgtgtgtttaaa

SEQ ID NO: 44887 - DNA, 1042 bp, Homo sapiens
acatttaggtcatagaccccatatccaacttactgtctataatttctcttacataggggggcacatttagataagcacagactaattggggttatagtcatagctttagaatagtttaaagacctagctgacggccaggcgtggtggctcacgcctgtaatcccagtacttcgggaggtcgaggtgggaggatcacttgaggtcaggaattcgagaccagccgggccaacatggtgaaaccccttctctactaaaaatagaaaaattagccatgtgtggtgacaggtgcctataatcccaactactcaggaggctgaagcaggagaatcacttgaacctggttgcagtgagccatgatcgtgccactgcactccagcctgggtgacagagcaagaaaaaaaagatctagctgagggagttgggaccagatgattttctccagtgatgtttgaacaaaaagaaaaaatgcagctgggcgcggtggctcatgcctgtaatcccagcactttgggaggccagggtgaacggatcacgaggtcaggagttcaagactagcctggccaacatagtgaaaccccatctctattaaaaatacaaaaaattagccaggcgtggtggcatgcacctataatcccagctacttgggaggctgaggcaggagaatcatttgaacccaggacacagaggttgctgtgccactgcactccagcctgggcaacagtgcgagactgtgtctcaaaaaaaaaaaaaatgcagaagctacttaggttgaacacagaaaggaagaaggactgtgtagttcagtagtgtgtgttctgagaaagccctcacagcgttggtctctagtaatctctggaaataagtgaatcattccagcttgaattatcatgatgcaaaattgtgttcgctgaaaagcaggggttaagtccgctgccttgtgaatttccgcctggaaatgcatctgacccatggtggttgctcaattctgagtgagtttggagaaggaaggaaaatgaggagttacttattagttagtcgttat

SEQ ID NO: 44888 - DNA, 1026 bp, Homo sapiens
agagatggggtttctccatgttggtcaggctggtctcgaactcccgacctaaggtcatccgcccgcctcggcctcccaaaatgctgggattacaggcgtgagccaccgcgcctagctgagaccttttgtttctacgtgacattcttctgtaccgtttgcctgtttgaaaaaaaaaatttttttttgagatagggttttgctttgtcacccaggttggagtgtggtggtgcgatcataactcgcttgcaggcctgaagtcccaggctcaagtgatcctcctacctcagcctctggagtagctgagactacaggcgagggccaccaagcccagctaattattattttatttaagagatgtggtgttactatgttgcccaggctggtattgaactcctgagctcaagccatactccgacctcacaaagggctgggattacaggccagagccaccatgcctggcctgtttgaatttttgtagcaattaaaaattgcgtaatttaaacacaaattgaaggggacagggactaaaaacataaatgagagttagaatgcagtgccacgttgaatgctttcacaggtaggagcctagaaatcatctgttccaactactgcacttttgagttgtggagaccagaccaagagaggtgaaatgactgttggctaaggcgtccacctctacttgcgtctggaattgcccctgcctctgcctttaagtctggtctgcgtggcttctgatagcgaagccaggggcggaccccgttcactgcatcaggagagccctgagcagcgcttggcaggaactctgcagcccagggcgccctctagaggctggaggaccttcgtcaagaccccggggggtgtggatgtggacctggaggagtggtgggcagaaggcggagccaccctttcacccagtcaattgcattcctctgtctttaatgttgggcttcctcagattagattttctttgaagaaagagttctgcagcttaaaaaaaaagtgacagaagaatcactggtgcagagt

SEQ ID NO: 44889 - DNA, 1051 bp, Homo sapiens
agtgtcgaaggtgcattaaacagacatacatatggatgggtggacagaccagtggatgggtgaacacacacacacaaatatacacgtataggtgtattagtctgttttcacactgctgataaagacatacccaaaattaaaaagtggcttaatggactcacagttccacatcgctggggaggcctcacaatcatggcggaaggtgaaaggcacgtcttacatggcagcaggcaagagagaatgagagccaagcaaaaggggtttccccttataaaaccatcagctctcatgagacttactcactatagtgagaacagtatgggagaaaccgcccctgtgactcagttatctcccatcaggtcggtcccacaacatgtgggaattatgggagctacaattcaagatgagattttggtggggacacagccaaaccaagtcaatagatatatatgtgtacagatgtttgagaatttttttaaatgtaagaatatataacaggctgttaaatccatttgcctcactgggataggattgacggtagtagagtgagagggctgttgttaacttagtctcatgtatcttttcatgatttcttgttataatgaacaagcaaatggctaaagttatgaacattcataagaaaatatttctacaaagcatgtatacaaggatgtttgttaatcactgtaatagcaaaaatggaggaaagaaaacctttggaaggaaaatggttaaactattgttcttcaatatgggaatggtacaagaaacttattgggaaatattatataggtattaaaaagattatattctcagaaaataaaaaaatagaattaccacatgatccagcgtaccatttctggatatatacccaaaataattaaaggcagggcctcaaagagctatttgtacactgctgtttatagcagcatgattcacaattgcagaaagatgtaaacaacccaagtgtccacggagaaatgaacggataaacacagtgtgatatacatacacgtaggatattactcagcctttaaaaggaagggaattc

SEQ ID NO: 44890 - DNA, 1050 bp, Homo sapiens
tcgcaggctgccggctgttcgtttgtccctgccgctgatttgggtgtgctgactctgcttcattccagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccaggtacgcgccatggctggggcgccagggctgtttgtggggaggccgactgcagagtcccagaggccagcctagtactgggtgggacttgcagccaggcctcacaggtgcaagcagtgagctaccctctgcgctaggaagacccagccattgagctgtgtggtgccctcagggccgcacgaggctaggggcatctgcatcgggctgtatttcaggacatcttatcaagatggtgatgtggacatgactgtgactcacaattttttaacagctcctctatgccatcatctttggaaacaaagagaggggagtccagggctggcatacagcatgggtggcaggggcggaaaacaacacagaagtacaacctgaatgagactgcgtgctggggcgaggggaggcgtggttgcgctgtcggaggccgagcggaggttctctaggcaagtctgcctcctacgtgcagggaggttagacttcaacagggagggtggggaaggaggaggaagctggcatggggaaaggcctggatcctgcagagggcaggcagggcaggctggtggggaggtcacaggcaggatgccactttcatgagacccagctctgcacgtgtgtcaggggacgccctggggcagcccatgttccctctggcggaggacgatggcgtctcggcctccctgcctcctcccctctgcagttccctctcttgggaccaggatgcaccaagcttgatcacggtctcctttgaccagccctggctgttatctcgtctctgctcttaactgaaggaggccgtgtcttagtgagcttcttattgtctgggagaacctgatcccaca

SEQ ID NO: 44891 - DNA, 1063 bp, Homo sapiens
gagccttccccctgtagggcccgggtggacgcggccgtcctggctgacctgtccctgcccccgcaagccgccctgggcatgagcgacttttgcgtggttcccggtggttgcgctccccgtttcgtcccctccgtgagcatcggcgcttaccggtattttaacccgagggttacacatctgaggcaatgtgggtgggttacgcgggagaggacgagtgagttttttggtaagcggaatgaactatgcagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggtcagaacttggttttacttagatttttatctgcctcatgcctgtactatttgtttaatgaatgcataggaggtgtttttattccaacaagaaaattattcgtacgcgattattgaatgaatagacaaattcagccaagttcttctggtctggaccagcctggctgatttctgtaacttttttgggccaacaggacagtagcaaatgtgactcaggccgaggcttgataggtgcctgaacatcggagtctttctttcagtgtccatgtgcttcagtaaacacactagaaaataaatttctggtttttgtccccagtagactacaccctcatttggtgttatttttcacgtgctatctttaatacaggtacatccttcagtctatttgtagaacattcagttttcttcatcttttctttgccggtgctacattatttgaattattttgctacagaataacttctattatttgatatggcagatgtcactttttatatttagatatagcattcatttatttaacaaatatttgacgaccagttgtatatcagatagtgttctaggtgctggaggtacaacagtgaacaagctaggtgaagaccttgattttataaaactt

SEQ ID NO: 44892 - DNA, 1279 bp, Homo sapiens
atcaatctgattatgtaaatttatgtaaattcagttctcaagtttgtggtttttttcccctcctggagaaatctattctattttaaagtgaggaaggctccgtggagggctggtagctggtagctgttcacttgtggaactttcagcctgaggctggagccccttcctgggagtctggtcttgtcgtcttcctgaccacccccacacccttcctctaaattccctccatccctgtttttctcccgcttgcgagcttttgggagtgtgctgaatctcagactgcaatagataaacccaagagggacaggcaccagtagcctgagcttgctttctcccctggctcatgggaatcaagcagtagaaatttttagtgagtgttgttttccatagtatgcttactagttgtgtcttcctgttttgttcttggtgatttgaagaaacctgtttacaaggtaagggactgaaacaaataggtgacaggaaaaagagcagcaggggtacgagctggaggagtaagtggcttggcttgctctctttcagaatggagggctgtatggaaaggaggggtagtgttcttgaagagtgttggggtttaaatctagggggaccgtgtcttggcattgattgaaactcctggcttaacatcaccccgaaactgttagttggactgaacatgacatttggcagtgcagttaaaaacacttcctgctgtagcctggtaatggtcaggctatgtgaagagctgctctggagctcagtccagagcgggtattctgtttctttcactctgaaatcctgcctctcgatattttgagaaggaaggagttggtgaattgttttaaaatcctcgatgaatgtcttcatttattcatgacaccacttctgaatatatttatgtgccagacgctgaagtttactaatattatggtgcccagtaaatacttgtttttactaatattttttatggcaataaaatgactttttcaggattatgtgatttaaaagattgacccttttggcaaaatacgtattcatgataggaaatatatacaaataaaaacaacatagttcacttaaacctcccaccagagcccagggttcactgttaccattctgaagtgactatggaatttcctagaagtggatatgccatatttttttaaccactcctattggatatttgttttttatttttttgagatggggtcccactctgcagtgtacaatatcatagttcactgtaacgtgtatctcctgggctcaagcgatcctcccacct

SEQ ID NO: 44893 - DNA, 1944 bp, Homo sapiens
aaattagctgggcgtggtggtgcatgcctgtaatgccagctcctggagaggctgaggcaggagaatcatttgaacctgggaggcggagtttgcagtgagctgagatcgtgccattgcactccagcctgggcaacattgcgagactccatctcaaaaacaaaaacaaaaacaaaaaaaatgtgtgacctaaattaggcttatagatgaaccattgcagtcatgattaattccgccattgtttgccttgtgatctttggtgccatgtctgtacatatttcatgatttctgtgtttttacggtttccatttcagatctcccttgagtttagaaatctggctgagaaataccaaacagtgattgccgacatttgccggagaatgggcattgggatggcagagtttttggataagcatgtgacctctgaacaggagtgggacaaggttagtctcataaaacagtgtctgtgtgtgatgtattagacagagctggcagtcctcatagtgaagctcagaacaagaaaagttgtccagtattttcagcccctctggttttacaattcatctgtttaggttgaatgtctcatcataaacagtttattccagagttaattccaaaccagcagctatgtaggatatcagccaggctaggagtagggtactggagagaagtgcttatctagacaaagggatgtaattgaccatgaagattaaaactacacatcaaaacataaggtagggttaggagtcttgcctatttttcataggaatggtgtttgtgagacttactcatcacttctgtggaagtaaagacattttatttatttattttaaagccagtcagatttagcaggcagagacatttcagacatctaaagtgttgatgtatttcatacctttaactgtgcttaaattaggatctccgaaaagatgctgctacatggtcactacgttagtgtaggtccaaggtcttgggcctcttaatttttcaaacctcaaaacttgacagcagttatctttggaactgctgatttgtgcttcctaagttaacagcatacaatgactgctagaaatcaatttctgcatttaaggtgaagttagccgggtactatggtttacctgtaatctcagcactttgggaggctgaggtgggaggatcatttgagcccaggagttagacacaagcctaagcaacatagcgagaccccgtctttcaaaaaattaaaaaatgagcagggaattggtggcatgtgcctgtggtcccagctactctggaggctgaggtgtgggaggattgcttgagcccaagagttgaaggttgcagtgagccatgattgtgccactgcactccaacgtgggtgacagagcaagacaccatctgaaagaaaataaagttgaagttaaaacttctggccaagaaccagcactggttatgatagtaactcattttctgttgtgcagatttattcaggaaacttaattttaggttgttgaatagaagttttgatcagataaaattgaattaaaaaaaattttttttgagacagggtcttgctgttatccaggctggtgtgtagtggtgtgatcacggctccccgcagcctcaacctcctgggctcaggtgatcctcccacctcagcctaccgagtagctgtaactacagtgcatgacaccataccaggctcatttttgtacattttttgtagagagagggttttgccatgttgcccaggctagtctcaaactcctggcatcaaacagtcctcccactctggcctctcaaatgttgggattacaggcatgaccagccaattatttcaaggagttattttttttcttctactttgggggaagatgaattatataagtctccattttaggagtatttctaccaaaagaactattatcttcaaatatatttttggatagtactatagatatactaatt

SEQ ID NO: 44894 - DNA, 1031 bp, Homo sapiens
ttccaaataaaatggaacttttgtggctacattatagaattgttttagactgcttaattctgtgtgttgttgagaaagggaggagtggggaaggtaaaaatcttgacatactttcttcgtgggtattttttcttgagcgattccatcttagttgattagcagttagcaattgcccattcaacagaaggttttcttacctttttgtgataatgatagctaacgacatcatttcttcttttttccctctcttcttgttgtctctaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagaggtgggtttttatttaactacttggataatttgtagctacttttatgatttagtaatgtcactgtttaaccaggtttggatattagatgatcctaacaattcactatcctgtggcctaaagagacaggaattgatatcctttataaggaaaaaagtctattcacaggagccgagcagattgctcactgctgtgtagtaccctggtgagaggagataaatggagcaaggctgtaggttggagcccctcagtagaatcatagattttgagctgcaagatgatgcaggaggccaaccaagcttcttgttgctggtgaggaatgtgaggttgaagcttgtctgtgctgatgcagtgcgtgattgagtggatctctggctcccgtccatgtgtcctgacacccagtctggtactttcattatgccacaggcctcaattgaaaaatcacagtagggaatttaggccaaggaaagccatcaagttgcaattatttcctaaattttctttggaaaatttcatttcaaataccaaaaccatcctataaaaagaaaacttaccttcttaggtcaaatctctaatatttgactaggttcaaaaagtttatttctggccaggcacag

SEQ ID NO: 44895 - DNA, 1032 bp, Homo sapiens
gactcaaaagttttgccactaattgtattaccggggactgtcacaaccaagatttctcttaatttattcaccttacttatctcctggaagggcatattgaagtgctcttggagttctctaaaagggtttttgttggttgtgtatattcacttgggtgccagcgattgattccaaataagtaaatcttttttcccaaaaggatgtaagatggcttatggttataagtacaacaggctaacaaagtacaagtagatgagaaagtaaaatgaagaaataaagtcataggagccacagaattaacccaggaatgaataagtgtgtagtttggtgctgatgttatcatcctttatttgtacattgcttgtacagttgctctgagaaggtaagtcttaaattttcaaaagtgaaatgtcaccgagcatggtggctgatgcctctaatctcagcactttgggaggctgaggcaggcggatcacttgaggtcaggagtgcgaaaccagcctgacttatgtgatgaaaccctgtctctactaaaaaaaaaaaaaaaaaaaaaaaatacaaaagttagttgggcatggtggcaggtgcctgtaatcccacctacttgggaggctgaggcaggagaatcgcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggcatcagggcactcaggtcatttacaagagtagtgtgtgagaccctgtgtgtcactgccactcatcttggccttcggccactgctgtagcaaccagtttccaagtagggctggaccttgccttctgctccagagacctctcgcttcctgcccttgggcttctgacgagctgcaggaactgcctggcacgtgggtccccacaacccagaggaggtgagggc

SEQ ID NO: 44896 - DNA, 1154 bp, Homo sapiens
ataggccttcctgccttctgtttcacttctccactcgtttccaaataaatggctgcatgcaagcttttgcctcaggttctgcttttaggaggaaggctaagacaagcagtaaagcaacatgggcaggcagaaggatgacttctaatagaattatctcatcactatatattttactttatggatgcttgtattgaaaagtcttggctgggtggagtggctcacgcctgtaatcccagccctttgggaggccgaggtgggtggatcacttgaggtctggagtttgagaccagcctgaccaacactggtaaaaccttgtctctattaaaaatgcaaaaattagccagggatgcacgcttgctgtgtgccagcacagggctaggctggagataaaaaggtgagtaagtaggtgcggtgtagtcagggtgaaaactacagatggtccatttccacgtaagtggaaaggtaaaggtatgtacaatagggtggctcctggctgaacctggagctgcagacaggttttctagaaggcataatcctgaagttgagacttgggggcctaggtaggagccagttgaagggacgtgggaggcgcattccagagagaaggagtggtatgagactggaacagaggtgtgcagcagcatcgcatgggcgaaacaacagtagacagttgttcttttgtttttgtttgttttttgagacagggtcttgttctgtcatccaggctggagtgcagtggcatgatctcggatcactgcaacctccacctcccaggctcaagtgatcttcccaccccagtccccaagtagctgggggaccacaggtgcatgccacgatgcccggctaatttttgtacattttgtagaaacagggttttactgtgttgtccaggctggtcttaaacgcctgagcttaagcagtctacgtgcctcagcctcctgaagtgctgggattccaaacatgagccactgtgcctggcccggcaactgttactagactgtagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatct

SEQ ID NO: 44897 - DNA, 1282 bp, Homo sapiens
acgtttattgggcctggcactgtgaggtgctggggatgtgaagatcattgtggctcagccgctgctctcgagggcctctgggtgcagtatgcacacctgtgcctcctgtttgctcaggaagacaggctttgagatgagctggggctgacatccccaccttatcattgggatggctttgggtaagttatgttcatgttctctgagcctccctttcctcattggtaaaatgggtataaaatacctgccagtggagggttgttgtaagtagccatggaaaatgtaaagcacatagcacttatcattttttcctgtgtctttaacagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtcaagtacagttcgcttgaaagcctgcctgactgtggaaaagat

SEQ ID NO: 44898 - DNA, 1022 bp, Homo sapiens
caccccagtcagtgttccaggagttggcaaccagccagtagggtgtgccattctccactccccagcccaggatgcggatggcatggccacccatcatctctccggtgacgtgttggtacactcctgaaaagggaagaactggctgagaccgagaccgggccactgtcccacgccccacagcaccccccacactcagctggtcatgctccgggaaggagaaacagcttccagagggaacctgctgctccaccaggaggctccagggggggtcccacaatactggggaattaaatatatttttgaaggcccaacacactcaaagttgttgagtaaatattgaaatagattcctacaaaatgtgcttgttggctttaaaaatagaatttctaatacattctaattgataaaacatttaatgctagatgactgattcatctgttctttatactgggattccatgtaagtaagggtttgtcaaaagcgttacacggcttaaagagttttaatagctgctccaggtacaccctgaagaggtgagggaggagaagggaggactggtggcagctaatgctagctgatgggaaagatactggctaaggggctcagggctgcccaaccaggctctcgggtggggaaatcactgtcaaagtggaaatgcatcttttaataataagggcgaggactatgctaagaagtgccatcttcacagaaactttttcttgccagaatcatcttcctttgtcaaactgttgttttacaagtttccaatctagcaaaatattaatgggatagatgcagtcagcaaagactgttcatctggagcaagggatttctaagacaggacttggggatggggactgtccagattccttggttggagtccctatggcactacccagggcaaggtcctccctgtgtgttcatccactggtgtgaggcacgatctaggcctttgcaaagagaaagatgaagaaaatgtgtcagccagtgcaaacacgaacggcctgccattataacagaaa

SEQ ID NO: 44899 - DNA, 1048 bp, Homo sapiens
aattaggatgattttaaggatggtgatgaaatgagtgggctgtgacctttggccctgtttctttcctttgtcttttcatgggccaggtgtgcttcatcagaaggcttcctatgcccgatgtaaagtgtcctgggggaagaaaggagcactgcttagaaagatgctccacagggagaaaggagccgccattttcagaagaatgttccccagaaacatgagcaatccagatgccgtggcttcacacagggtgttggatggtcttatctctttaagcgggacctaggaattgttgtcctttaatgctcataactgcttttgaggtgagccgaattgatgtcctgcctgcgtgtcatgctcattgcactttaattcacacacatgtcacacacaaacactctgaataagcacatttttgttcttgagcaatatttcacccaagattctgtggttctaccgagccctgagttctgtcctggacatctcaactctttggtaggtcaactttgatctttgtacctaatgataaatggactatgaaatcttatcagcaaatatacaaaagtaaggggccattctccacaatcgtttctctctggtaggtcatctttgataactgtacctaacaagaaatgaatatgtgatgattcctaatcaaaaaatttcttgattttttgccattttaattaattctgttaatgtttaaatagagttttaaacccgagatttggcatgaagtctaatcgtcaaatacacaaaaggaagggtccattcttcaaaatcttttccactgaaagaccacctctgatatacaagtctcgttgcattacagggatcctgcttccaagatgcagctttcacagcttgatgattgacccagaatctcctctaatgccatttttttacacccaaaatgagatttatttcagggcttccggattttattttagctgaatacatccactcttctgtttccatttctttcaaactcttttaaataattatcttgctgcatcagcccttatataactactgtccacccaccgagacc

SEQ ID NO: 44900 - DNA, 1107 bp, Homo sapiens
tgtgttcctccgctgatgtgctcctctcgaagtccagctgcctgtgtctgcctgctagggtctcagggtttttataggcacagaaggggggtttggcagccagggtggtcttgggaaatgcaacatctgggcaggaaaacaaaaatgccagtcctcacctaggtccgtggacacaggccctggggtggagccctagccagggaccacaccctcctctacccagtacttcccttcctcacttccatatcatttaaagggaccacattcttcccttctgagcacttcccttctgtatcacaaagttttgggattataggcatgaggcactggtcccagccaattccgttcttttaatgcaaactagaaaataggtgttcagaaaggcctgccctatccacctcagggagttgctatgaagatcaaattagaccatgtgcaacagaagtttagaaaagattccaaaagcactgtgcaatgggaatgtatttttaaactccactgagtggacttaaaactatggttttctttctttctttctttctttttggttgagacagagtttcactcttgttgcctaggctggagtgcaatgatgccatcttggcttactgcaacctctgcctcccaggttcaagtgattctctgcctcagccacccgagtagctgggattgcaggcgcccaccaccgtgcctggctaatttctttctttctttgtttttgtctttttagtagagatggggtttcacagtgttggccaggctggtctcaaactcctgagcttaggtgatccacccaccttggcctcccagagtgctgggattaaggctttagccaccgcacccaacgtgtgtttctttttcaagcaagaaaacaaatgcctctccccagcgctcactaaacaaatccctctgttatttttttttccataggattcttatccttcttgccccactgcaaacaatctattttcttttggcccttccgtctgtctgtgaaagggtcaggctttctagctaacccttaatcaaatatttttgatgaccacagtcaagacagtacttattatttttttggggggacggagttttgctcttgttgcccaggct

SEQ ID NO: 44901 - DNA, 1025 bp, Homo sapiens
cagcctattgattctctatccgagtgaaattacctgccagtggagaacaagagaagtctttgcatgaaatgctcttgtggaagctagatggcaagtaataaagcatcaagtggtagaaacatgcactaaagtctgaagagatactcagtgcacaatgtagagtgtgtaagactttggggaaatcatgcaatcaccgagagactaattgatgacattccgcaaatttatgtgtgccagaaaagagagatgaaaatgacattgtatagtgaatggtttcggacgtgcgacggcagtttaagaaaacctgaaacaaaaaacttgagaaatcagaaggtatcccaactataacctttggtttattaaagaattgatgaaaataaaaacaacgtatctcacagcatgggtgataatattttcatacgtatgtgataatggatcaacatttgatagagatgaaatgaaaagttctaaatttgacaaaagcaaacaccgaaaattgcaccgtagaaaagccctggtgacgggagtgaggccctgtctcaagaagaaaacattggagagatttaaaagcagagagtgaaacccaggatagcataagattgttaatactggcccttgtttcagtgggaaaaggcaaaaataagccgtgtgtctcctggattctcgcatcgattgttcaggatctgagatgttgcctccatttacagttacgcattgcatggtggaattgcagttagcacatttggtgcaaaaattttagtgctgacgaaaatggacatgttccctgaactaagagggacataatttgggtgtgtcttcaggctctctggcttaccaggattgaagatctaggctctagggattctcccaaaatgtcttagacagtaagcactggagcagaattgaggcccggcgccaaggtctcgaggtgtaaagaaacagccgtggcctcagggcccatgaaattaggatgattttaaggaggatgatggaatgagaggactgtgacctttggccccgtttct

SEQ ID NO: 44902 - DNA, 1028 bp, Homo sapiens
tgtttcttaaaagaacgataaaaataattgcaatgtaacacacggcctgtgtgataatgttttaatacatatctaaaaatgccttaaaattcaatagaaataaaataacaacttctaaaacttgacaaaaggaaacaacaaaaattacacactggaaaagcctggctgactggagtgacatcctgtctcaagaaagaacagacaaacccacaaacaagcaaaggattctaaaagcagggaatcaaacagatacttgtacaccattcttcctactagcactcttcatagtaggaaaagtcaaaaacaacccaaatgtgtggtgaattacttcatcagttttttaggatctgaaatactgcctcaattttcagttactcattgtggagagaacctgcagttaccacatttgttccaaaattttatggtgatgaaggtaaacctgtccggcattctcagagggacagaattctggtgtttgtccaggttccttggcttaccaggaatgaagatccgaactgtacagacttttttcaaaagtatgtacatatgtatgtatgtatgtatgcatgtatgtatgtatgtatgtatgtatttcctctttttaaatttaaaaattacaggatacatgtgcagaatgagcaggtttgttatataggtatcctttgctatggtggttcgttgcacctattgacttatcctgtaagtttccttccctcacccccagcccccaacgggccgtgttgtgtgttgttcctctcactgtgtccttgtttcctgaatgttcaactttcacttattagtgagaacatgccgtatttgttttttttttgtttttgttcctgtgttagtttgctcagtatgatggcttctagctttatccatgtgcctgcaaaagacataatctcattcctttttatgactgcatagtatattttggtgtatatggaccacattttctttatccagtctagcaatgaagggcatttgggttggtttcatgtctttcctattgtatatagtgctgcaat

SEQ ID NO: 44903 - DNA, 1075 bp, Homo sapiens
cattcctttttcttcaggttgggcagggccacggtcatctgtggggcctggtacccatgcactgttattaacatatacttcaataggattatctatccaagtgactgctcgaattaagggtgggaaaatcacataggcccagtaagtatagttagctgtagcggctcctgaagacatagggagacttaccaccgttgatacaatcattaaatctgcaagtagcatattctctggagtttgtgttacccttgtgttttccaggcttttttcagctaactgtgtcagcttctttagctgggcccaggtcggcggccccactttcttggtggatggcaacttcatctgttcttctgatatcaccatttcgttcaccctgcgagtcgatgatgttcgattgcgggttctctgtctctgcggaggtgccttcccttgcacctctgatgggttcattgtagaacttcaaatgtctagtgggtacccaaagaggaagctgattttctgctgttggaacacaagcaaaacctcacccccatgttatcaccttacctatttcccatgttttatttttgttgtctttccaccaaatcagttttccctcatgtgggctgttctttttaccagtaaaatgttgttctgcagaagtagtggtctgatttctatatatatttaaaaaatttaaagtatagagtgctagattaagttgcatctggggagtattatactccttactttttccttcttttgtttaaccaattgagcttagagtgttctattagttctttcaattatggcctgtccttggaaattaaggattcctgttgtatgtgtaattttccactgatttaaggatttttgaaatgctttactacagtatcctggcccattacctgtttcaattttttctggaaatcccatgactgcaaaacaagataataaatgtcttttaacatgggaagtactttctcctgtctggcaggttgcccatatgaaatgtgaataagtatcaactgtcacatggacaaatgacaattttgcaaatgaaggtacatgtgtgacgtccatttgccataatgca

SEQ ID NO: 44904 - DNA, 1050 bp, Homo sapiens
ggtgctggaaaaactggctagccatatgtagaaagctgaatctggatctcttccttacaccttatacaaaaatcaattcaagatggattaaagacttaaatgttagacctaaaaccataaaaatcctagaagaaaacctaggcaataccattcaggacataggcatgggcaaggacttcatgtctaaaacaccaaaagcaatggcaacaaaagccaaaattgacaaatgggacctaattaaactcaagagcttctgcacggcaaaagaaactaccatcagagtgaacaggtaacctacagaatgggagaaaatttttgcaatcaactcatctgacaaagggaccaatgactttcttataaccaagagaatatggcagaggtgatgggatgtagtgattatgttagataggatgttaagttgtcttgctaggaggttatcttgctggctttgaagatgtgagctgccatgtcatgagtggccagatggagaggcccatgtggcaagaagctgaggacagcaagaacctggggccctgagtccagcagcctgcaaggaactgaatgctgccaacaaccagatgagcctggaagcagatcaatcaccagtcaagcctccagatgagaactgagccctggctgacattatggttgtagccttgcactgaacccagctgagtcacgcctggattcctgacccacagaaaccacatagtgataactgtgtgctgtctcaagccacaaagtttgcagtaatattgttgcacagcaatagataactaatatgaaaactgtcctacatcatgtacattactgagtgaaatgtagaacctggatttaagctctgatttcagagttgtggtttcagtctccccagggagacctgtcctgggagacagttatgccaggctgtgatgctgtgatgattgttctcttcctacccagaagctttcaataggcatgtcaagcatgtgaccccagctacatataccaaatatatttctgacaaatgacaggacatcatgagctttcttgttttactgagagctccat

SEQ ID NO: 44905 - DNA, 1034 bp, Homo sapiens
tttatatttttggtagagacgggatttcaggatgttggccaagctgctcttgaactcctgatgtcaggtgatctgcccgcctctgcctcccaaagtgctgggattacaagtgtggaccactgcacccagctgttatttattttttctttttttgtacagacagggtcttgccatgttgccaaggctggcctggaactcctggcttcaagcaatcctcccaccacagcctcccaaagcactgggatttcaggtgtgagccaccatgcccagcctggaatctatttttaaagccaatcaagcgttgaataaaattgcaacttgggctgttttttctttgcattttttacatttcaatggttttcaatatattcagagatatacacaaacattaccagtcaattttagaacatttcatgacctcaaaaagaaacctcataccctttagctaacagccccatcctcccatgcccctaccacccctaagcaaccactaatcgacttcctatttctgtagatttccatctgaatgaaatcatgtagaatgtgatctttcatctgttttgaaggttcatccacgctgtagcgtatgtactatcctcctttttgtgatcaaataatattccaccatgtgggtagacaacaataggtgtatctcttcatctggtgatgggcatttggattaattctctctttgggttattaggagtgatgctactgtaattattcatgtacaaaattttgtgtggacctgtgctttcatttttgaatatgaaaatactgcgcatctccaaggaagacatacaagtggtcaataagcacatgaaaagatgctcaatgaaattcatcatcagggaaacagaaatcaaaaccacaattagataccacttcatacccataagcatggctagaatcgaagatagagaaaattggcctggtgcggtggctcatgcctgtaatcccagcactttgggagaccgaggcaggtggatcacctgaggccaagagtgtgagaccagcctggccaacatggtgaa

SEQ ID NO: 44906 - DNA, 1022 bp, Homo sapiens
tcaaaatcaacaacaacaacaaaaaaaactgaacatctccatattactgacacccaattcaagaaacaaaatattacagccccttccaggatattcctggggtctcttccatctctactaacccctgactacaaacagcctccacctatttcacctgacattgtactttatgaaagcagcagttctcagatggggctattttgccccctggggacattagggaatatctggagacactgagggttgtgtctacttggggggagttgtgttactgcatccagtgagtccagggatccagggatgccgctcaacatcctgaaatgcacagggaacccccacacatagaacagagaaattgctgagccaaaatgtcagcagtgtcacagctgacaccctgatatacacactatcacacagtatctgctctttcgggctcaggatctttttcattctaatcatctcataggaaacagaaatgtcatttagaggtaggtagagtccaaaacaaagaagaacctgagtttttttttttttttaatcagcctggtgcctttagagctaggatttagtttctattctttctgtctcattttcaagtgattttttcttcaaatggcatctactgggctcaagaactggagatccccacaaagctgagattcacatgggaattttgtacacacccacacaggtatacacttccatttacatgcagacatccacccacagatacacacatccggagaccaagacagaacgcaaactgccccataaaagcacggttccccaaacaggagaaacacaccattcactccagggaggtatctatttgtttaattcagcctctgatagtcaggctgttgccaagcccagctctgaaactcttcccctctaggaaagaaagatggattttttctttactcaagaatatagatctaaaaaaaaaaaaacacttctgcatctcaaagcaggctctacctcctgagctacacgtattgatcagctttttattgtcaattttc

SEQ ID NO: 44907 - DNA, 1046 bp, Homo sapiens
ttgaaaagagagctctgtatacactctttttctaactccaaagaaattttgtttctagaaagattcaattaccgtaatgatgttctttggaaatgtgcctttttgcgtgtatatcttaatatggataaagttccaaggtagttcaaaggttttaataaaattttacttaccagagtgatgtgaaattgggaataccctgtgtgaatggttaactctactttaaattggaaggtcaatgggagtggggatcttcccagtaaatcttaaatctctgtgtacgtgtatctctgacagcgaaatcttactggagattgcaggggttgtaaagaagagaccagaccttatagtatttctgatacgcggatatgtgaatgcttaaatgcatttcacttgtaaagaatttatatgctcctttagagaactagtctccaaaatttgaaacacatttatgaagaaggctctatcattgctttgaagaagacacaagcaagacatatttggcactatacaggctcataatattgagagcaaaatgcaattaaatgcctgtttactacatgtcactgttctcatttgtgtttttaaacaggaattgagtgaaagctctcattgcgattaagcccctggtataatgcattattgaaattaggctgtcagcgcttgtctgtgcaatcttatgtttttactcgtagataaattaggaattcttctgaaaagaatggcatgaaagcattaagataactggagaattcatttaaggacagactgaagagtgatgccaaatggccatttaaatgtccttcagcttttgtgactcacttcttttgatgccataaagaaagtaccttgcatagaactcctagctgagacatcttcaaaaagagttaacatcattcattttggatactcacttctcatccagagaaacttctaaccactcaaagaagacattttaagagtttgaactagatcacctggattaaaaagcccagctctgagccatttccttgtctgtgaaatggagataatgacacctccccaggtgg

SEQ ID NO: 44908 - DNA, 1056 bp, Homo sapiens
gctgtcacacttgcatcttctccaccctagacaggcctttgactcagctaggttaaagaagtaacctgtggttgtttttagagatgatgatgaggtggtaggggaaggagggcacttgaggagtttggtgtatggtcctcttcacacatatgcgtgtttttattctctttgcctttccccgttccctcctatcctcccttcttttctctctaggggtcccgatcattatttcccagcctttgttaatatgtctcggcatcaaccctaagccgtaaagggttgttagtcctgatttgggtagtcctgcaaggtgcagcctatgaacttcttgttcttaaaggtgtaactgcgaatgtcaaataggcacaacctttgccacttccatggttcttctggggtgttacgtcccattttgctgtatcgaatgtgctcatttctaccttctctttcttctctgttaggttgcagataatggaaactatcctaactatttcgagcaggaaggggttgaatatgagaattagatgctcacaggaaggttggaatgaaggttgcaactgaaagtaggggaggggacctggcctgagcctcatgcgttggctcccgggcggcaagcttgatgggcccccagggttgctgctgtcattgccacagcctgggggctgggaatcagaaccaccgctagaactgctaacatcaagggtgcaccttttgggctgtgttccattgatcagagaggctgctgcaaaatgcctctccaccctaggaagctggtgactgaacattgctaccaacaacaaaaacaagaaagcaaatgttttccttagatgctctccactttccttcttacgctactcatctccctgcaagaacactgtgcccagaaccctagctgcaagggactctgggaaatgcagcttataggtttctagcctcaaaggtagagggatgcacacttgaaggagataggagtgaatgttctgtgacaatccatcatgcctaacacatatctaaaatatatttcatccgagatttggctagagtatttatttttaa

SEQ ID NO: 44909 - DNA, 1031 bp, Homo sapiens
aaggagacaggctacagcagaatagggagcttccaggtacccagaaaagtattcttcctttggctgtggaagtagacacctgaatgccagtgtcaagaacatacgtgcagctgatctcaattcagacaatccctttatggaagtggagacatcaaattgcaactcttcattggaagttttaagtaacacaatttccactggagctttacagtcctggaaagtaatgtccatgcctctgggacaaataaggagttgctgcatttactatatgggaattgctccccctgtttaattctctgagccagttttggcactctaaggagtcaacagaggaaatctgctcatttttagtggcagccttaagggaaatagttacatttcagtcactagtagtaaccaagcttaagaaaatatatctgcaaaagctacctgacaatcagaaatggtagctgagaaccaaacacgtattaaggagctttcagaaaaatggagcccacggagtatcttacggcagcccagaatggacagtgttcccaggcctgctctccttggactgtacctgtatgggtgaagactgaaaaatgaacaggcaactccacacagaacctgcacacaaatgtctgtagccactttgttcctaattgccaaaaactggaagcaaccaagatgtccttcaataggtgaatggataaacaaattgtagtatatccttacaatggaatattatttagtgattaaaaagaaatgatttttcaagtcacaaaaagacacggtggaaccctaaatgcatattactaagtaaaagaagccagtctgaaaaagcctaaatgctgtgtgattccagctaattgacatatgcaaaggcaaaactctagagactgtaaaaagatcagtggttgccatgggtcgagtgtgggggtaagagaagaataggttaaacaccagggatttgtagggcaataaaactgggctgggcgcggtggctcacacctgtaatcccagcactttgggaggccaaagtgggtggatca

SEQ ID NO: 44910 - DNA, 1047 bp, Homo sapiens
ctttggagagacaacaggagaataaaagccgaaacatgcgtatatacaaaatgaaatatgaatgtgagcttagaggctacacgtggtctctcggatactagaactatctttcttgccttggaccagctaacgtgccttggttgcgccagtgtactgagccctgtggacatcacctcattaaatattcaataaatgttatttttttcctattgcctttctctcttctatatgagaatctgtaagtattcgccgaaggcttttcttttgcttttgtgaataccttcacaccatgttgtattctgtcttggttagttaaaaaaaaaaaaaaagttggccaggcacagtggcttgcacctgtaatcccagcactttgggaggccgaggcaggcggatcacctgaggttgggagttcgagaccaacctgaccaacatggagaaacccgtctctactaaaaatacaaaattatccggtcatggtggcacgcgcctatgatcccacctactcgggaggctaaggcaagagaattgcttgaacccgtgaggcagaggttgcagtgaaccgagattgcgccactgcactccagcctgggtgactgagggagactctgtctcaaaataaataaataaataaaaggttaattatatttcttgttatgagacaaatgaagtatttcacattttccattgaggatagcatgtaacgcaggtttttctcttataggttgtgggactggaaaatatcttaaagtgaacagccaggtacataccgtgggctgtgactactgtgggccactggtagagattgcccggaatagaggatgtgaagccatggtatgtgacaaccttaatctcccctttagggatgagggcttcgatgccatcatctccataggaggtaaggcagccagatcacacattcaccctttgccatgagaataattgacccggtttagtccgttctcatgactcaacatccgttctgtgtagaaatgtcaatgtaatttattttatctaatttaaaaaaattgtttcaactacttgactgat

SEQ ID NO: 44911 - DNA, 1047 bp, Homo sapiens
atatataagtggagtataaattaaaaattaatttggtttcttctatttcttttttttttttttttttttgagacagagtctcgctctgtcgcccaggctggagtgcactggcgcgatctcggctcactgtaagctccgcctcccgggttcacgccatcctcctgcctcagcctcccaagtagctgggactactggcacccaccacgacgcccggctgtttttttgtatttttaggagagacggggtttcaccgtgttagccaggatggtctcgatctcctgacgtcgtgatccacccgcctcggccccccacagtgctgggattacaggcgtgagccaccgcgcccggcctgttccttttatttcttaattcaggacactaaaccatgactgcaagggatttccttggtaaaaagaaaagattctcagagtcaaaatggtcttacaactcgggcttgacggcctttgaattatgaatggattgttcctctctctgaagcctattgtcacatgggtttttaatcctggccttgctgctagaaatctgtgcttgaagtcctctctttctgctgctagcctaccagttaaaagtcaagacttggtggaactcagtttaccagactctttagcctttgagctaaactgtctgagcaacctcttagatgtgcacacaccactttgtatgaaagggttctctagaacggttctttggagagaaatattttcatgtacgtttgacaggggtgtaaataaagcatgctgactaataagtcttttactcttcatctaatgaacataagaatctatgcatccagatattattttgtatacaaatatttaatttggtgattgataatctctctttggggtagtcacatggaaagctcttttaaatttaacttccgcctttggattttttttaaaaagccattgaagagcaaaactaatgtaaacgtcttgatcatttaaaaagcttgcttgtcctcgaaaggaaacacaggtcatcagtgagtataaacgtagacagttgatttgtgaatgctgtcgg

SEQ ID NO: 44912 - DNA, 1497 bp, Homo sapiens
gtatttgtataccatattccaagagttttagatttaggagttcacgagaaaggtagaagagtgaagaaaaagtagacagttttttttgtggattaccaaagcaaagggcaataaaagatgatgaagaactccatggaaattgtgatgttttatctcctaggacgatccctaggaccacgccaattttcatttgaagggtgtgaaccccaaagtattttaagactgaccttaatcaatttttttttttttgccagtgttaaggatgcactggtgacacagcctctggaggtcctgatggcaggtgcccaaggtggtcagggtacagctggcttttatacattttagagagacataatacattgatcaatacatgtaaggtctacattggtttgatctggaagggtgggacaactcaaagggggaggggcatccaggtcataggtagatttaaaaattttctgattggcaattggttgaaagaattgttattaatagaaaggaatgtggagaccatggttttattagccagatgaagcctccaggtggcagacttcagagagaatagattgtaaatgtttcttatcagacctaaggtctgtgttgatgttaatgctggttggcttttccagaattccaagaagaaggagggtataatgagcatgtctggctcacttttcccatcgtcgcctgaagtggtttttcaggttagctttgggatatgccctcggtggagaagaggggccctttcagatggctggggcagaggtcggagggtgcttacatttttgtttttcgtttacaaggggaaaaaaaaaatctaaaaagtgtacatgtttacagcatctgagtatctccaataataagatgactttaatatgtgaaaacatttgtggatttagtataattaaatctaaattacagcaacatgtttctattaaaattttttctcgaaatatatttttgaaatgaaaaattagggagaacattgttgaggattaaaaaagtttttcttgcaaattagttttatttctcctaagtaggagcacttgatttcactgtatgacagtattacagtgtatgtatattttactgaagaaaagaagagcaaaataagagcttaaatagttgatgttttcaagactgtactttcagggatcatttctatagtttgttaaatacttggtgttctgatactttactcaataagcatgcgtatctctgaaatacaggccattccgtatctggtactcactaagttcacaaactgtgatctcttccaatattggaagggaaacacgctatattggaaagtgtggtcaccaatgtggtattttcctagtgatagcccagggttattttgacagtatgtggtctctttctgtctagctgactttaaaacctgatgcctatgataagatttggcacaatggaacctggaagtgtagcagttgaaagttaatttactattaatataataaatattattgacatatgtac

SEQ ID NO: 44913 - DNA, 1033 bp, Homo sapiens
aaataaatatgatgagtatgggtaagttgtacagattatggagttgtcaagaggcattatattttagtggtcaacttacattcttattacatgttttgttgtcattctgctctcatttattccctaaaacagtgttcctcagactctctcttttgcttaggccctttcctgtaactggaagattgttttctatttttaatcgttaggttagggtgggtctggacaatagatattatttagtaaagcattcagctgcctcttcaccccttgagagtaatttataagttggtaatttttctgataactgtctcacaaagcttacttttagggttttgacccatagttgcttccatgagagctagcttttatttgatagctaacattttttcattttcttttgagaatttgagagaaattttctctacagagaaatggatcaatgaaacattattttaagctagatgttactctttatgttcaaatgggtttttatccaggtgtaaatcacttggaaaacatttagagcaatcagccagttagaacctaataaacatattcaactttatactttcaattataaggagtgtctcctgctgtgaaactaactattctagtgttattgtattttaaggttattttgaaggagaatagagagtttaactttggggtggttctttttctgctgtgcttcatttttatttcttgaagtatttagaaaatttttatactgactataaacttatccgtagcaattaatggtttaaaaaatattattagattgtcatgtaaaatgcacattttatgggacattatgaactgaataattttgcgatagatgtattttttttgcatataaacctatactactttatgtttggaattaataggaattaaagtggattttgtgtacttgatttttaacactttgttttaaaaggactaagactgctttgtcatgtagccaatgtgttgtattaagattcctcagtgagaattatttgattttattttgcaatgatattcaaatatattt

SEQ ID NO: 44914 - DNA, 1015 bp, Homo sapiens
aatatgatatgtaacacttctcctttttagaagacctacaaccttctctttgttcttcagacatactgaagaccactcagtctgtatatacctcaaattgcaattcttgcttcccaaatcaaatcttacatttagagatctgtctgtacatttttattttgatttcaacaacatgtaaagatacatgtagctaggtgaccatgaagttgatcaatatgactggaatacaaatgagaatgaaaggagaggctagtaaaaattaccccatggcaataagaataaactagaactgttctaaacaaatctaatgcaaacagggtgagattttatgtcgtcaaaatgaaattaaatagtatactttagaaatctttttaaagccatgtaagacattaaacatttaatatttgatcacagtgattatagaattcagaattatgttcaattcttttttggtttaagttcatagtcattttgtaataaaatgcggaactaataaaactcactttagatttgaaagctagagctagcgcagagaagattgacggtgatggtaaaagtgaaaatcctgctacatgaggattactggaagtaatttgccaagtttagcttggaaaatgaaaaataataggcttattattgttccctttgaattataaaaatgtgttctatggttaaggctttttctttgtagctccagagagcaaaactagatcccgtggatggtaaatatatgcattcaatgtaagaaagaagaattttgaaatatcattgttttgaagtgcaattggctgcttagtgggatagcaggatagcaagctaatttgtactggaagtgttcacctttagtgctcagctgtcaagactgtacatgccatattttgtgggaggtttaattaaatttaattaaaatggattttttttcttaagcaagtattggaagagtacattaaaagaagtataagccatttatgtatatcctaaaaccagaaaaaaaccacaaacccttattttatta

SEQ ID NO: 44915 - DNA, 1034 bp, Homo sapiens
tgtctgattattttgttttttgtacatcatttataaccattatcatcttacaaataagcatacagccttagacaacttaagtaatatagtcagtgtcctaccaaaagtgagttaatggttgagccaagccatgaacaaaattctgattctagaacttcttttggaaaagttcgaaataagtataaattctcactatccctagtgaggatagagtaggaaagaacggatcaacttcagcttaacttaatgtagacttgatctttttggtaggcgtagatttcactttataatgtttgtctgtaatttcataatgcttctctgaaaattccatttaaatttggagttaggccccactctattaatattctgttaaaagcatctgacttagtatttaggaggtcacaaattgtattgtaacagaggtgatagatgacatttatggatattttaaaattatcttagataattccaatgtacagcctgctaatgctttacacaggagtttctgattggacttttcactctgctctggtttcaggcctttatgtctttaagtctttaattttgcagatgaggaattccagagtatctccagagaagttttatagccagttaatggcaaagacagtttatggcaaagtcaaacccaggcttcttcttatacaaaacccaagctttaggccatcatgcctagtgagagacgtcatgagtgaacattagcttttgttttctttctcctccggcttctaactttcttctctctcccagcatctaagaaaataaattctttcttgccaattcccccattaacatttaatttttgttttgaattttatttactatttttagaggttctagaatagaaggaatttccctgaacaccactctgccatgttgctctatgtgggggattcttcaaagtatttataaatatttatttttatttatttatttattattattattggtttttgtttgtttgttgcttttctgagacagggttttgctctgttgcccaggctggagtgctgtgg

SEQ ID NO: 44916 - DNA, 1033 bp, Homo sapiens
gcaagtattttgatcctttaagttcttgattataagatttgttaggcaggattggagcaacattcagtgtagggataattattccctactattgccagagcatctgaatactctacataatgtcttatgagatttttcaatttggctggtgggaacaggcactattactggtcctctgtgagtgctggatactactcttatgaatcaggttcgctgcacactagttatcaacttgagtttggtgagatggaatgtctttttatgcaacaagttacataagacagattcatgacttacaggcaggcagcaaaggaccacagaagcctaggattcattgctggttgcccacggctcacggaaacttcatgggacagatggagttttgactggatgcgcgtcatcttcactgcaattgagggaccctggaaagttgtctaccctaggttttatacttcggggcaatatgatactctgggctaaagctctgaaggacatcctgtttctaagggggactggaacagaacttgggctattcccaccagtccctccctttctcagaatattgcattcccatcactttgttattctcaaactgcaagtgagaaaaatacggaaagctgggctcttaaggccgtttggagaactgtcctgtagttctcattatactttcagatagatacttttcccagcctctggtaatttctttacacataggatttgatcagcactcagctgaatattcaaggggaatctctagatttccaggcttctctttgtgtaaatctttcctctttagtactctgccctgtgattctaggtgccttggttacctggactttccgctctgtttccatagctcaggagtcagctggtctctgcctgtactctccctctctgtgctgtaggcttgaatctctcaagggagtagggtggaacagacatagggctcactttgttccctgtctcttaggcatcagcgtcttttatatcctgatgaccagcgtcctgaaaactgttacatatgttttgtttc

SEQ ID NO: 44917 - DNA, 1024 bp, Homo sapiens
gtcataaaatgtttgcctatgccagtgtccaaaaggatatttcttaggttttcatctagggtttttatagttttaggtatttttaagtctttaatccatcttgagttaattttgtatatatggaaagctagggatcgagtttcattcttttgcatatggctagccagttactccagcaccatttattgaataggtgtttattccccattgtttgtgtagactttgtcaaagatcaggtggttgtagatgtgtaactttacttctgggtcgtctattgtgttccattggtctgcatgtctatttttgtaccaataccatgctgttttggttactgttgctttgtagtatagtttgatgttgggtaatatccctccagctttgttatttttgcttaggattaccttggctatttgttctctgtttgggttccacatgaattttagaatagcttttttttttctagttctgtgaaaaatcatgataaattgagaggaatagtactgaacccgtagattgctttgggcagaatggcgattttaatgatagtgagccttccaatccatgagcatgggttggttttccatttatttgtgtcatctatgatttatttcagcagtgttttgtagttgtccttatagagatctttcacctctttggttacatgtgtgcctaggtaatttgtgtgtgtatgtgtgtgtgtatgtttgtggcagttgtgaataagaatgtgttcttgatttggttcttgacttgaacgttattggtgttttagaaatgctactaattttcatagattgattcctgaaactttactgaaatcgtttataaagccttttggtagagtatttagggttttctagatacagaatcatatagtctgcaaagagagatactttgacttattcttttcctatttggatgtcttctgtttctttttcttgccttgttgctctcatgaagacttccagtactatgctgaatagtagtagagagtggacatccttgtcttgttccagttctcagg

SEQ ID NO: 44918 - DNA, 1099 bp, Homo sapiens
ggtatattttcagcctggcagcccaagaggcttgagttctcctgacctggtgggtctcccgccagtgtctgcaccaggagcaggcccaaccggctaagcttgtcgtaagccttctgcacctagatcactgttctaggcatttgatgccttgggactccctggggaagaagctgcagctggctgtcaggctgcgttcctcccggactggtcttatgaaaggagggatgcccagctctgatgtcagcacatgagcccatgccacagtcttctctgtgttctgagattgagggctgcttccccactcaagctaaggccacagatctgcagcttggtatccctgggtggtgtggtcaagtcctggggagttgggaccagatccaggggtttgttctctagcccctggatgtaaagcagcagctgtgctgcaggagagcagactgctcctagacctccagcaaaacactcagatggggcaatggaggctgtgctgtgggcacacttctgcaagatcgttcaggcaggcaggcttaggaggggccacggggttacatggatcagatgcaccccagtcctgtggcaatggtggccctgctctcttgcagcctagcagacagcagtagctacagccactcagtacagcatggcacacctcggggcgtgaacacctttggtcacattttgctggagctgcactgcgtagtgaaacatttgggggtgcatgcaagtttgagctgtgcttctgcctattctctgagtggcttccctgccggttcagaggtctttgggggtcttgggaaacctgtagctgggatcccagaggtatgtggtgggagtgtgctgccgaaattccttcactcaccgcttcctcaggtctggttcagtacaggaggccggtcctagtgcccagcgactctgagtggcttcctggcttcctccctctttaatcacagtgtccatctcttctctattgacttgatgctttctcacaaaatctttattcagagtgtgatggtttatttgatattttggttcctcttggtggacagttcccggctgtttctagacatcttgaagattttaaaaattcttaaacagttgg

SEQ ID NO: 44919 - DNA, 1050 bp, Homo sapiens
atccaaatacatttcaactccaaataatctctgggtccagaaagccagttgcactgactcagaaaaaagtttatcatgcttttccaccagacagactcacacttcaagtcatttatttaattcaattcaatgaataactacggtatgcttttccctctgtgtagctctgggggtgtaacagtattctgggctgaattcctgtatttgtgaagttcataatttattcagggctgcaggtgattctacagttaatttctgatagaatatgagactagctataatcataatataagcaaagtgctgtgtgaacagagtaagtaggagtgaaagagccttttccttaggctggatattgtaggaaaaaaattaaatttcttcagttaatggacaagtggaaaataggacagaatgaagaaaggccatatgccttgttgagggaacagagagtaatttgatgtggttagtgcctgtgagtgttgagaaatgaggctagaaagataatttgttactagattatgagggaccttgaaagctttgtggtaatttgctcctaatcatctgagcagtaggaaatcatggaatgatttgaagaaagagtggtgttgggtacctaagaaactgtttgtttaaagagacagatgtctctttcagtgtttgtctgaaaaagaatgtttgttgtcccttttctggtcctttcactagagggaatggctggagcttttttttttttttttttgctttgcctgttggtgtttctgggttgcccacttctccagtatcatccagtccaggatatgtgaagtgaaaatcattgtgttagtccggaggtccctattctgtgtgctttcttctctctacctttcagaatcttcttatgtttgttttatatgtgatgtccagggtgtttggcagtatttaactagagggacaaacacaagtacatccatcttgtctggaattagaaatcttaaatggactttaaaaaaatgttacagaagtaaaatgtacaaatagcgtaatacacagatcttaaatgcctattttaataag

SEQ ID NO: 44920 - DNA, 1047 bp, Homo sapiens
catttctcatataccttgattcacactgatagtttaccgattaaatataaagatgaattttgttcatctgtagccttcaaatagcaagcttaaagaaatataaaattacctcaaaatttaagtctcattgggcagcctcaaccagtaacactcattattagttaaacccagtctgaaggcctgcaaagcaaagccatggtactgtcaaccatgttatataggcctaatgtctgaatccttaccagtgccatttttatttcttagacacgtttcatttatcatactgttgtgctatatttcacatcagatgtcaagataaagtctctgatgtcaaagatttagaagcagtgactttccagatttgctcatcagaatgcagtggtcctggacatacagagcaaatggatgacattagatttctaaagctgctggcattaggtgaactttaggggaaatgtcattcttgagaccatataagagaagtttcaagaatgtaaattaaagctatctgaagtactggacattttagcatgatataatggcactaagagattttgcttatattgcgattgaggcagtgaccacaaataaatacaaatccagataatgatcgaagggcaatataacaaatatgttaaaaggttccttattaaagagtaattccctggccacccagggttcttgtcatccatgttcatgtgctgacagaattatgaaagcattttcatgtgaatactgaagagtattatggacattcgtattcataggtacatcaaaaaaagaaaatgtaagagatagactatgcttcgaagaagacaatgattcttacctattttttgtttaaacacatgttatagactttgcttgataataacatctttttttatctcctaatcaccccataagtaagaaaaaatgatctgtacttagaaaatgaattacagagtggttacatagctttcctggggaaatcattcaatttattagcaaatctggattagggcacagagaacctgttcctaattcatttcttagacaatcacaagt

SEQ ID NO: 44921 - DNA, 1035 bp, Homo sapiens
agctttaatgaaaacgaaggaatgaagttgagaagaacaagattacaaatcgcgtttatattgcaggagaacgaaaagatacctttctgaaactcattgaacaccactgaccatcttcttcctgtgtctgtctccattctcaacatttttatttctcccacccttgatgatgcatgcttggatacatacgtgaaattgggcacatctgcagcccatttcttgcttacatttacttacttgcctgtatgctttatggtttcaaaattaagaaactactgtgaggagtacttgtttggctctagtttgtctcatagactggaactggaaatacaaattttgttgtatttttcaacaaatgctcagtttctgcacacctgctttaatatggtaagagattaatgctttctgcacatcagaggtgccttcggtgagaaaaggaagtctttgtgtatatgtttatagacatatctactcctctctattaaaaaataagggcaaagctgtatttactctcgacttactatttaaagatattcaggaagcaaaacatgttaacattaaagcaaatggatagaaacataaagcatttgttgcaggtaagtttttaactcatttatttaaatattatagcttctttttgtttttttttttttcctaacttgtttcaatccatgatgtagcatcttagcagtatactttatctggataaagtgatgactatcgaaacacatcaggaataccgagctgaaggatgaaaagctgtgttgagatcatccttttattgtatggcaggaattctccaaggtttaatttcatggatcattgacatcaagctgagatttaggattcaaataaatttcacaagcagtgtgaatgttttcatatagatcttagcagtgatacataaaagaattaaaagtctgtattctctttatgctaatagtcattatttgttgcttcatttttcctgtgttttttattttagacatatctattactaagaaagagaaaaattcttttaaaatggtggactca

SEQ ID NO: 44922 - DNA, 1025 bp, Homo sapiens
gtagagcaaaggaagcaggagtcgctggcagtcgttctggctgctggcaatggttcatcctccagcatgaacctaagtaagggaatggagagtgactcagctgctgttttagaggaagaagaaacaaaattgataataaatgtcacaagtaaggttcaagaacaggaatcagagatgattctgaagttcagctatgtgttgtaggatagaaatatggaggagaacaaggtttggagggcaatgtttagcccaaaaaagttcctaagattgattaggcctcataattggttgatgagaaagggattaatttgtttaaattgcttaagatcataaagccaatcagttgaagagtcaagaacttaaaacttttaacccattgtttttctacttagtaatattttgccaataaatcaaaacctctgtggtgaataggccagtaatgttctcaccaaattatatattgtgtttatttgttgtaaatatctgaaaagatcatcataataaagatacagtggatatgttgatttattttttatttttattttttgagacggagtctcacttcttggtcgcccaggctggagtgcagtggcgtgatctccgctcactgcaagctctgccttccgggttcacgccattctcctgcctcagcctcccaagtagctgggactacaggtgcacgctgccacacccggctaatgggttttttttttttgtttttttggtttttttttgtatttttagtagagacggggtttcactgtgttagccaggatggtctcgatctcctgacctcgtgatccgcccaccttggcctcccaaagtgctgggattacaggcatgagccaccacgcccggcgatatttctttagttattctatcgtatttttgtacagaagacaatatcctctagcagtataaaaacaaatgtgtgtggggatatgtaaacataaatacacacatacacgcaggtgcatgtgctttgtgctgagatacaagagtcacaaaacctgacaagatgtctg

SEQ ID NO: 44923 - DNA, 1050 bp, Homo sapiens
tatttttttaactcatataatttgaaaaatgctatattgttactgcatttgctcccaacaaaaatagtaaattataaaaatgatttaaagcagcgtgaaacataagtgatataaaggtaaattcatagacatctttaaaatggcaattttgtgagttattgcaaacttatttgtaaaatctggaatatgtttatggagtagtaaaatgtatttgaatgctctgtgctttatgaagaagatttttattcttagcctaaagatatttcatgctgaaactgggctagcaattatgttctttgcccaatgcttgttatcattttcatctaatcctgatatcatcttacttcattacttttgtgcttttttgctttgcatctttcactctttagttttgtgactttgagcaagttgtttaaacttctctgggcttcagtttccttgtttgtaaacagatggtaatgtctacatcagagagttattggtactgggtaagatagtgaataaaacaaagttcttgcccttttggagctaaaattgtagtgctggaacaaagacaataagtacattgtaaaacgtatacaatctgaaatttctttcaaaaacaattttataataaaaaaaaatcagagtaaaggtgagaggaggcttctctgacaagattgaatttgaacagagacccagtggaagtgagggagtaaattacatggccatcccagggaaaagtacctcaggcagtgggaataacaagttcaaagatctccttattacctgacttgctttgaaggtattaggagaaaaggctagaaacctagaaggaggatttaatttctaaagcaggaaacaaccaccaaaactcataaaggaaaagatgcataaatttggccacattaaaattaaagttttctacatgacagaataatttaaaatacaaatataaaggagaatctgaacgcaatacttcagtcaattcgtatctggaaaaaaaaatgttgtcctccaagttaagaaaaagcaactgtgcttttggaaaaacgggaggaaaaaaaaaga

SEQ ID NO: 44924 - DNA, 1054 bp, Homo sapiens
aaattgaagtttcaggttataaatttttaaagttaaggcatatttgctcacaaagaatggtaattttatgttatataaaggtaattgattgtatttacctctgtgtgcatttgtagtttaaccattctggaacattgtgttcagagccagaaaaattaatagattttattcacatctatgtctacggcttccttgacaactactgcagatgccgctatcaccatggggatggttcttctaaatgaagcagcaacttcgaaaggcgatgttggaaaaagacggagtaagtctctgtgttgccatttttgtaatttcgttttagtcttaagattcatttaagtcaaatgggaaatacataaaagccctttgtaaacaaacttctaaagaaatgttctggtttgaagaagattttaacttttttctattgctgggatgtgttcatatacttgaaaatatatttcttccaaaggggactgggtcgttttctgttgatttgcttataaagtggagctgtccttcacccttgtcagggtgctctaatccatccctgctgaagccatagtcttggttgtaattccacccggcacagagagatggaaaattttgagggcagagtcttcagagattttattggcatgtaacatattccctctgctacaagaatcaggggtgcgctcaaagcgtgacttagatgaagcttctgcataggtattgtacagtgagatactcttattacctttctattcgttccaaagcttcctttaacattttttaaaaggcatctattgatactatcttttccagggtctttgccttttccattgatataccaagatttacaactccctcaagttctccggcattatgtttttaagcaagttaattctgtggcttttctttgatgggaccatttctctcagagttgtagaaaaacatatatgaggtttttgagaagtaaagagttttctagcaaaaagagaagaacacacagggaaaatgtgctctgaggagcaaaggacagtcgattgtttcctgccacagacctttttatagt

SEQ ID NO: 44925 - DNA, 1050 bp, Homo sapiens
ttcctggcctttagtacttctgcaaagacatttgtagatgtccattttctaagaacattaggctgtacaatagtaaatcataaactctagggaccaagagctgaaccactccaaccatccaagacagaaataaatacattgaagtaggctgacaagaggagaaaaatagtttctcaaccaagactctatccttgacttccccaattttaacatgaatacatgttgcagagatcaactgctagtacagacacacattcttcttcacagtagctcttggaaagcttcctacttctactttggatcatacctgtacttgggataagacacttaagttaccctttagtgaaaatgcacatttgaacataacaccttctactttttttccttttcttaagaaaagcacctttagtaatggcctttaggctccaatgccaaagtacttgcttgggtgttatgcctccgccttttagccctcagtgtcttcgttttgcatttttgtgaattataaactgttgtaccactgatatacaggactgtatccataattatctttatgtacagaaccgtgatcataattgtctttaaactaattttttttacattttttcctcacaattttgaattttatttaaaatacagtccttaagttcttctatctgaagtgatcctgttcggcttattcatttttattttaatcttaagccttacaaaaccttaaacatctatgcccttcatcatattttttcagtacttcatagtactttcaaaattgttgttttctttgctgacacaggtacctgctaaaggataaaaatctactttaaatatttatcctatagtcttaaatcttcccctaaagtttacccttaacagtttacgtatgaatctgtctcatgccattactaaattctctcagattgtcttttaaatttaataggcaaacttccctgattggaatacccagcctgctcgttactagctgtgtgaccttgggcaagttacttaacttttgtcaagctaagttctcatttataaatggagatgatttgt

SEQ ID NO: 44926 - DNA, 1076 bp, Homo sapiens
accgcaaaagtgaaaagcacacatcaggggaatacattcagttttcattattgacagttgtttttaaaaaagtatgatacgaaggcatttatacatttttgtgataggcattattagaaaaaacaatatccaggcactcctgaaccataagtttgtgagaactattatactgttagattaagaagcaaaagtatttattagacagataaatgtgaaaagggaaaaaaatacgtgtcagatcttgtttagaaatgagagactaattccttgagtgataatatcaatataaaacattcatactggaacatactttggaaatttaatatttataatttaatatttatataatgaaaataaaagtgaaacctgaaatactgattagagaacagcagttcatacttttctcagaaacgttttaaccagtcaaaacatttttgacatttttgtgcttcaagtgtttccagtgtcttgaacaaataaagaaatttttataactatttaaaatgaaaatgatagttttgaaaatgatagaagcataggaagtactctaattgtcctacaataaaggatacatctaactaacaagtaatcagtttcagattaaatatatatttatcatttcataatgatataaacaactgattgttacaccaggttaagaaaattactaaatgaaaaaaacagtagcataactaaagataacattaataaagtactcacagagatccttttactgtgaatatacctaagtatcataaaactgctaaaaagttagaaggtataaaattaccagtatggatcagattagtatttttgcttttacaggggtaatatcgttagcagcaataaagattacctttagtgctccgtaacttgaaatctgcagagcctttaaacactaaacaacaaaaagctacaaatccctagttttaagtatcagttcattttatgattaaggtttcttttttcattaaccctcattcttcagttagcttcatcttcagagcaagctgatgatggcttgtgtgtgctagcaggatgaacgctatcttttcaaaacataatgccacagttca

SEQ ID NO: 44927 - DNA, 1012 bp, Homo sapiens
gggagctgagcgtggcggcggcggccggcggggggctggtcggcctggtatgctaccagctgtacggggaccccagggccggctcgccggcgaccgggcgaccctcaaagagcgcggccacggagcccgaggacccgccccgcggccgggggatgctgcccatcccagtggcggctgccaaggagacggtgagtgcgcgagcgcgcgtcacacctgcgcgggggatgtgaccttcgtgccgggtacgcaggaccctggaggctgtggggacggtgcaagcgctgtggccgcgggtgaggaacttcccgtgagcgaggctgacacctaggccggacagcctaggatccggtcacccacgtattgggaagaccagtgatgctgtccctgatgcatcaggaccttaaaggtggctgcagctaccaagtatcaatccaaacccaaaaccaacacccctccccctcttacaaaaaaagattcagaaatgaaggccatgacaggcagaaagtggaccgctgtaggtgtgggaaaaaggaactcctagattgcgcggggcgacagctaatgacccaggaggtctgttgcattagaatgagtttcgaagcagcggtctgagatctcaaaagccactactttagcatatgagaatttattagtcccaagaaaggaaatgctaaacctgcatgctaacgcccttatcatacccagggaatgttgatgttaccaggtctgaaaagaaataaaaaattgttcaaaaagagacataagtatttctctctttttccttcccccactaaagccagaatcccgttagtaggtaacgataaaacacaaaatggataggatagcaaatgtaggaggctgtgaatgacacaaactcctacagaagaaagtcacgtgaaaatgttcaactgtcattatgtagttaataatacaaggtaaagatgtgtgaaaggcaacagtgagtaaaggagcgtgattttttttgtcgcatcagtatatttaatagtcatgt

SEQ ID NO: 44928 - DNA, 1051 bp, Homo sapiens
ctcctgtaatgttttgagaagtcttagtcttcagaatgatggaaaagattaatcatttgcctggcttttcgtttaataagatgtaacttagaaataaagtagtattcttgccaaaagtttctttgggttgtttttgttatggcttctcaaggtactaaatatttaaacagttttttcttatatgaaatcattttataaaatacgtgaaagtataatttgtgtgttactgataatcatgtaaattgctataaactccatgaagacagtttgactaaaaagtcttctttgactaatcagtttcactcctaaggattaagggaggctaggcaggagagtcgcttgaacctgggaggtggaggttgcagtgagctgagatcatgccactgtactccagcctgggtgacagagtgagactctgtctaaaaaaaaaaaaaagaacttatcctgaagaactgttatggatatttctgaatattttcaaggttggtcattataccattgttttgtaatagcaaaagattagaagtcaacatgaataaccaagtagaattgtttatgttatactataaacattttctatggaatattatacagttaacaaaaatggtcttctacaggaatagtgacacaggaaaatggccccgaagttttagtaagtaaaaaggtcagattactgaatgatatatatggtataatcccattttctttgccaaaagaaagcaaaaacaattctatctataaatttttagattctgtcttctaattttatacggtaactactagaatatttagtgacatagaaaaatggccctgataattgataagtgaaaaagatcaggttattgaagcatgtatggtaaaatcccacttttttgccaaaaagaaaacaaaattatacttaacaaattttttacaattctgtcttctaaattacatgtaagagctttgcatttctcttgtaatcaggaaaataaatccttttattaaaaaaaattgctctagttacttcagagagaaaataacaatggaatattatctacaaggaaaggtc

SEQ ID NO: 44929 - DNA, 1054 bp, Homo sapiens
tgtgtccccactcataatccctcaatgtccttcaaaagataaacacaatcatgacttttatgtaaatcacttacttgctttgttctgtggttttaccacctacttatgcatcctaaacagtgtagtttacccctttttgtactttatgtaactggcatcatgttatatgaatgtttctgtctcgtttcttggacccaacgtcatgattgccagtttcatctatgttgtatgtagtcctagttaattcactttttttgctgttaacagtggctttcaagcattgtggtctgtgatcccattacattgtcgaaagttattgaggatccaaaagatattttgtttacatatgttatgtatttaccatattagaagttaaaactgagaatttaaagatattagtctgttttaaaacaataatttaaaaactcatatgttaacataaacattttaatgtaggaaaaacaacttcaaaaatatagtgagaagagtgatattgttttacatattttgcagatctctttaatgtctagcttactagaagacagctggtttctcgtagctgttttgcattcgatctgttgcaatatgttattttggcaataaatactgtcagttgtttactttcaagtgacaggctctcgcttggttcattttaaaaaaaaaatgtctaccaggtactgaaatctgaataaccatggtttgtctattagttgttctttcaagtaaaagtggtggctcatgaaaaaagtggctagttcagcttgcaacacaaaccatcacacaggtgttctttcttaagacaaccatggtacttcagcatgcagcagtagtgctgtatgcacgcttcctgtttcatcacaccaaatattaaaaagatactcattcttctatgcctcttaatttctccttaacagtttgccgtatttttatcttttcatgctgcattgtgcataattcttcatgtttatcttccggttcattaattctactagagatatataatctgatactaaatttcagcggttaaatttctaagagttttatttgactatta

SEQ ID NO: 44930 - DNA, 1080 bp, Homo sapiens
aatctttattttattctttattgcttatcagagtgagtggatgaaaacatttgtaaggctgcaacataatattaaaatgtgaataaataaatgttctgataaaatagaaaagaaagtaaattacagtgatttccatcatattatcactcttgaattttatcatctataaaatgagagataaaaatatctcactgaattgttacttatatcaatttaaaatttgctagtggtttgaaaataataatgtactgactacatgtatgctgttattgtcagtgtttccttctataaactgttctttggaaaaattaagttatacataaaattcatattaaactttttacagaaagcatacatgataaacagtttatggtacttctcagaatcatttcataataagcaatttatttagcttaagttccaacttactgttcttattataaattgcaaagcaacctgtcttacattcttacattatcttaaaataaatatttctgcccttgaatcaagaaacattgtacttggcttttatatgtatctgtggactaataatgactttctgaaaatgtaaccttcaaactttggaaatctttatgggttactaaacctcttttgattttattccctcttctgtggcaacacatgctaatgacatttatctcatcaacacctttgtgggtaggtaactcacagagctataaggcttctcaaagtaaattgtaggaattcctaaattatagaattatggtcattggtactggaaaacttttcagaaagtttatatgtgacttaatggagtattaattttgtaggtatcatcttactaaggtaacacctagaaatgtttcaaaatacactagttattatcctactacttatagccatatagtaaattaacactttttaaaatataatgcttttacttccaaaagatataaaaatatgaattccataatattcagaaactgtaataaaaattgtaagtgataagaaatcactgtggtttgtaaaaaattggtagcatttttaatttcttagtagttcataaaataatggtacaccttgcaatgttgcatctta

SEQ ID NO: 44931 - DNA, 1020 bp, Homo sapiens
cccacatcagggatagcaatctgctttagtctactgatttaaatgttaaactcctccaaaaacaccctcacagacacacccagaataacatttgtcaagtatctgggcaccaaatggcccagtcaggttgacacatgacgttaaccatcacaacacctttatactataccatttcattcagtgataattatttgagttcagttgtatattctacttacaagtcaagatttatgggtttcattatccaggtcatgcctgcttcttacaattatggtctttcctataatatgcatacctattgttgcttttaagaatggacatttggccaggcgcagtggctcatgcctgtaatcccagcactttgaaaggccagggcaggtggaccacaaggtcaggagtttgagaccagcctggccaagatggtgaaaccccatccctactagaaataccaaaattagccaggtgtgatggtgggcaggagtagtcccgctactcgggaggctgaggcaggagaattgcttgaacctgggaggtggaacttgtagtgagctgagattgcgccactgcactccagcctgggcagcagagcaagactgtctcaaaaaaaaaaaaaatggacatttttccgttagattttctatctgatttttgttggtatacagagaagcaactgattttatttgttcagcacttaactgaactcttggtagtactgaaagtttttcaattgattctcttaggttttctggtgggcagtcatattacatgcaaactaaggcaaatgtgtctttgccctatctacattattgcttctatttctatcttctgtattattgcattgatcatagcctccagaagagtgtaaaatactaatagaggcagcagaaatctttcgaattcccattttaataggatgatctctgtaattgttcaaattaacattttgctgttgatcagaagaaagtatcctttatttcctgaatttggaagaaaaaggattgagtgttgaatcatctcaaa

SEQ ID NO: 44932 - DNA, 1055 bp, Homo sapiens
tttgttgcgtttaactggagttgggatgctcattaagtgcctcatgttcgaaccgagttaaacaaatgttccaaaacaatagttccgttgttgctgtattatttatctattgcggcattgcaaattaccccaaattgcagctgcctaagaaaacaaacattatttcccacagtttctgagtcagtcaggagcagctttgctgggtgagtctaactcaaggtctctcctgagggtgcagtcaagctgttggctcgcactacaggcatcagaaggaatgactgcagctggaggactgacttccagaacactcactcacatggcgacccccatcctctgctacatggccctctcgatggggctgctcatgacaacagggcagctaacttctcacggctcaagtgatgtgaggctgaggaggaagccgtggtgtctttttttgaaccagtctttgaaatttcccactattaattctgctttattttattcattagaagtgagtcactaagtgctatggtctgaatgtttgtgttctgccaaaattcatatgtgggaaccctaacccctaggtgatggcagcgtttaggggtggagcctgtgttagtccattttcacgctgctgataaagacatacataagatggataatttatagagaaaaagagatttaatggactcacagttccacgtggctggagaggcctcacaatcatagcagaaggcaaaaggcacatcttacatgatagcaggcaaagagagagtgagagccaagtgaaaggggtttccccttataaagtcatcagatctcgtgggacttattcatgaccacaagaacagtatggggaaaccgtccccatgattcaattatctcccactgggcccctcccacaacacgtgggaattatgggagctataattcaagatgagatttgggtggggacacagctgaaccatatcagagccttgggaagtgattaggtcctgaggatgaagccctcatgaaagaaattagcacccttataaaagaggccccagcaagcgcgttggccacttctacta

SEQ ID NO: 44933 - DNA, 1080 bp, Homo sapiens
tgctcccccagcctggtaacagcgggtccagtgttccagcctgggcagtgtccagctggcagggctgaggtggttgcgcccacatctcaggctgcatggtccagcgagctcaggtgtttgatcttttttcgttaccatggtgagaagtgtgctagcggggaaaaaagacaaatgtatcccatagatgagtatatatgggggcgaggggttctccatgaaatggtcctcattgatttttttgtttcatttgtttttatgttttatcttgatggagaatttgtgattttccttctcagaaaaatagagctatacttacatttcataatttatactgctgatttatgccactgcgttttgacagttgtatcatatcacccagccttctcttctccaggaagtggtgtattcatgggtcccctgagattccagcactgcttatgatgagtgtagaaattctgtcttgtctgtcttgcagaatgacagattagaatatggcatagattcttaatgctgtctgttgggaaaacaatattctaaagatgattagaaagacagttttaatattatgtggaattctgttattacatattaccatttagaaatactacagagaatttataatgaaagcataaaataattgaatgaggtttttaatagtccattagaaaattgttgaaaattttttcctaattcctttaagggaattttattataattgtcttgattgttgtttcaatcaaatggcagtagtgaaaagggcgaaattatcaaggcagggggtaggaggaggaggcgctgggtaggatgctctgatttcttaagaagaataggatagctgtaaagaaaccagacatgattgcttgagaattttcctttcaaaatgataatatcacactttatatcatttatgtagcatttttcctaatttgactttttatctggccatgacttttaaattcagttataaatattaattgcctgaagtgttataaaatccatttttatttgagagatactcacaagcaaaattatatgctgcatttctcgtcttagcacttcactctgaagtgcatacttaat

SEQ ID NO: 44934 - DNA, 1057 bp, Homo sapiens
caaactgataaagaggagtgggtgggaaggaggggaagtatgccgtgaatgcatcgtgaatacatgtgagtgcatggtgtcaatcatgaactcgattctgatccgcagcacagggactgaacatgatttataaatgaagagcaaggtttctgttttgcccaaagatccagagtaagtgaaatgattttagtaagagaaagcataaatccatacataaaatgaggggagagatacaggcgggaaacctgagatgcagtttacacatggagcagaggaagagactcattccaaatattgatgactggattcttcaattccttgcataatttttttttagaacttctcacttacattaatgaatacatctagtatataaacaggtggtacttgtataatattacactattacaatatgttgtgtctttaggcagtagtcatggaaatctttcaactgtgggtggccagataatgacaatgtcagatttattttggttgtgactgaatacacatactgtttcagcaattgctgtcagagagattgggctagtgctgtaggtgaatgcagtgttgggcgagagtatgatttgctgcaagtaagaagagaaaggcattgtataattccagctgggatcaagaaagattgtgtatgtttactttatgaatatatgacagtgaagttacagaagaaaatagtgcttctcagtgacccaatactgaagggtgagctagtgaatagctggatactctcgaatgttttaatagatattgtgacccagtgctatcgtgcagcaattactgctggtgctagtgttggtttaaatatttgatttcatctcttccggtgtgccactgtaaattttattccaatgagctcataaacacaaatgtaggaattacatccttatatagtttctttctctggagagttgtaaagtactcataagtgtcaaataattttatgaacctagaaataattggattaatttttaaatgtgttacgtgtgcctgtactctggtcatatagtactcaacatatagctgctaaccctgctagatg

SEQ ID NO: 44935 - DNA, 1029 bp, Homo sapiens
aacttatagaccctgtctgtcttcaaagttgcttgaagcccagttgaagccagtatctccctcagctttttcctttttaaaggaacaggaaccattttgtcttctccctctctcctctctttagagaagtgttttcttcacctcacagaagagattactttcgcttttttcaactatcagttgagtgctatggtgtgctaagctaacatggtaatagaaataacttttctcttgagtttttcatgcccacaaaagaaaaatgaatacttctcatatgtccgctttgatataccagttttatgtgattcaaattagttgtcatggtctgtttgtctaagtcagtctcttactcagtaaacattaatggggcagatgctctatgccagttcttgtgctttaatgaggaattaattttaatatgatccagcagagctggaagttgtaacgtttttgttacaggcaggaaatgtttaaattgaaaataaaagaatttctaaggtagaattaatgtgctattcgtcgtgactttgagaataaagctcatttgctttagtaaaaactgagtaaacctcagttttctgttgacaaaaattgaaataactattaatttatctcaataactggtttaaaggaaatgagataaagaaggctatacaacacttgaaatttctctatggtaaaaattgaagaataggtatcagcatcattgttaaatcaaacaaattgaaattctgtctgtgaagtaagaaaattaaataatcctggattaaaactcaaaatccacattaaaaccaatagttatttttagaagacctgtcccaattatgttcagtattgctatttagtttttgtattgttataaataatcaaattatatttgattaccatctatattgtttcaaaaatgagtctctatttttcatatgttatctttatatacataaatattagaaaagtgtttgaggctaaatttgagcaatcttttcttgaacagttacttttgaacaaaaatatttgcatttgacaata

SEQ ID NO: 44936 - DNA, 1027 bp, Homo sapiens
gcccttttgaaaagctgaataaggacaaaaatatacaaagtcagacttgctacagctgagatagggcaaaacttccaaagactctagtacaaagagagagaccaaatgggaaaacaaatagacaatacaaaaggcgtacatatgtcttgattactaaatacaacttcttgccgcagcttgctttagtgcttgtggcccctgtcctcatctataatacctgctagcttggaatatttacaacagccgctgaggagtggcagtttcccagcactgcctggcctttcgttgtgcaacagggagcaagtaaagtcactgtgcataagcatttgtacttttagaaattagggggaaaaaaagtgtgtgctgtggacacattttattctttgtggaaagctcaccaggtggttgccagtttatcaagagcaataaatgcctgcggaaatgtaatgacctggagagcattgcttttatctgaactctatagttggaaggaaaaccagtcaaccaaatgatacagaaataagacccgcaaggggcacacttgacaagttttgttccgcaggacaggagccagggctgaagtgcgcaatggaggcatggctgactgcagcctccagccgtttcctgcaccctctccacactgtgctcacctctcctccaaataaagttgaataaatatttagagaatgttggtttgaagggaagccacattattaagctacttaaatgccttatgtctgtgtcaagccccgtttgccataagcttcatgtaacctattacctttttttctctttacagtgtccatggaaaacactggcgaacaaggtaagctagattatattaatgttatagattttttaaatagtttgaaaaaaaattgtattcacttagatttggttgggattaataaattgttgtttgagaatgtggagacaagctagggttaaagatgtctcatttctcttaagtttgcagattgaattctgtcagacccttggcaaagaattctatcctgaaatggctgtc

SEQ ID NO: 44937 - DNA, 1059 bp, Homo sapiens
ttccacagttccatctctcttatgcagagaaagatttgttggagagagagccaagaggagaagcccatcaggaagttcttaggcgagcagccaaggatcttcccatctataccaggaccatgtctggaggtaaatgttgataatgagtgctttgcaatggtatgcaaataacatcattaaggtgactgtaagaaagtgtgtttatgtacttgaaatggtaaaacactcatttcagaatgctgtgttatttcttggattgctgttaaatctttcctgtgtgattccataaaacagaatggaaacacgaatagcactgtggcacagagatcgcaaggaaatcagaactgactttaatcctgttctgcctacttagttatgactcagtgaagatgtgggaactgctgaaatcttgatttatggtagtactcatgtttaaggttttaattgtagactttcctatttatatttaatttaaggcagcagtatctgtaatgaatataaaatgaatacttttacatgtattttttcgtaaacttagaacagtcatataggtgatgtaaaatttcatttaggtattggtataattttttatctatctttaaaattttcttacaaatgcaataaattaacaaatctcttacttgggacatattttaaggtaatttgacaactatccacttaaacagttgtcttaaaactgatgtatatggactagtgatgcttacccaccaagacttgcccagagcttctgtgacttcagacctgtgctgtccattatggtagccgctagccccatgtggctgttgagcgcttgaagtatggccagttcaaactgacatgtgctctaagtattaaatacacactggtttcaaagacttagtatgaaaaatatatataaaatatctcattaatgaacagacacagtggcttgtgcctataatcccagcaactcgggagcctgaggtggaggattgcttgagcccaggagttagaagttgcagtgagctgtggttgcaccactgcactgccgcctgggtgacagagtgagaccctgtctct

SEQ ID NO: 44938 - DNA, 1113 bp, Homo sapiens
gtgcttatatatgtttaggtatatttaccctgtaaggctaaacaaacactgcagaaatttaagccccctagaaataaatcattgctgagtttccaaagctagttagtgacagtaaaaggtgcaaaaacctggtgtccttattcctagttcagtttaaaactttttttgataaataacagggtacaagaaataaattggtttaattgagggagacattctatttattttgattaacatggacatatttgtaccctttgtgagccttattataactactgacaattgaaaaagcatcagaaaaatttccttaggaggttctctcttctggttaaacctccagagaactgtggctgtaggcaagtcattccatttttgtatttaaacagcatcaaatatcttatttttttaccatatttaaatttcatatgctttttaaaatttaaatttggagagatgataaaagccatttaattgtattttcaattcagtgttaactctaagactaagtggagctttttgtccctagccatccgatactgtgacagatgccaacttataaaaccagatcgctgccatcactgctccgtctgtgataagtaagagaacctttaacttctaaaatatctacatgctggtggtctttttcttcattatgtttcttttctcactgttttcctgattatcttctccatattctcgcttctcagcccttgatttaggaaatggagttggtataacccgctggcattcataccagtgaggcctaaggccacagtcaagtgtcaatttgcccccagattcacggtgccctgaagtatgtgatttttagcagttctgacttggctggttcaatttaggaaatacttctatgagtgttttccatttttataaagagaactcagttgacttcaggacagtcagacgttgttatatatttaatatactccaaggacagtatgacttggcataaggattgatattgaaggggaagttttatccagactttccgtaaatccgttgcagttttgttctttctttagcctaagatagttgtatattaatacattatattgtttttaggaaatgagttgctttgcatcttaagcatgtata

SEQ ID NO: 44939 - DNA, 1048 bp, Homo sapiens
ataagaaaatttactgcaatggtttccacttgaaatgagggaaaaaagaaagtatgattgaggatacattggaagcttcaattatacttgtaaaatggtgttattaatctaagtgtgagtaaaaaggtgttaattgtctatacattttggttgactgaaatattttttaaatgtagtgcttaaaagaaaaaaaaatgtaagtcaaaattagctacccactgctcaggtaggcagacagggtaaaatcgcccctgacccaccatatctttcctttctgtgataactgttagagtaaagaaacttgaggcttttggagatcaaatggacccccagacaccttcttgacaactccattttaatgtatattatggacttagtgcccttggaagacctctaaggattatctgagccatttctgtggagagagaagccagagtcttagaaattcattgtctggagacttttgctccagctttaagtttgttttgattccagactatcaagaatttgaggctggccagagaaagacctgacatttcattctgaacgtgctaccaactggcaaaaggaaaagttacttaaacttttaaaatgctatgtatgaattttcagtggtttgaaacaccagtttttatacctttgtgacagatttgagtataaccattcctctgatttttcaatgaaagccagtagcaaaagcataaccataatatcattcttcattaaacgttagagcttttcttagttgctgcagtgccacatacacagtatccacaccaacactccatattgaacatttcttactgatcacaggactttttcctagggagcctggagtgaccccataaacctcaaggcagtgttcctggtagccattctaaagttctttttgttgttgttgtttgtttgtttgtttgtttccattttagttttgagacagggtctctcttgtcacccaggctggagtgcagtggagtgatcatggctcactgcagccatgaccgcccaggatcaagcgatcctcctgcctctgcccttttaaattggg

SEQ ID NO: 44940 - DNA, 1064 bp, Homo sapiens
ttctactatctcccatgttgagcccagataaaattttcgtggcaagttctgttctcttctttactccagagttgaatatcttgctgtctacttgacacacccacttggacacctaaaaatcatctccaactaaacaggttcagagcagaactttgaatttgattcccagccatgtgtaccctcatcaccaccctaaaccagaatctcctccatgcttccattatcagtattagtgacctccattctcccacgtgttcatgctagaaactgtggggtcatcctggattcctctctttcaattactttgtatttactccatttgcaaatcctatcagatgtctctttaaagtatatctataatctgaatactttctaaccacctccaaggcagctttcctggtcctagccctcatccctgctcccatggattacttcagtagttttctaactgatgtaacatttttgccccactccaatctattttcccttcaaaatataagtcagattgtgtcactcttctgctgaaagctctattagtttcccatcttactcggaataaaagctaatgaatgtctgttccatcacttaacaagactgatctgaccccagacagtcattcttttttttttctttttttaatggagacagggtcttcctgtctctattaaagcaagttagtaatgtctctgttataataaaatgtctccattaacagcccgttgcccaggccggagtgcagttttgtgatcatagctcactgcagcctcacactcctgggctcaagcagtcctctcaccttggccttctggatgtcattcttttttactttcctttcacttacaatcctcagacacagatcttgctgttcctcacatggaccaagcatgttccttatgtagtgccttgtccttgctaattccctttccttaccattcttcctccagatctcagtgagctgtgtcttctctttatttatattctgttcgggcgtaacttcagaatagagggaatctttgataaccctttgtaaaatagtaactttctccgcctcttcctgttacact

SEQ ID NO: 44941 - DNA, 1068 bp, Homo sapiens
aagtacctgctgatgaataatcaagtgagtaactacaggctttaaacaacttacgttttcacaagccttaaaatttgaccaaataaactttttttctgcttcatgcatttttcccagcatcggttgcatcacatcttagtagattccacttcaggttgtactgtttatcaacttttttgaaaatattcccacttgtagttccatacaaattcttcgatcacttcaaatccagcaatggtttctcaaaaaataaagctaggcagtactgactagtaagaggcaaagaattaacagtgtcatttgatgttgtgtccaaaatcctcattcttcaaactactgttctcatcaaagggctgatgtcttaattttctctggacacatgtctttgggttggttactatcttcaagcacgatgtaattcagcattagtaaatggttttctttgcttggctaacaaataggctacttgtaaacattttggttgcagcctcatttttattacttttgtgaaattttgctgtgatgtttcatttaaattttctaattcttctgactgttgctttcccaccagttgggaatattgtgatgttagtctgatactgtcagtctattcttttaccagttatggtgacactgcattataaacacaatgtaccagcatataataaaatagtccatattccaatgtgccttgaaagtgtaacattcaaaggtacttttcttgttctgagatacagggcatgaactggtagcagaaaaagtaataaatctagcaatacacagggcattccaaatgctttcaggtaatatctgcatcaccatgattctgtagcttgccaagcggcaatgtgaaacaagacacacatacacaggttctgtagcagctactcaactttcccattatagcaaaaaagtatccatagataatatgtaaattagtgtggctgcattccaataaaaacttatagacactaaaatttgaatttcatgtaattttcagatgtcaggaaataatcttttgattatttttcccaaccatttaaaagccattttcagttcatgggccac

SEQ ID NO: 44942 - DNA, 1066 bp, Homo sapiens
gagcgcctcctcctccgcggctgggtcccccggtggcctcaccagcctccagcagcagaagcagcgcctgatcgagtccctccggaactcacactccaggtgactggtcgctgcctctccaccggaggaaaaagtagggtgggagggcgggcttgtcctaaccaccctcacagcgcctcagtctgctccccaccagctcctcatgtggtttacctcccttggttgtgggtcacacgcttgctctgccactcctgcccccttttactgttttcctccggaccctccctgcctcctgccgcaccactgctcagcgcttctaactcggatttcctcatccctcctgacacatagctgctgactgtaatctctcaatctctctcatagtctatttccagtatcccttgctgcccaggcttcgccactgatctttccctttgcccacctgattgccgcgtcagcagaattgttaaaatacaattgtgaagagtaatctccaggtttcacaaagaatggaaaatagaactgttgcaacatcaaaggaaagggaagccagagttttcatcagtgaatgcttctcgtctgagagtcacttatcacgtagtcagtcttcttgagtctctaagatttaccctgttggagcagtctctccccatctcacagcgaccagtgcatgtacatttctcacttctttcatagtcttgtccccacgctcaagaattactttatgttcatcttgattgttctgttgtcttcctgtgagtttttcattttatcatggtcagtttagaaatatttttacaattcatattatttcaacttttactgtaaattggtttgctgcagccttttacattgcaaatgtctatggtctctaatggttttcaaaaattagaactgcttctttatattttatgcattttgcaagtatatttacttaacagtttcacactattttaaataaagatgacaacattgttaagtccctaacccctttttttttttttttttttgccgggggtacggctctcctgttgcccaggctggagcgcagtggcgcgatctcggt

SEQ ID NO: 44943 - DNA, 1024 bp, Homo sapiens
ggaggaagtagaaggaaggcaggaagggcaaaatgggctcatatcagttgtctattattttgttccctttaagatattttcctacaatttctccctacaactttcctgtacattctactggatgggatttaagtctatagcaacaactagctataagaactaactagaacattgctacccagaataaaatcaggcttctctacttagaaaaaaggggatatttgtttttggaaagcagccagcatcctctgtcataagattgtaggatgcgtctcatctagacttttaagttcaagctgttaagacccagacttccccagctgccgatattgcttaatagtggcagttaaaacccagatggattgctcatctgtattaaccggagagcacacaattgcttctgctaatggtaaattggatagagtgatagtaaaacagtgtagcattaatgaagagttttttcttgcctctttacatcatcatcccccttcccctggatagtttagaatgttactgtgtgcttagatgatgagcctttctaactatgatcattttccttcccctcaagatacaagttatgctggctatccagattctgtgattaaaaataaaggtagttttagtagattctagcacttaacattggtttttaacaataatggtttcatgactttgggtaaattttttaaaattttctcctgcagtatagccgaaatacagaaagatgtggaatacagattgccattcaccataaacaacctgacaattaacattaatatgtgagtagaattgtatcctactttttcatgtaaaaggacttaacagtttttttattgtttcttagttattagaaataaacttttaaggtgaacttatttcaagtaactataatttataaaatagtgcacaattcagtgaaataaaaatattcgaaagctatcactgttatagtgttataagaaagaaactagaaaagaggaaatgcaataaaaatgtgtaatactaattctgagtactgtaattg

SEQ ID NO: 44944 - DNA, 1030 bp, Homo sapiens
ggtcccaaagctactcccacactttagatttttgttgttgttgttgtcatagcagcattccacttccaggtacttcagccctctccccctcatctttttcttcctgttttctatgttctagagtcctgagtccttattttcagataaaaaatgtattcaaaacccatacctctatcttctgtagtaatagggctggatataaactcatttaccttatttgaaaatacaaaccgacaagtttacttgttttcatttcagataagttcggggatatagtaccattattaaaaatcaagtttgatgcatttcttagattattttgtgggttgtacctgctactgagttcaaaataaagcagattgggtcagaattattgatttaaattcaaagatattacaaatactctctcatgttggttttattgtttctaaatagcttgttatattcacatacatatcactaattccttcagataaattttaagataaagatgagccatcgtttgaaatgaacaagctgattagaaaacttaattttttctaggggtcatatattcacctggctcaaaattcaaaaagtataaaggagtatagagtgaaaatctccgtgtcacttttttcccttgcagcttaattttttttcctcattagcatctaaagttatttgtttgggtttgtgtatatataattcctgagctgttttattcatctacaagaaaatatatatagtattgtattttcccccttttttatatgaatggtagcatattttgcccttcctttttttttttttttttttttttttggtggagggggtcactaaatgatatggttttggaaagtttttcatgttagtactaaggcacttcctcattattccttatagccacaaagtatttgttttatgggtgtattataatgtctttagcaagcctgacagatattttcatgttttctaaccctccctcaaaagcccatcctacttcattgccgtcagtgctgctccagtaaataatctttaaaataatatt

SEQ ID NO: 44945 - DNA, 1050 bp, Homo sapiens
gaccgtggaaaaagcgtagtttctgggctgggtagcacagtccctcaaggcttcccttggctaggggaggtagttccctaaccccttgcacttaccgggtgaggcaacaccccaccctgcttctgctcaccctccgtgggctacacccactgtctaaccagtcccagtgagatgaaccaggtatctcagctggaaatgcagaaatcacctgccttctctgttggtctccctgggagctgcagactggagctgttcctattcagccatcttgcctgggagccactgtgggcaaatcttaattggaagataatgtaaagagatacatattcatcttcttaaatattagaggtattttttattgttttctttctagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttctttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcattt

SEQ ID NO: 44946 - DNA, 1031 bp, Homo sapiens
cagttcaatgtcagtctgatacggatattcttgtagaaatctctgagatttaataaacttacagttgagtagaactgaatcatactaaagaccagtggaagcatccttgcagggccttatcagtttttacaatgtaaaataactaacccatagcgtttccttttacagttaatgtttgtttaataacatgcttaaggtataatattgagacgaagtgaggaattttaatgctgatttagctactgaaaaattatctcttgcaacacttgctttacttgtagttaggatttgtaatgttttattgcaaaagaaagccctcttttaaatgcgttgcatttgtggcatagtggttgtgtaggtggagtaggacttgtgtctgtacaattcatcaagaacatagcacagagcacttttacatgccattcagagacaatagtgggtgttgataaaatttgtagtactagagctgtgaaaacaagtgctgggctggtgcctgctttaaactctcttgaaacttagcagaatttcatttttataacaaaaatcactattttctttaaagaggattgataacatgaataagtctaggtgtcctggaaattcatttggttatatcactataaaaatggtgagacactgttgtggtagttggttttgtattttaaagcgtaaacttcacagtacatttaaaactgtcctgtgcgaaatttcagaggctttggacacgttcctttctagcctccctcgccgtggacagttatcaagtttctggcacggtgctagacgaatatggaagagaagtaagtgcctcagaatgacattttagaacgctctttttataggttaagagactgagatcttgagaggtgtaactcatctgaggttagacagctagggatacagtgaagactggagtccaagcatattgaaaagtcagaccattctgtttttgtgaaaacaaataataattactagaatgcactacttctgtggaatttttttttttgagacagactcttgctttgttgcct

SEQ ID NO: 44947 - DNA, 1050 bp, Homo sapiens
gctgaacacttagtagtgctgctatgttacgggttttggttggttggttggtttttttctttcctggcgataggaaactgactggcatgacttctcctcttctccctctgggaatcggatttttacgtaataagaaagtaccttcaagaatagaggaaatttcatgtaaaacagatggatcagctgggcacagtggctcacgcctgtaatcccaatctttgggacattgaggagggtggatcacttgaggccaggaattagagactagactggccaacatggtgcaaaccatctctactaaaatacaaaaattagccaggtgtggtggcgcacacccgtggtcccagctactcgggaggctgaggcaggagaattgcttgaacctgggaggcgtgaggttgcagtgagtcaagatcacgccactgcactccagcctgggcaacagagcaagactctgtctcaaaaataagtaaaataaaatgaaataaaatagatggaccaagataagaaaagggacaaaagcagaggagaactaccctggagaagaggaagaatttcacacaatttaatttctttacctgttgatgttttattaagcatacacatcttttgtttatatttccttaggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaaggtacattgcatcgcctttggggcacgggctgtttgggactctacaaagtagtcagtgtctaaaaatttgcttttgtctgtttaaaaagtatcctaatagaaacaaaatattatgcaactttgtatttattgattggcttgctcagaatttccacataaaaatcttaaaggataaactcccctgctgttagttgagtcagt

SEQ ID NO: 44948 - DNA, 1475 bp, Homo sapiens
aaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaatttagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagacgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttctttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttct

SEQ ID NO: 44949 - DNA, 1043 bp, Homo sapiens
gatgatttggtctaaaccccacaatcctattgtgtggcttagttatatctataaatatagaacctgttttacttcatttttgtgtcaggtggtttgaaggggggaaacatacaatgctctgctaagtaattagagctacttacgcaggcattggggaatctgaaacttagcttctaattgtctccacataaaaacagaagttaacttctagggacatcttcagggactcctcaaggcaaatattcatgaaatggggcctattggcttttcttttcatcttggttctgggcatgttgccatgttcctgatctctgaactctgatgctgacctgctacagactccaggagcaatattaaggataaaataataactcacataactttgtggctctttattctaaaaaaaaaaaaaaaagttggctcaattttttttcctccataagaaaatgcaaattgcaactgtattgagaaaccattttttcacttatcagattgtcaaagattagaaagtttgataatcacagtgttggtaaaagtgtagactagcagtcacaatgaaaatgtaaatgtaaattataatgacctccctagggggaaggtcaggatacctaacaatattgcaactatacgtataagagtttatcttggccctgcgtggtggcacggtgactcatgcctgcaatcccagcacttggggaggccgaggcgggcagatcacctgaggtcaggagttggagaccagcctggccaacatggtgaaaccctgtctcaactaaaaatacaaaaattagccagacatgatagcaggcgcctgtaatcccagctacttgggaggctgaggcaggagaatcccttgaacctggaaagcgaagtttgcagtgagccgagattgtgacactgcactccagcctgggcaacgcaccgcgactctgtctcaaaaaaaaaaaaagagtttatcttacaacacacaggagaaatggtatgtatctacaaccttgtttatttcagcattgtttataataagatatatttcaaatacaaat

SEQ ID NO: 44950 - DNA, 1089 bp, Homo sapiens
tgcgtaaaacattctttctccagatatattcttttttttttttgagatggagtcttgctcttgcccaggctggagtgcagtggcgtgatctcagcacactgcaacctctgcctcccgggttcaattgattcttctgcttcagcctcctgagtaactaggactacaggcgtgtgccaccatggctggctagtttttgtatttttagtagagataggatttcgttatgttggccaggctggtattgaattcctgaccttgtggtaacgccgaccttggcccagatatattcttaatacatttatcttactttactattacttcattattctattaatagaaagtattgctaacatactcttttaagataaaaatgatatgtaataattttgacttaaatatcttaattttcccttccaatttacgtttcaaaacaattgcttttagtacttttaaatatggcatcacttctgttgcctggctgttttattcttcagtattacaaattatgtcagtatatgtagaatacagtagttgcaaaatgttttatttaaatgagtcattttggttcactggatatacttctatgggtattattttttaaagttttaaaatatatttctagtataaataattacgtaaactgttcctgaaaatatgagacagaaaaaaagaagaaaaatcaccagtgcctaccctgtaaccaataattgcttttgtgaaagcactttaataaagtttcttagcttttgtttaaaaaaatttatgtataatttttcatactgcttttttacttttttatattactttttccatgatacaccgacaggttatattgtccaggcttcataattacatattttgaagggtacttagtattctacccagcaagtgtagtacagtttgcctaatagcattgattttgtcatttgacatttagtgttgttttttaatttatcacaattatagcgtaataaacaacttcattatagttctttccaccatatttaaggttgttttcttagattgcatatagagaggtagaattactgcgtcaaaaattcagttttagttcttgatacagtattgcca

SEQ ID NO: 44951 - DNA, 1033 bp, Homo sapiens
tggaaataaccaagttcatttgtcactgaggacacgttaaggatattagaatttttcattttttgggctctatcctagtactggagcaaaaccagatgactgaaaaatcgagagaaagactagtaaatgggacaggatagcatttacattgtgacttattcacaatgagaaaaatgctgtaattgctgacttggcaaaatggaatttgttgaagtactgtttttctgaagaatagtaatttacagaactttgaggaaagatttctaaaacttagtgtggttcaatgctagggtgtttttaggcattttaaacaggcgtgcctataaccatgcattattaagcttttaacacctattacaggctagtaaagcttttgttttgagaggataagcatatatctcttcgggttttgaggtgttcaaaatgccattcagcattaggaatttgaaggtttgtttcctattagtattgacctgcataattcttacctgcctcctttctcttcccggaccttcctaatttgaagaggtgatttggatttcttttctctacattattttcaacaggagatacttagagagcctgatccaaacagttgttgaagaatggattttactgtggggaaattctttttctatttacagtggtgcgaggcataatttcttccttaggttccagcagaaatggaagggttaggacgatgtgggtaaaggaattctgttggggaggagtgggaacttgtatagatttattgtaatttatataaagtattcattgtgatggcaatttctttcataatataaaatgacggtatgaaagttgactaataacatgtagcagagtaaatgttaaaaatgtgctttaacaactgtgtggtatggtaattccgcaggatgtggtacttgcttagttacagtaagcaacagtctagtctacagaaaacttaaaagactaaatatactgctgcttggagggggatgtggattgatttttgtttttttttttttttaaaaaaaaggtggactggtacttt

SEQ ID NO: 44952 - DNA, 1007 bp, Homo sapiens
gagttgagatcacgccactgcactctagcctgggccacagagtgagactttgtctcaaaaataaataaataaataaataaataaataaaaaataaaggaacatgagagagaagtggtgggaaaaattgataggttaagaagttaaagtttacagtggtagttctagaaagaaggcaagagagagaatgagatttttgaaggtttattttatgtaacgtggcattgttattacttttgattcaattactgatgtctagtgaatccaagacctctgtgtggtcatgtgtctctaaaactatgtagagtcagctctcagtatctgtgggttccacatccatggattcaaccaaccatggatcaggaatattttggggggagaaataacacaacaatttttaaaatgcaaatttaaaaatataacagctatttacatagtgtttatattgtattaggtattataagtagtctagagctgatctgaagtatataggaggatgtgtgtagattatgtgcagatactacaccattttatataagggatttgggtatctgttgtttttggtgtccccaggggtccttgaaccaatccctcatggatactgagggatgacttcatatgttaatagtggcatatcaggaaaccgtatttaatttgggaatagtaagggtatatacttacctaccagcacagcctagcaaatatttctttctctttataaagaatatttatgcatttaaaaaatgagaatgcatttaattgcgttagtcttaattcttcttttttgttgtttttttttaataagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatctt

SEQ ID NO: 44953 - DNA, 1050 bp, Homo sapiens
ctcagtaatgtctgtatacctgattttcctgagaggtagtatttagtagtacttcacacttttgatacttgagaaactagaaatctttttgacatcaggttttctgctattaacatttacacctgcttaaaatgaacaattaaattgaaattggttttcttacacttttgtccctaaaacagcataagaaaataatgtgagattttgagtaagctgtacttggcattaacctcattattttacagtcataccccctggagagttcactaggtggatattccattaggtctaaattttgtttctgttagctgctatgatatgaaaataatgtctgtattattttgctaaaatgggtgtaaatcgtatacataaattttttgtttatcaggaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcggtaagaacttttctggggatgtttttccagcatattcattctgtcttgatacttataatgtgggaacaaaaatacttcgttgtagtatttactatttgccttttatttaagctttctactattttggtcagtgtaatcatctctgccctgtgaagaaagatgaatagggaagtatggagtacaatagttcagtaaatttgccctttgttagactgaattcgagtaaatcatgagatgtatctaacttagcattttgctgtctttttctttttaggcgtaattttcattttttcagatgtttttctacttaaatagcacatatgcagaagttaatgaaaagcaggagtcgattattcaatttgaatttaaatggaatagccaacaatgtgcttggtttggtgttattttattagcagttctaaacttggatttctttctctctttttttgtgccttaaatgacttcaggctgttttctttcttctagaa

SEQ ID NO: 44954 - DNA, 1049 bp, Homo sapiens
cagacttcaatttcaactgcttggtccccacgttacccacacttctgtgcaacatggctagaaatttgggagttcttacaatccccttcaggtttatttgctagaacaactcacgaaatacaggaaaagacttacttacgtttcctcatttcttataaaggattctgaactgccaaatggaagaggtgtgttaggacagtgtgtgggttggggaggtgtgcagagcttccatggtttcctctgtgtgtcccaccctccccagcactttgatgtgttcagtgacccagaagctgcctgaattctgtttacggttttttaggagatttcattgcttaagcgcaattgataaaattgttgactgttggtgattgttctcattagcaaaaattcacatctggttgaaaggggcttgttacggataacaaaagacattatcacttgggagattccaagggttttaggagctctgtgctaggaaccaggcacaaagaacagatagatattttattataccacaagaatgttgttccagtagatccaggtaaactggatcagtcttcactcctgctgttgagaattaagcaaaaataacaaattgtagatagtgaaaagagtctgccaacaaagatgttattacattgttactaataattataactgaaaatttcttcatgaataacagatggtgaagtagatacagtagctccacttgatgaaatactatgtggttgaacttaaagcgtgaagaatggaaaactacttgtgacataataaatatttttattttgcagaatacttaattatatggacactgctgtgtaaaaacatacatgaaaaagactggagactaatgaaaactaataattgtacaaagctaaagatctggacttctcccccctctatattttttaatactttgtatgttcttttaatttaaaacagaatattggcccataggcctgagtatcagagtttattgctgtattttaaaaaccaaattattatgtatgatgacttaatgctttcaatcttgtgttaggtggaagaac

SEQ ID NO: 44955 - DNA, 1055 bp, Homo sapiens
taatgttgagtactattagattataaaaacaacttttgtctcataagttttgaggatgcatggtattaatgatatttaggatttcttctgaaacagagtttttgactcagtgtgaaaggttggctccgttgaacctagtctgtcagatgtatctctctgattgtctttcctactccataaaaatatatataattcacattatatttctctttagctatgtgattaggaaggtctcaggctcttatattagcattttgacactgtttaattactgagtcattaactgggatttttttttttttttactcgattaaccaataactctgagaattccaactttgtattcaccactaggagtgctatgattaacatccgttactttgttgactccttttttttggttgttctatctttttcctgttaaatctcatgttgctctataaaggtattctgttgtcagaagcctaacacagtgttagttcacagttgccattcagaaatgattgttgaatgaatatccatcacgagcagtaaacatttattcaaagcttcggtgaatagactttcctattagaatgtccctacttcattattttcatataattgatagtaaaaaattactctggttttaaattatttatatcatttttaggatggatctgaatgtctaatattattttagatatttggcctacttcagattagacctcatttcccaaaatctcaactattgtaatttcatggaattaaatgactagagataaaaagtcagataaaatcctgtagtcttattcaggggtcagaaaacttttcctataaaagactagatagtattttaggccttgctggccatatagtgtttatcatagccattcatctgtgacagttttgcacaagagcaaccataggcaatatgtaaacatgagtatggctgtgttctgcaataacactttatttatgggcacagaaattttattttcatataattttcatttgtcacaaacttttaactttttttcttccaactatttaagaatataaaagccattcttagc

SEQ ID NO: 44956 - DNA, 1077 bp, Homo sapiens
gcttgaccacaggaatgagacttccatgcaccctcatcttgccattattaaagctatccagcatttgggtccagccttaagagaaggtgagagtcatgactaggccagtgaatataacagtgcatataaaagggacctagttaccagggagaaaacagaagtagaccactgaaagaggcaaaacctagtgaaaatagaattattgaacaaaatattgaacaaatacacttgaacaaaataataagggcacataagcagattgaattataacaaattctttagagctagaaaaaaatgacattaagttttaatgtttagattatttaaaaaagaggacacgtgctattaagttccaaattacaggcctagaaaatcagggggaagaattatgtcattaaatggaatgaaagtactaacagataaaatcaagagaagacgattagagacttacaagaagttctgaaggggaaaataaaaaaccaggtggacaagcaataactaaataatagatgggatgaagaaagacttgagactgcagatcagaacagctggctgttgtctagccaggagagaagtgagggaaacacacaaacacctatgcagagtctggcaaaatccctgaattccaaggaaaaagtaaaaatcctctaagcttccatatgaaagaccaagttgcatacaaagaaaaagaaccaaaccgacaccaggcaatcttccttaccacacaagcagaagtagaaaaaagtggaatgacgctacacagttgacaaagaactgcaactcaggaaccttgtactcagccaaaggaccctccacatgtcagaatgaaaaggagatactagtttatcctatctgaggaaaactaaagaaacaacctgtgaatcaaaatagagacctttatacaggggaagataaagaagacagagaacagtttaataaagaaaacagtagatcagtctcactaatataaattcaaaagtaaaaataaaatattagcaaattgaatctgccattgtatcaaaagaattctagactatcaacactagagtttatttcagacatgtaatgatgatttgt

SEQ ID NO: 44957 - DNA, 1163 bp, Homo sapiens
aatgatacgcaatttagattgataattttatcacatacagaggtattaaatatgtcattaaacagttatagctttgaaatgaattttttaaattaagtatgattaaactgcaatatagtatataagataaaagtttgcatatcaaaattctttttacctggatttttcccattagaagagattgcttacagagataattttggttcctgcttattataataagtgtcatttttgtgatagttcataccttaaaactacgagaactttagtgtatcacttgattttatacctgtaactgaggcaaaatagggaagttgcatatttattgttacatataattaatatatttttctattgatatcttatattagtaatgttattatttcatgcttgtggaaattgagacctgaagatattaaattattagccaagtagtggaaaatttttctattagagcacattctttttccattttcttattcctctcacaaaaatgagtttttatgatcttgtatacttctttgaaagcgcaatgtattaagatactcaacattttaaatggatacctttgagtgtaataattttgtgttatcaacaagtaaatttagccgaattgtagctaaataatagagtgatgcctagattctgtgaaactgaaaacttcagttggatcacttgcctgctccaatatacactgagtatgtaaataagacacaatggtgaaattgacctattatgttaggttacagatttggttactcatcatcacagcacttttctgtgtgatgtatgagatttgataattagtagactatactggatagaccttaatctagtagctttcattggcagcattcagtttattctttttaacattaacaaaatatacaaacttccttttctgtaatgaagtccatattagcaaaagcaaaaaagaaattagcacttagcttatttctaagtgttgaaagattttcactgatttttcctataaaatgtataatattttctgtatattttatatgatcagaaataaacatggttcttagtaatgctaggtaatgttattcattaaagtttcatttttagtataaaatgcatatcttgatattttaagattttatttatcttggtaatattaagcttcttttctactttaaaag

SEQ ID NO: 44958 - DNA, 1052 bp, Homo sapiens
tttttcttacaaacctgcaccagtagctgtgtctgaagtagacatagaattgggaaatttcattgataggcctttttcttacctaatttgcttgttttaggttgcgttgttttcatcagaatttgcatgacattttggaattcacttgtattgtttaaatgaaacaacaaaatgaaataaatatgggcttcagagtttgataactaagtttaaatccttgttcctacattgaactgtctgtgaaagcttgagcaagttacttaaattttctgcaaatgaaagtaatgtcatctactatataggattattttaaggattaaataagtgtgacaatgtatatgaagtgctcaagtagtatagtgtgtagaacttgttaaagctaattttcctcccttttgtttggacatttttttattaatgcattttgaggaatatatgaaaaagttcacttttacatactcaaaaaatatttttgttccaaatgtaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaaggtatatatttttgttttcggtaggtttttggagaacaggtggtgtttggttacatgaataagttctttagtggtgatttctgagattttggtgcacccatcgcctgagcagtatacactgtacccagtgtgtattgtttgatccctcacccccttcccaccctttcccctgaaaccccaaagtccactgtatcctgcttatgtctttgcatactcatagcttagctaccacttatgagtgagaacatgcaacgtttggttttccattcctaagttacatcacttagattaacggtctccaactctacccagatggctgcaaatgccattactttgttcctttttatggctaagtagtatgctgtggtgtataaataaataaacaaatatatctgtctatctacaca

SEQ ID NO: 44959 - DNA, 1047 bp, Homo sapiens
tatgaaagaagtcattccttttttgaaggtaagcaattattttaaaaaataaacgaaaccttctatgttttgttttttaattcatacagaagaccttattgtgataaagttcaacggtataggtaaacaacaacaaaaaaactatcacccataattttttcaccctaccaacattctctgaacctttcagtaatattttatacacatgtgcatattctgcctttttcatttactatatcataaacttctttctagatcattatttttctgctgcattttttcaggatttatcacctttatttttagttttagtttttgtgagtgtatagtaggtgtgtatatttatggggtacatgaaatagtttgatacaggcatgcaatatgtaataatcacatcatggtaaatggggtatccatcccctcaagcatttaacctttgtgttacaaacaatccagttatactcttttagttattttaaaatgtataattaaattattgactgtagtcaccctgttgtgctgttaaataatagatcttattcattcattctgactactttttgtacccattaaccatcttccctattccctactacctttcatagcctctggtaaccatccttatacagtttatctccatgagttaaattgttttaatttttagctcccacaagtaagtgagaacatatgaagtttgtctttctgtgcctggctaacttcacttaacataatgacctccagttccatccatgttgttgcagatgacaaggtctcattattttttatggctgaatagtactccattgtgtgtctgtaccacattttctttatctgttcatctgttgatggacacttaggttgcttccaaatcttggttgttgtgaacagtactgcaacaaacatgagtgtgcagatagccctttaatacactgatgtcttttcttttctgtatatacccagcagtgggattgctggatcatatggtagctcttgctgtattttcagttttttgagcaacttccaaactgttctccagaggggttgtac

SEQ ID NO: 44960 - DNA, 1052 bp, Homo sapiens
aatgtcctgcagagtttccccactgttttcatataatagtttcatagtatgaggtcttagatttatgtctttaatccattttgatttgacttttgtatatggtgagagatagaggtctagtttcattcctctgcatatggatatccagttaccccagcaccatttattgtgaagagactgtcttttccccactgtatgttcttggcacctttgttgaaaatgagtttattgtaggtatgtggatttgtttctgggttctctgttctgttctatcggtctgtgtttctgggttctctgttctgttctgtcggtctgtgtttctgttgtttgtatgccagtaccacgctgttttggttactatagctctgtggtataatttgaaggcaggttaatgtgattcttccagttttgttctttttgctcaagatagctttggctgttctgagctttttttgtggttcctataaattttaggattcttttttctctgtgaagaatgtcattggtattttgatcacaattgtattgaatctgtagattgcttcggggagtacagacattttaacaatattgatttttccaatccatgaacatggaatatctttccctttttgtgtctttttaaatttctttcatcagtgttttatagttttcattgtagagatctttcacttatttggttaattcttaggtatttaattttatttgtgtctgttgtaaatgagattactggtggcatatagaaatgctactgatttttgtgtgttgactttgtatcctgcaactttactgaatttgttgatcagttctaatagtattcttgtggagtctttaggcttttccaagtataagattatatatatatcatatacaaacaaggataatttgattcttcctttccagtttggatcccctctatttctttctcttgtctgattactctagctaggacttccagtactatgttgaataacagtggtgaaagtggacatccttgttgtgttccagatcacaaaggaatggctttcagtgtttccccatttagtatgata

SEQ ID NO: 44961 - DNA, 1049 bp, Homo sapiens
taaatatttgtcaacatgtcttttaaaaactaataggtatgcttgtagtaatatttatttgatatgtacagttactttataagggttaaaaaaaaagcctaaatgatctatccttatgcttagggagtgcagccttcagttaggaaattgattgtttttacttttttgtgtctgatttgatggaagaattatgtaagttacatgctatctgctcagaaactgttatacaataaaatatttaatacttgagcgaaatagaagtcaccttgagtctgtgaaatgtttaaaaagtcttgaatttaaaagaattacattttttaaagtgatttttcttaaatgtctaagatattaggaaatatcaatggtattttagttggctaaagtggctagtgacactcatttaataggttttccatttgaccttttaagcgctactagcatatctagagttacctaaatcacaacacttatcttgtcaccttgtgtaaaatctaaattgttccttctcactttacctgtgtagccctgatttaagtgatttcatttcatgaggaaatgaaataataaatactaatttagcatttcaaaaagtgtctgaggccagtaaagagtagaactaataatctgattttaattatttatgatgtctcatttcacttcagatcttgactttttttgtaggactgtagaacttctttgttaattatgcccaggcagcattacacccagtcacctgagttagacttcttgactctctttatgtcatcactagtgagtcaaaaatgtattctcctccttagagtcatcaatttgacttcactttcttctttctagtagcatgaccttaattcatattcttaccttttgcttagactacctgtcgtaataggcatgaagtgcatttttactaagccgtgtcctacccaaactccttagtcttcaagtggcttcactgctggatctggtgtgctttccccctctagctactctccatctaggtacattcacttcacattattcaacattttccatatctactgttacttttt

SEQ ID NO: 44962 - DNA, 1031 bp, Homo sapiens
tgtaaacccagctacacaggaggctgaggcaggagaatcgtttgaacccagtgggtggaggttgtcgtgagccaaaatggtgccattgcactccagcctgggcaacaagagcaaaactccatctcaaaaaaaaaaagttcccaagggtttgactctgaagacaataatcaacaccaatgggacatcaagggattctctggtatgttactctccataaggcccttaaacaaacatggggaggaaactaagatcagcatcagtgggagtcacgtacagtgttggtggataccttatccactttcaaccccatgctaataaatcagccagtcccttggaggaaagaaaatatttcacgtttccaatcaagttcagagaatcctctgtgaaccagtctaaatgacagttggactaatctcagaaaagcatgccttcctacaatatgacactaaattgagagggcacttaaagttctctctggaaggaaagttaattttagagcttcctgacccttctaaacctgaactgctctgtttcctacaagcaggaattgatcatattgaaactcactcttataccaacctagacctttctgaagtacccagatgtttgtgggcttgtttctcaactgacaaagggaagattaaaagtggtaagcctataaaaatacaaatacattattccaagccattgcctaaattgccctcatgccccctagggtcagaggcaatccaagggctttacccagttatagaggatttaataaaacaattccttgtacttgtctctataatactataatcctacagttaagaaatccatcacacctttaatcccagcactttgggaggccgaggcgggcggatcaggaggtcaagagattgagaccatcctggccaatatggtgaaaccccatctctactgaaaatataaaaattagctgggagtgctgatgtacacctgtagtcctagctactcaggagactgaggcaggagaatcgcttgaacccgggaggtggaggttgcagtgagct

SEQ ID NO: 44963 - DNA, 1029 bp, Homo sapiens
tgacacatatttaaaatcagaacttcaccatgatacccttgactatattagtagagaacggactgaaactgacattggttcaaaggaaactctagaggcaaatggaatacccctgtagtttcactgtatacaatagggtttttaagatcagtattcagggcatatttgaaaaggaaacaagtcatccttatttggcgatggtacccatgtgtaatacatagaagtgtttttttattcctctttctatttaaatcataaccattctacctggcagtgtgcagatgcagatatgacagagaataaccatgacaatcacatcattcccaattggtgggtaataggatctcctttgcccctttctctcagtaatactggattattcatcttgtatggcaacaaaatatataaatgttttcacctatatggtctggacactgtggtttgggctatttcctacctaaaatgaccagatatgactctttaaatggttgtgaaattcttaatctggggttgtttgtacatgaagtgatcccttacaaaagaactccctgtgatctcccaaactcgaatatatgaaggggttctagattttgttctttggtaagatcgctttttctttagctggcagtctctgaattggaaaaatggcttatggatatttcagcaacccttgaaaaaaagttttaatgatactttcgatactcttcaagcaatacaatctgagatgagtcatttggtctcactggaactccagtagaagtttagctgctcacagggatgagctttgggtgaaacgtattgtttttatgttaattagatattgttgccccaaatttaaaagatcttaataaatcagaattttttttatcagataagcaaggcctcctccattgatttattcagttggttaaattttaggcccctgggaatctttgcttagagggatctttaagttcttgctacagttactgtgttttcttcctttgtgctttatatccccacaaggggttcaaatgctttccagcagcc

SEQ ID NO: 44964 - DNA, 1044 bp, Homo sapiens
aagaccctgtctctacaaaaaattaaaaattagccaggcgtgagagtgcaggcctgtggtcctagctactcaggaggctgaggcgggaggatcacttgagcccaggagttctagactatggtgaactatgattgcccctgctgcattccagtctgggcaacagagtgaggccctgtgtcttaaaatttcttcttaaatatatatttacagttatgattcataatttcttagaaagggggcttataatctttgaaaaacgttagtacaaagagtaactcttctaactcttttgtttgcctcactacgagtacaattatacatttaaaacttcgaaaattactggttagatttattcttatctgatcattgtctagttgccatagaagacatttaattgaaattaagtcaaaggtagattataaaagctcttgaatttgaattttagtcagggatcctactgaatgtttttgtgcaaggaagtgaaatggtcaaatttatgggctgtgaagattaatctgctgactatagcatatactatcaagctagattgggggatctactattatataagtatgaaatataagctgaacaggagcagggtgagaaacagtgcaagaagaagaaaaacctaagatttctacttggataattggtagaattatgatactattaaaaatcagaagggagaactaggagggaaaaaaatagaattcaagtttaggaaaaacagtttaaggtgatcacaaaagacagttactaaattcatacctcagctttctaacagccccatcagagttgatacactgaaaagtttgtaagtggttacttacattctgctgggtacagctctcgtgttcagtaaacatatgaaaaaacaagagttgtctttctgtttttagtcctggttgtaactatttcttcagcatgtatgaactgcccccctgcctttttttttttttttttttgtgacaaaatggtaacagcttgacagtatgtttcacagctgtgattgtagcttttcctatgaactgcatatttctaaat

SEQ ID NO: 44965 - DNA, 1075 bp, Homo sapiens
ttgttattttctgttttcctacttggaacaatcctcctcacgcatatccttaggccttattctctggcatccttcaaatcttagcgagtgttttttttttggtgtgtttttttttttttttaaaccaactaatttaaaattggagctctccctctgtacttactgggtcctttctttactttagttttcccagggcacttactacaatctaacagattgcatgttttatccatgtattcaatttcctatatatgtcactccaactcccactaaaatataagatttttgagagtaagcaagcactagaacagtaggaaacacattatagctattcagtgaactatttcttgagttaatcaatcaatggatgagtgaatcaatacagttctttgagcgggaaactttgtataaggctcagctaaaagggaaattgagtgggtcaggtaccacggatactatacactctattgcatgattctcctgcctacatcagaagacgtttataagcctattttaaaggataccagttggaatctctcttttattaatcaccaagagaaccatgaacaagctgtttatcatttgactcatcatttaatcttgatttccagcttctcacacttgaaagaagacataatacatttctcacaggattctgggactattaactgaacttatgtgtgtaaaaggaattcatacaatgaaagcactagaaataattattatacttataaccattgtatttttacatgtttaaaatatagccataattagcctactcaaatccaagtgtaaaagtaaaatgatttgctttcgttttgttttccttgcttaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggct

SEQ ID NO: 44966 - DNA, 1033 bp, Homo sapiens
atgatgaagtagtggaaattacttcttgcttataccagtggcctcttgtcggtccttgagcaaaacataagtatgttggaattctgtgctctgtgcattttcatggggagtcagactttctttatcaggtaccatgtcaacagtaagtcataatgttaattgtaggctacttttttcttacatctcaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacggtaataaatagcttatttccagaattgcctattgattcttttggatccttataaaaacaaaatcatgctttttaaatctgtgtaatgcgtaggtatagtttttgggcaaattttgtgacactcaatgcaaaagaggatggtttttcattttatcaaaacatttctgactgggcacaatggctcacatctgtaatcccagtgctttgggaggctgaggtgggcagatcacttgaggtcaggagttcgagaccagcctagccaacatggtgaaaccccatctctactaaaaatacaaaaattagccaggcgaggtgatgcgtgcctgtagtcccagctactcgggaggctgaggtgagaaaatcacttgaacccaggacgtggaggctacgatgagccaagatcacaccactgcaatccagcctgggtgacagagtgagaccctgtctctaaaaaagaaaaaaaaaaagaaaaacagatttctaactgaaatatgaactcttaagacgatgttgtgtttgaacgtctcctagatacttcagagaaaagagaagctacttagcatgtttgtgtcatgaaatcttgatcaccaccctaattcagaagggaaaagttaccatttatattggacaataaagaatagttttacatgcctagggcaacatttggtacatgt

SEQ ID NO: 44967 - DNA, 1052 bp, Homo sapiens
gttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccacactaagtcattattttgtatcatttttaaagtaaatttattcttaggtcagattcactcagcatattttgactaagtaaccactgtacttagtaaaccgaagagcttctgagaattatagtgtaccttatagatatttttaacatttatatttgtataaagctaaagaaagccttacatatcctttaaactgactatagaagaaaatgatacagaattttgcctgcataaagtacacagga

SEQ ID NO: 44968 - DNA, 1093 bp, Homo sapiens
attgtttgtataatccagttacctcacatctttatttctgcacatgtcttcttgcttacccttgcatatctttgcaaaaagtacaaaatagttttgttgaatgaataccctaaaacatcctggtttcgtttatgattacgattccaaaaagtttatggtaaaagttattttgttgtagaaatgttattttagatttcaactgaattcttctactttgttcatcagattgcagctcagatctgtcgccaggctggtttggtaaagaaatccaaagatgtagtagactacagtgaggaaaattttgcaattgtatttgctgctatgggtgtaagtagaatttttgttttagtatgatatgtaaaattttgcttgtgtcgtgagaacattgtagtaagctgtacatatatagttgaatttttctttaggtaaagaatttgcaatctggcattttggccaaattaaggactaaaatttggcatttgactaatttgaaatttaagaataatattgtttgtgccccaaaccggctctttgttctgttggtttttgtgaagatttttggggtacttgaggttttaaaagaaggaacaattcaaatctgtagcttggctttcatcagaaataaatgttaaggatttttcttctcccagcactgatgaagttattgttatttaggtaaacatggaaactgcccggttcttcaaatctgactttgaagaaaatggctcaatggacaatgtctgcctctttttgaacttggctaatgacccaacgtaagtaacagagctatttctttctgtggcccagactcgggatcaaaagtgtgtcttaaggttggggaggtaaaatgtggtaataacagcatttggacctaacaatgaggtaaccctgtatttaaagtccagccctgcttcttggtagttatctggcactgggcaaattacttaggttctgaagctcataagatgtgacagctgatacttgtctcatggagttgttttgcatattaaatgagatcatacttataaattacctaatacacaatcaactctctgtaaatgattttttcctcctacctcaaaaatctggcttt

SEQ ID NO: 44969 - DNA, 1933 bp, Homo sapiens
attttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagtcttgttatttgggtctcttagaccttacctctcaactccctcaagagtaccagtctctgaagttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatggaccttaactaaagtgactctctatcttctaacgaggaaagcaacaagcaaatatgtaatcacacatctcttcaattcacagctctgagcatcataaccaggattgggaaccagcccttgtgttgcagggacatggcttccacactgcccttgtcattctttttggtactgtcccttacagcatgctgtagtttgatccagggctgagcattcctacaggtgctccccagcgttcctcatttcaggcctagtcaggacctctagagcccatctgctgtgagcaaaagagggtgctaaatagtgaaatacagcttgaagcaagccaaaacctgtttcacataaaatctcacatggatgtcctgtatatatagaaacctggtgaaagcacagggcatgctgtcatggagcctcccatttctccccactccagttcaaggcagctttcaggagatggagaggaaaaagcttaatcataagaagaactgggtagacctgagttctctttcggattctaccagtactatatggccttgcttaatcattcaacaaattcgagtctgcttgtctgcttgtatgccttttagggttgttgtaaggactggagatttttgtgtgt

SEQ ID NO: 44970 - DNA, 1025 bp, Homo sapiens
tcacagaaaacagatccgtaattgcttgtgtatgggagagaggcaggagggaggattacagagcagctcaagtcaacatttgccagtgatggataggttcattaccttgattgtggggatggttttgctgatgtatatgttatatcaaaacttatcagatatgtgtagtttactgtgtgtcaattataccttaataaagctctcaaatttaaaaaacaaaaagaataattggggaatagagaatgacaaagggtggtgtttttgataggaggttcatggaaaactctctgggaaggtaccatttgtgtagacccaaatgaagtgaaggagtgaacaatgtgaccagctttggagaagaacatttcaggtagcaggaagagcagatgcaaatgccctagactaggactgtgctgggcacgttagagtatgatgtggctgcaagagagtgaacaaagggcaaaggaggtcagagaggtagagaaggcctagatcatgtagaacttatcgttttttcactgacccggtgaggtgggggtggggggcaagccccaaggggctcttgcatctggcaccaaacacctggctgcacgccacccaggcacaacccgctccagggacagtgccaggtggagagtttaactggggcagtacactgtcaaacagtaacgcaagtgtcctaaggtgagctcagggagcacagaaacctccagtggaacagaagggcaaaagctcatttgatcctgattttcagtatgaatacagaccgtgaaaacagggcttcacaatccttcagaccttttgggctttaagcaggtgtcagaaaagttaccatagggatagactggataaagaaaatgtggcatacatacaccatggaatgctatgcagccataaaaaagaatgagttcatgtcctttgcagggacatggatgaagctagaaaccatcatcttcagcaaactaacacaggaacagaaaaccaaacactgcatattctcactggtaagtgggagttgaacaatggag

SEQ ID NO: 44971 - DNA, 1033 bp, Homo sapiens
acttggttggtcatagggaaagggggataccagtattaactgagtgtctgttatatgccaggcaccatgctaagccttttatagtgttatgccatttaattgggaaactcgtttggtctctgagcctggattaagtgatctgtgaagtcccttgtacttcaagcattctggatgggatttccagttgtcatccttgtattctctccccaatatagcaccgtgttctcaattcatatgtacatgtttgtaaaattccttaaaatatttatgctcaaaccaacatttccattttatctatcttaaatatatcttcctcttctttacgcctaatttcttaaactcccagagtttttttctgtaagatctagtcatctgtagcacttctcacaaattgagctctcttatgccccaaacagtaacgaaagaggtctcttagttggacaataagcagtgaaagatatttcttatgggacaagaaattaacattattagtcaaatgttgatgccggtaggctgagaaatgattctcacttaaaagcccctgggttttaaacctctcttagaaaaacattagttagatgaaaaaaaaaatcaaaatattttcctctggaaaacaatgttcctctgaaaacaagcagattattaaaatatcccttgtactacttcaggaaattgtaatcttataactgtagtggccttttagcttttaaatatatgaacttgagttggacacatgctgatctcattggtactttgcatgataagaaattatgatatttacaatgtgcagtctcagaaagaactgagagttttgctagacatttgccctaaagtttgagtcaatttatggtttaaaggggtgtatttaaggctagaaaagggaaatgaagggttttcttaggattttttccaattctatttaaaattgtttgcaaagttttgaaagcatatgtcatgagtttggcaaaaattatttcaaagcttgttttttttttaacctcattcacctctgctaactcctgaacttcagtgc

SEQ ID NO: 44972 - DNA, 1023 bp, Homo sapiens
tgccttggtgttacatactggccttagcaagataaaaactcactctgccatcaacctttagatcactcttaacggactcagactttgactaatctgttagttccaaaattataccttatttttaatgcatagcacaataagaggttaaaagtttcaaaactgcttatcttgtggaatttttggcatggctagaaagtgtttagattaacgagtaatttatataatcaatggtagatatgaccaccatagagcatacacaaattcatattagtcgaataaatgaatcagtcttatttggatgtgttaaatgtatttccaaaacacagttgagttcagtcattaaactgtttgctttttaaaacatcttgatctgttatgtttcaggctgaagcacttttaatgtcttacggtaatagttaccaagaagattaaacctcttagtacgcatgtaataggaaggacttttaattgatgttttgctggcagactccacaggagctgagtttagtgtacttttccgactgtgcttgtctagtttcctaggattctgaagtagctcatggctgtttccctctgttcccatcactgcttctgtcactgcagtgtccccatctacaacagctgccatttgtcaacccagggaaggtatttctttttggagttagttcatcaattattaaaaggttcactgaaatcatcagaagttatttattggtaaccctgtttaattgtagaggatcaagcagaaattaaagtaccctggaccaacaaggaaatcagtacccgattcttggtatctttgttcctcttttataaaaggaatatatatttgttaagcagatattatgttcaaattgatcatcagtttttgcaagtaggaatgttacgtaaatgagaatcttcaaaggttttggagtaatttataaagtagatacaaattttgcattaaactcccactttcattaaacttttattactaaagcttcagagaaataagatatagataatatttatgagcctttc

SEQ ID NO: 44973 - DNA, 1028 bp, Homo sapiens
cgggattacaaaaagatacatagttaggctttttttttttttgagccggagtctcactgtgtcacccaggctggagtgcggtggtgtgatctcggctcactgcaacctccatctcctgtgttcaagcaattatcctgtcttagcctcccagtagctggaattacaggtgcatgccaccacacccgcctaatttttgtatttttagtagagatggggtttctccatgttggccaggctggtctcgaactcctgacctcaggtgatccacctgccttggcctcccaaagtgctgggactacaggcatgagccaccgtgcctggccagtggtcaggcattttcatcgtcctgtatagtcttgccaaaaacacttcctgtatgtaatcttgccataggcggggtagaacctcagtctgatccaatctctggatgcatctgtagttttcaggaaataccccaaacagaggtacatgccgaattataccaagcatatgtaatcagcacaacctaaacctagggaactctaggtcaaacagcctgagttcttcagtaggtaaattacagtcatgccttggtgtctgtgggggattggttccagacctcccccatatatctaaatctgaggatactcaagtccctgatagaaaatggattagtatttgcatataacaagcgtatcctcctatatgctttttttttttttcttccctttgagatgaggtcttgctctgtcttgcaggctggagtgcagtggcacaatcatggctcactgctgccttgaccacgccacaaccccgctccctggactcaggcaatcctcctacctcggtctccctagaaggtgaaactacaggcgggtgccacctgactagttaagaaaattttttttttagagatggggtctggccctgttacccaggctggtctcaaactcctggggtcaagcaaccctctcgccttggccttccaaagtgctgggattacaggcaggagccactgcactcagactcatatactttaaatcatctct

SEQ ID NO: 44974 - DNA, 1073 bp, Homo sapiens
ttgaaaaaatcactatctttggcaagatggaagtcttgggaagggtgggatccccccagggtcccatgaaagggcatcatgagaggcatatcccagctagacttcagcagcaagcactggccttcttttgataaagtggcaacataaagtgcagtcctcatatttttcctaatcctcaaacagcttcccagtcgtgcttacctatattacgctctttcacagatgaaagagaaaacaccaagaaaaggcacatatattagccatcattcttgtgtgtgtggaaaaaggtgaaaatagaaatgataatgccatgtggtattctgaacaacagtaatccctaaagaattgcttaatcaaaatttgctttccaaaaagtatccttaagactggaatgaaatgtgaaaaaatgaaagttaattggttgagaggatagaattctagttgactttatttttgactttttattagtattataatattgtttatacagtaaatagaacaaattataattggttgaaattatccgttagtagctgaggggtataacttttcccccaaatatctgaatgatacaaagtcatggtcaaagactgtgtggtggtctgttctgttttacgcacatagtgttttatatattgctcttaaatcacttggtgtttggattgatgcacttgtatttgtcctgtgggagatgcccagctagctctgccagctaactcctgctggagtgacagtacagtctctctcaccactagtcttaaatttttatacctggtggtattatgtaatattaacataaatggatagtctgagggactaccatcttaaggactttctgtgtcatagaaaattgtccttgacccttgattaaaatactttaatgcttctgagcctgttcctgttttatggcattgtatataatatagccacatggaggaattcttccttaggcattttgatcacatggaatgctttgagtctccgtaaggttaaaacttgttaaacccacatttgagaatgtgataaagctattccattgcttaaggcataattctcctttctcacaaataacc

SEQ ID NO: 44975 - DNA, 1071 bp, Homo sapiens
cagatttgacagtcttcctttgtggtgacagttaggttttaagtccagcaaaacaacagttttaaactatgattccttgctgccttgtctaggcagttttactaatgacacaggaacccgtcattcgaaagtatgagtgcattccaaatgccaaaaccaagcacacatgacaactctttctaccttatactttttttaaccaggatagtgttgaatactgcatcattggtgtcacaattttatctcagctaaccaatgaaattaatcaagtaagtgctacagccttcctcattgaagtaagtgccatattttttcttagtattggtgttttctgctgtgtgtgggatgatcttttttggcagttgtgtgcttttgcggtaagtgattaatgcccttttgaaacaaaatagttccattgggttttcctctgtaattgcaactcacctcactttttgtcctgttccctttctgtctccaggttgttttccccttttccatcttagcttttttttttttattggtactaattatcattttagagataaaagcgatcgcagcactttgggaggccgaggcaggcggatcacctgaggtcaggagatcaagaccagcctggctaacatgttgaaaccctgtttctactaaaaatacaaaaaattagccgggcgtggtggcatgtgcctgtagtcccagcgacttgggagacaggcaggagaatcgcttgaacccgggaggtggaggttgcagcgagccaagatcgcgctgttgcactccagcttgggcaacaagagcgaaactccatctcaaaaaaagcaaaatactactgccttgcccatgaaggagaatgacttcaaaaaagagaccataaaggtcgaccttttgtgtgccccttctgctcctatatactttaaattttttaaatggtcattgatgccacagaatactacagaggaaacaccagtggctttcttttgtcctggctatattttagtcatttacttttttatccagctaaaaatttgtgattatagaacaggcccttatcaatattagctataacatctcaccctt

SEQ ID NO: 44976 - DNA, 1030 bp, Homo sapiens
acagatagtaacctgggcttcctctttttaccgggcctggctggtgtttgtaacatggcactgtgcccagcttgggtgtttttaactctaaggaaatactacactaaaaataatggccttgtctgatacaggaacattggttacctaacgaatttccctcttagcattgcccttaccaaagcagagaagtagccattctctgtaagaaaagtaagacttcatggtttcaccacagtgttcttaagattaaggaagttcagagtgaggaatgtcttcaagaaactatcactggaggtgacactgggtctgtctcctgctgcaggaaggctgacatggctggtttacattattggagcagtgatcggtggccgggtttcttttgccagcactgatgagcaagacgccatggatggtgagcttgtctgtcggtaagtgctccccacagaagctctccactctgccttgctggcacttctccactccccgatagggtcctctccacttacagaacgtaatctgaacatgctaactgcccatgagacacagctttcaaggcttttgtaagtgccatgataactctgcctatgatctttactttaaaataaaaaaccagcaataattcagaaaggaaataatggatacggaattaggaaaactaaagcagagattctctgttaggtctttttacgaatagtatctcagagttagtaaaatatggactgcttttgccatcccaaaataagtctaaaaggaaactgcagttctttaaagttcaccagagatggaattacagagttcctacagcctttcaaatctcttggccatacatttcaagttatttttcatctgtgcaattctcattttatcaaaactttttttttttttttttttggagatggagtctcgctctgtcacccaggccagagtgcagtggcgctatcttagctcactgcaacctctgcctccctgttccaggttctcccgggttcaagcgattctcctgcctcagcctcccaagtagctatgatta

SEQ ID NO: 44977 - DNA, 1077 bp, Homo sapiens
ggaagctagtgaagcttagtgcggtacagttcatgctgaacaatcacacggtgagtgattttagctttttttcctggccctcctaccacccacacatacactttctcgacacataaaggagatatgtaaactgaggtcccgggtattgctacagcaaagacggtggtcctgattcccacgatactgccagattatacttacgtcatcagagtggctctttgagatccagatgatgtgagttatggtgaagtcacctactgctactcatactgcagataaattagtagtagtgacaacggtagcctgccttcaaaaaaaaaaaaaccttcagatcctcaaggaatgactacataaccattggcttgaaagggctcagtaattctctgattactggcttgcattctgcctctaactcatgtttttacctttaacttcttttctttttttcaatagagcgagcacttttcatttttgggtattaacaatcagtccaacctgacagacatgcggtgtcggactaccttctacacagcacttgggcgtctcctcatggtggatttaggtaccgtaagaaatcgtagtggctcatgaagtcatctggcactcttctaaatttttatttgaggactgaaaactagatgttggggaggccttttctgttttttcaacagtaacaaaactatctgaaataacagcctgatttcaccaagaacagatcatgctgtcgaggtccttataactggaagagagtaacagtctgctcctgaagttttcatctgatacgcagtggctttaaaattctcttcacattcttcgggtgttaaataagggaattgagattcctaaatgtatctttttggccagataacttctccaccccacaatgaggtgtaaacccacttgaaacagtcaacaccactttttattatccagttttctagcacagatgagccagaagggctttatcacttttgtagcagtagtggtgatattagcagtttcaggtcagttaataactaaagctcagtggtattactctaatttcgagctgtttaaatttaatcctactaaaatgac

SEQ ID NO: 44978 - DNA, 1028 bp, Homo sapiens
ccaggtgcctctttaatagttatgtaaaggaaatgagctgatcccatataataccatagaagtgatgaaaggacaaataacagtatgaaatacatcatgctcttcagaagaaaggccctatgtaaactaaaatgtattatgagatgcctttcacaggttaaagaacacaaaatcactttagtatcttctggttagaaagactccaagattagcaagcaagagacaggaacttaaagaactgtagtttgacaagtttttgcttggctagtgctgaaaaactattttaaattctgtacctttctggaatcagaaatctttccttagcttctcatttacagatatccatcctatatgccaattctccaacgggcaattgagctctggtaccatgatccagcctgtactacacctgtactcaagttgatggctgaattggttcataataggtaagcaggaggcagagcttgcaagggcacatctgccctgttatctgagagaatttgctgtatctagtgctttgggcagattgtgggaaataataagattcactactgcattttaaaattcgaaaagtttttgtgtttttgtttgtgtgaaagaatagtattcctaactacacaaaaccatagtcaactgcaggaaataagtcactttttttggtttgtttgtcttgttttttttgaggcggtgtcttgctgtctcccaggctggagtgcagtggcacagtctcggctcactgcaagctccatccccctgggttcacgccattcccctgcctcagcctccggagtagctgggactacaggcacccgccaccacacccggccgattttttgtatttttagtagagacagggtttcaccatgttagccaggatggtctcgatctcctgacctcgtgatccgcgtgcctcggcctcccaaagtgctgggattacaggcgtgagccactgcgcccatctaataagtcacttttaaaaagagtctccagtggggcatggtggctcatgcctgtaatcctagcttctt

SEQ ID NO: 44979 - DNA, 1051 bp, Homo sapiens
gatccattggtaagtgaagttcaaaccaattttaagaacaagaaaggaaatgaatatcttagaagaaaaggtaaccttgaaatagaagactcagatgaagcttcacaaactatttgtctgatttaccctatacagaaaaggccttcagcctaatatactcctgtatttggaatctgtcgttttatcttgggtagcaatacattaggtcactgcctgaaattctccattccattttcagatgctgtccacggtgctgaacatcatcatctttgaagactgtaggaaccagtggtctatgtcccgaccactacttggcttgatattgcttaatgaaaaggtgagagagccagctccctggtgccaacccagaagcagtggcaaccacgcacttggtatcaccaagccctgggagaaatgtgtatagaaacaccccacggtggtgaaacagggaaaatgggtcatttactgagcaagtcccatttgtgctttcagtatcacataatcatttaactgttagaagtcagcatgtgtggtagctcacagacacaggataaaggagtgtttcccctaggcagtaagagaaacctttcaaggaaataatgtacctgggtatcagaggacctaagacctaagttctagttctagctctgctataaacaagtcttgagattctggtaaaagaaaggtctggataagatgacccttttaaagtgctttacaatttaaaaattcttgatattcttagtaggatgaagccatattatcccacaagtgcttgcctgaatttcttttttaagggtccaattttagtagacattccattcctccttagagaagaacattcttcaaccctgcagatgacggagggctaatctgccttcccctgcttctctaaccttctgttccactccttgccccacagtatttttctgacctaagaaacagtattgtgaacagccagccaccggagaagcagcaggccatgcacctgtgttttgagaacctgatggaaggcatcgagcgaaatcttcttacgaaaaacagagacagg

SEQ ID NO: 44980 - DNA, 1031 bp, Homo sapiens
cattattgatcatactaattctgcttctgctggttttttctgctttttaatcatttgatcaggttttcttttatttttgttttaaagacaaggtcttgctctgttgcctaggttggagtgcagtggcctgatcatggctcactgcagcctcaaactcctgggctcaagtgatcctcccactcagcctcctaagtagctgggactacaggcatgagccaccatgcccagctaatgtttattatttttttgtagagctggagtctcactatgttatccaggctggtttctaatttctgacttcaagcactcctcccacctcagcctctcaaagtgctgggattataggtgtgagccaccatgcccatcctcagctttgggtgttttatatctagaaagctgcatttggttctttttcttttcataatgtcttgttcttatgattatgattcctacttttatatttacttggttttaaacatatacatatatatatatatgtacatatttctgtatatacatattttagagacaagatcttgctctgtcgcccagtctggagtgcattgttgcaatcatagctcactgcagccttgaactcctgagttcaagcgatcttccggcctcagcccccccgagtagcctgggctacaggcgtgcaccaacacacccagctttatctgatatttttttagatcagtgttctaagttcttggtcgggctagtctgcagtcacttgatttctttctgttgactctagctggattgtttcttgtatgttttgtaattttatacggtgagctcatctttagtttattttgtttttttccaaaagaattcgatgtggcctgagtttggggagtgttccaacagagtggtttcgtgtttgcttctgccatttacctcaggaatatcataagcttgggattttctgtacatttcttggcttggcagtactcactgagtaaattcagaccccataagtgagaggtacagctatggggtatgggctctcactggagacttcttttatt

SEQ ID NO: 44981 - DNA, 1046 bp, Homo sapiens
ggtgcatgcctgtggtcccagctcctcaggaggctgaggaggttggattgcttgagcccaggaggtcaaggttgcagtgagccatgtttgtgccactgaactccagcctgggtgacagagtgagaccctgtctcaaaaaaaaaaaaaaaaaaaaaagaaagaaaaaaaaaaagagaaaaaagaaacattcaagtgtctaagtcttggctccatcttcctttctccctcctcaggttacttccaacttgggaaagatgatcttgaaagaagagatggaaaagtcattgccgatccgaaggaaaacccgctctctgcctgaccggacacccttccatacctgtgagtgctgtggagggggctcagagtcacctggccagagatggaggcctgactctgtgcatctgttgacttgtgacacatacaggatgcaatccctgacccaaagcacggctgctctcttgggagcaagaatcccagtcatggaacaatgtcagatgataaatgagagaatcggctaaaatagaattcagcaagtttggtttaatttaacaaccatttattgagcgtttaccatgtgctaggcactgggcatataagcagggaaaaaatctagtcttgtcctctggtagcttgctgttggcggggaaactgtcatggaacgtgggatttcgatgcagtgtggccggtattgtgatcaaggtgcgcggggtgctttgggagcacagcaacagggcctgggaggccaaactgaggggttttgttgtggttgtttgttgtttgtttgtttgttttattgagacagggccttgctctgttgcccaggctggaatacagtggtgcactctcagctcactgcaaactccacctctcaggctcaagcaatcctcctacctcagccttctgagtagctgggattaaaggtgtgcgtcaccatgcctggccaatttttaaaattttctgtagtgacaaggtctcacaatgttgcccagactgggctcgaactcctggactcaagcaatcatcccgccttggcctcccaaactgtt

SEQ ID NO: 44982 - DNA, 1030 bp, Homo sapiens
cgaggtgggaggcctctgcgcgcttggccaggccgaggtgggaggcctctgtgcgctgggccaggccgaggtgggagaccctctgagtgctgggccaggctgaggtgggcggtgggcagtgggcagcctggggctccctggattccaggcctttctgcctatgctcttcccagtcctgacactgaaagtggcagttcgggcgagaggagcaaacaggacgggcactgtggctgtctcacttagaacactccaccatcccagcgctcctgttcccagttcactccacaaagatgggcctgccatgtgccaggctctgctctagatgctggggacacagcagggattcatactgacaagagccaggcatggtgatgcgtgcctgtagccccagctacgtgggaggccgaggtgggtggattgcttgagcccaggagatggaggctgcagtgaactgttatcgtgagaccgcactcctgcctaggaggcagagcaagacactgtctcttaaaaaaaggaaagaaaactcgacaagaatcctagtgggagaggcaggaccatcctgtgatgggtcaataatgacccagtcatggagcacagtgatgcaggaaaaggggttgtgagtgccaggaaggctagtttcgaacaacgtggcaagggaagcaggcctgtgagaacgggccctctgagccggaactgagggaggagttgagcctggggctctctgggggtgcagtgttccaggtgggggacacagctctgacaggcgctctgtccctggcctcagtaccccccaggcatgcggcaggcaggggacacggctctgacaggcgctctgtccctggcctcagtaccccccaggcatgcggcaggcaggggacacggctctgacaggcgctctgtccctggcctcagtacccgccaggcatgcggcaggcaggggacacggctctgacaggcgctctgtccctggcctcagtaccccccaggcatgcggcagcaggtgttccagttcttcagcaaggttctggcg

SEQ ID NO: 44983 - DNA, 1427 bp, Homo sapiens
aaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaaggtgctggcagcagagatggagaggttgggggtgggggaagggtgggttgacggctggggggtgatttgggggctcacatgcatgtccctgaagttgtatcctcatcccctagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggtgggtgcccagcccgggaaggccggccagcatcttcagttgctggcagccctgcctgtctttggtggccagctcccctggggttccacgttgctagggacccctgctggccaccctctccccaaggctgcagctgatccccaggggacttcttgccctccagggaagtactggttttgctgcctctgtccataaaacccccaagataactgatccccagccacagaggttccacaggagaggggaagggcccagtttcaggacacattgaggaagaccttgaagctccttctccactctctgagacttcactcccctcttccttcaggttacccagtgccccgtctgatgaggcttccttccctggcaaggaggccttggctgccttcttgggctggtttgattactgcgaccacctcatcacagaggcacacacggtgagcaggggcgggcggaggccgggctctcatgctgttccctgtaccatctccatctcgaggaccaagtggagcagggacatggaaacatggggtccaggagctaagcggggccccaggcgggccgggaccctctcctgtggcatcaggcgccgcgcaagaacacggttatttctcagctggaattgtaatgagggcaaaacacattggcgctctctggcacccaggtggttgcggacgccttggcgaaggctgtggctgagaacttcttcgtggagaccctgcagccccagctcctgcacgtgtaagtgtctagttccctcaggcatgactgtggtctacagtaaaccacctaccccacccagcctcgtcctgtccctaaggccagacaccttcttgaccagaatcccatttgtggaccccattgggtgatgtttgccagg

SEQ ID NO: 44984 - DNA, 1099 bp, Homo sapiens
gtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctt

SEQ ID NO: 44985 - DNA, 1032 bp, Homo sapiens
cctctgagagggggcccggcagaaacactctgcaaatatcgaggagagactgctcccagctcacgaagcacaggaggcccagcagggagggccccaaagggggcggggggacatgtagcaagtgggaggaaggacatggagttagggaggcgtgtggagcaagggaaggcttagggctggcttggcgagtacaggaggatccagtgagggggcgtagctaagtcaaggctaaaggatgtgcagaacagagagcttcccgagggcaggagtagtcaagagaggcttcctggaggaggcgggcctggagctgggcttccctgcaggtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcaggtatccctggactgcccagctcctagccccacctctcctcggagaacagggctccctttctccctgcccctgcacccctgtactccccagccctccctggtgccaggcaggcagagtctgccccctgctccccaccacttcactctcccatcaagccagcccttccagtatccaaatctcattattcctgagccctcaggactgtaatgactggggcctgaggatgggcagaacataagcattcagaaatcagcacccagaagtgaagaaggggatattccaggtgtcaggagctatgcaagccaaggcctgggagagggcaggtcctaggaacaggcagttcaagaacgtgggtggatggaggagagacaggtgtttgccttggactgtgtggagcagagtctctggcagtggcggacttctaatcagaccctgcacacgccaaataggttcacactggggccttcagaaagatgagtcgtggccgggcgcggtggctcacgcctgtaatcccagcactcaggaagg

SEQ ID NO: 44986 - DNA, 1072 bp, Homo sapiens
gacaggagaggtgagggaactcagggacagagaggaaagcccccagaggtccccctgagcgtacgcgggccaccgcagcagcccagccacacaccaaccctgaaatatactctattcattctctgatatttatttttttatttttatttttatttattttttattttttgagatggagtcttgctctgtcgcccaggctggagtgcagtggttcgatcttggttcactgcaacctccacttcctgggttcaagcgattcccctgcctcagcctcccgtgtagctgggattacaggagcctgccaccatgcccagctaatttttgtatttttagtagagacagggtttcgccatgttggccaggccagtctcaaactcctgacctcaggtgatccgcccgccttggcctcccaaagtgctgagattacaggcgtgagccaccgtgcccagcccattctcctgatacttattgacatgtaacatggatgaggcggcatcctaaatgcaggtcccagaaacagaccaagcaaagatcccagcccttgaggggcttgctcggctttcacttgcttgtttatttagcagccatgaactgagctccgctctgcgagaggactaaggggcacgtggcctgaatcaggcatgagcccttcactcctgccccccaccccatactaggaactcgcagtccaggagagagacaaggcaggcaccgcccgtgacagcatgagcccaagcgggagccaggcaggaagaaaggcaccccggcctaactgggcatgtgttggtagaggcattcgaggcagggggaggtgcccaggcagagacacaaccccagcccagcccagagtgtgcccaggtgacagcaggtcatttactttggccgaagcaatgggtgtgtgaggacagcaggttgtgggaatgatgtggctgcagagaaaggctggagtccagggggatgccttgagtgccagaccaaggatgccacgagggagctttgcagtctcctcctgggtcctaagccacctgtcagggcatccccagagctgatggtccacagcctcccctcttcc

SEQ ID NO: 44987 - DNA, 1033 bp, Homo sapiens
gtctgtgatcctgttccctttaccaggtcattgtactgtgttgtccctggaggaacagcttctcctcttgtcttgacagtagggctggggttttccctggttcagctggggagacgtttgcaggttagaaaaaggtctcatgcggcagcgtgtgtggctgttagacgctgatggcacaacttccctttgctggcgtcgtggcacctggcctctgggacagtatgaaccataggggctcaggaagaaccgcttcccctccacccccatccctgattcctagtggccccttagattttgggtacatcttccttcaggctcaccttccttcttttcaaagttcctcaagcctgttactcatttgtcaaggctgggcttctcctacaaagccctcaacctgcccagccagcagctgtgaggctgactgaatatttggtgaccatatcaccctttctggtgctgaagctcatgtcagctccattggacagtgttattctgggctcttctcactgtagaggactggagcagaaagggttccttggaaacctgtgctgggaagccctgtttggtctaaggctaagctttggttaactctgggctccagccctttcttcctttaaatagctgatgcacggccagcaggtctccattctcatcctctctttctattctgtttctttggttcagaaatactcttctgctttttttggacgaactcaatggcccgatgttagatattgggtatttttcaatcttctgttttctgacccttccaagaaagtttgaggaagaacatgtactgctttcacgttcatttcgcccattcagatgtcttggcttgaaccttatgactccgtatcaaagtcctcacaacctgtctcagatccctgatgcacaaattaggtcttattaataagtgtgggaaaagagaggagagtccaccttcttggtcaggcccctgaggcatgcatttctaccaaggaatatggacagatgacagaggagaagagcccaaagccaaatttatacatgagtg

SEQ ID NO: 44988 - DNA, 1652 bp, Homo sapiens
accacctatatattatattataccctaaacttctaccttagaaatttctcaaagactcaagatgacacaggtacgtgtcacatttcatgtagcttctgaaaagtgagagtgaaaagcttttaatttttgtatattagaataaaaatagtcttttacttcagggaccccaggtgtcatataagacagtaatttcagaattactgttcgagatcacttagcttaaatttctcagaagtcagacatttttctttgcatttattcttcagggttttttgtttttgttttctcgtttttttttttttttccaaggcagagtgtctctctgtcacccaggcgggagtgcagtagcgcaatctcaccgcaacctatacctcccaggttcaagtgattcttctgcctcagcctctcaagtagctgggatgcagacacgcgccaccacgcccagctaattttttgtatttttagtggacatggggtttcgccatggtggccaggctggtctcgaactcgagctcaagtgatccaccggtcttggcctcccgaagtgctgggactgaagtgctgggactaaaggcgtgagccaccgtgcccagccctcagttgttatttaaataaatcataatcatttaaataaatagaacctgcataaagaggtttgggaataggcacagctgttggcatgggaaccctcaatggtgacagcaggtggtggggttggggggaggttggccacctggcgaggggcctgttggctgcagggagggactggagacctggggtccttgagcagtccagtggcgctcagctaagagagctgctgagtaccatctccattcccgagatgcttgtgaaatgtgtgaggagctatgcatgtgtggaaagtcagatgcaggatggccttcctgaagctgcagtaagtggaacagaggaggggtactgggtgaggccagaggagggagtggcaggaggtgacagagaaggcttcttggggagggactgagccacatcttgaaagctaggaagcgggagagagagcagggtcctggtaaggagagccgtgtgaatgctggtgggatggtacacgtggcccagagtggctgagagggagcagcaagtgaggtagctggaaatgtacgttgggtctaggagtcttgaatggctcgggtgtctaaggtacgagtgttctcttggaactcagagctgtttccatatcagagacttgccagcagccctctgtcttggggtgcagcctgccagcctgctctttttttttttttttttttttttgagacagggtctcactctgttgcccaggctagagtgcagtgggtatgatctcagctcactgaaacctcccctcctgagctcaagcgattctcccatcacagcctcccaggtagctgggactccaggtgcacaccaccacacctagctaatttttgtgtttttagtagagatggggttccaccatgttggccagcctggtctcgaactcctgacctcaagtgatccacccgccttggcctcccagagtgctgggattacaggcgtgagccaccgcgcctggccagcctgctcttatctggagcaactccatggccccacgtccatgtcctctgtaccagtccacttcctccagcctcctgccacct

SEQ ID NO: 44989 - DNA, 1230 bp, Homo sapiens
cccaagtagctgggattacaggcatgagccaccacacctaattttttttttttttttttttgtattttcagtagagacagggtttcaccatgttgtccaggctagtcttgaactcctgagctcaagtgatccacccacctcagcctcccaaagtgttgggattataggcgtgagccactgcactcggccatgttggagtatttttttactggtgacatttatctagattggctggtgtctgcttgatttccacactgaaaaaaggtgggttttctgttgttgttgttttacaaaaactgaatggggccaggcacggtggctcacacctataatcctagcattttgggaggccgaggcaggcaaaggccgacgtcgggagttcaagaccagcctagccaacatggtgaaaccccatctccactaaaaatacaaaaattagccaggcatggtgacatgcacctgtaattgcagctactcgggaggctgagacaggagaatcgcttgaacctgggaggtggaggctgcagtgagctgagatggagccactgcactccagcctgggcaacagagtgagacaatgtctggggaaaaaaaaaatactgaatggataaactgaagaagttatctttctttccctttgtagtttcaggagatactttgagactatgcaaatcctgtttctccttgtactttcatcccctaattttagcacccatctgtagaccctgcttgcaacaatgatgactgtgatgtttgactaatgattctctatttccctcttgtacatttatttattggaattctttgtaagcaagagctggccctgcttccccatttatttatgcatttggttattcataatcagattttgttctgtgggttaaagttgaataatattttttgaggctcaaattgttctagctttgaccattttgggagctccttccggttgtctcctgtgttcttctggtaagcccctgccatttttttttttaagtgtttccttaatttcctttactacaaaatattccaggctcatcttgtaacttcgctgccccagccctagagtcaggcacttctccacggagtcctgctttcctttattggagaatgctgtttagaaaccaaggtctggttgctaggtatgttcattgctacagcagttatcattgcttctgggtcctctcagcagacaaagctaggaaacagataattcagcacctatctgta

SEQ ID NO: 44990 - DNA, 1079 bp, Homo sapiens
gggtttcgccatattgaccaggttggtcttgaactcctgacctcaagtgagccactgcacccagccaggaaaatcttgtgttttatcttagaacacatcttccatttcattcttgggttcccctctccgggaatacgagttatccttttgttagtctctttgtcttctcactgtttttggtttaagttttcttgtccatctgcattcactgtgattatctcaaactttccttgagccatttatgcctagtgttccattttttgaacaccaagcatataggagttaatttatatcctgctcaaggtcatcgccaaagtctgattgcaaaaattcaaaaacttgcaacctcaggcttaaatgggttaaatgactggcagaattttgttctgtatttgtcataatgtattggttcttcagtgaggttttattcctcttttttagtaagcctgcatcctcttttggtctcacgttggttataatctcatctttgagctctcgtctcgtggaactgatgttttaatgaggttattcctccgtgtggagcagtggtgaggaacagctttctctggagttgtggtttacctgtctgtggcttgctttgcctgccgtttcttttcctcttcctcatgtgagtgcagttctgctcacatgttctgttggctctaaaataagaaaggaactttcctctccaggtttgtccccacctctcagctccaggagtgctaaggactgggtatttatgacctgttttctgtagcctgaaggaatgctagctgtgtggtgaggtgggtctgtcctctattcagggatttagtccctgcagtgtggctctgctcacttccttgggagttgtattccttttccgttagaagagaaggcacacttggccaggcacagtggtttccgcctgtaatcccagcactttgggagaccgagacaggtgtgtcacctgaggtcaggagtttgagaccagcttagccaacatggtgaaaccctgtctctactaaaaatacaaaaattagctgagtgtggtggtgcatgcatgtaattccagctactcaggaggccgaggcaggaga

SEQ ID NO: 44991 - DNA, 1044 bp, Homo sapiens
tctggaccaagtgaagggtgacggtaggtggaattccaattatgggcctctggatggtaaggcaacttctgcgcttccatagagggttccagaacaggtgtcttgctttttcctatgtctccctcccacctccccaagggttgggtctggcgccttagacacagaaggagggcactaaaataattttacttatttgaccctgaggcaagtgcaccctcaggcagagagactccagcccctctccagcaggaagagctggcctgggggcgctcccaagccacagcacacttcgttttgtctccttcccacttgtctttctgcccctgaaaggtgtccatccttacttgagggcagctggcctgacaccctggggggactggagtggctctccaggggccacacatggaatggaacctggcgtggggcttcctcctgcagctggggccatgcgcgcggacccctgcccggcctccccgtcccagcggcgtcaacagctgtgtgtgtttccctcttctttctttcctctctaataccttttacaaaccttttccccgctaagaataacttgtagttaaaaagaagacaagactccactggagcagaaaactcccctttcatgcctgccaaaaggccggggtcacttggacttaagtgtcactcgcagctcctagatcctccccaacccttgcgggtgagtgcatgtctcaagcgctggccaggcaggggggctgtgctcgctgaatctgcacaccccatggagacaggtctagacctgagcctggatgctgtcttgtgggcgtcagtgcccagtgcagcacacgtcctggaggaaagagcagctgtgctgcaggggagaaaaggtcacctgggagaagcgaaggtggtcctgtgggctcattcttctgatggtacaacttgaaggtgcctcttgcctagcactccaggctgtcatagcagccacctgaggggccgaggggccgctgggtctgggaaaagtaaatgcttcgtagatgctcacctctaggtgagtgccagccaggcaaa

SEQ ID NO: 44992 - DNA, 1885 bp, Homo sapiens
ctctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgttgagaatcccacgggtgatcatttgcaataaatgtggatgtaatgaaggctgttgaacacaaggtggcgatggtgtctcactgacgtacaaagttttgttttaccaggtctggtttaacatttgactgggattttagaaggttttttttgttgttgttattgagacagagttttgctcttgtcgcccaggctggagtgcagtggtgcgatctcggctcactgcaacctccacctcctgggttcaagcgattctcctgcctcagcctcccgagtagctgggattacaggtgcccgccaccacgcctggctaaattttgtatttttagtagagatggggtttcgccatgttgtccaggctggtctcgaactcctgacctcaggtgatctgcccgccttggcctcccaaagtcttgggattacaggcttgagtcattgtgccaggccaagaaggaaacttttgtactctcttctctt

SEQ ID NO: 44993 - DNA, 1076 bp, Homo sapiens
cggagggaggctggggccgggctgcgcccaccctaggagggctcggaggggtgtagacagagccgggcggcagcctccgagagcagccacccggacccggcgttttctgctgcacctggtcaggtgcctggccgtcagtgccaagttccctcccgaagggttcagggtgcagtggggacttcttctcccaccgccccgaagggcccggatccctgtctttttttctctttaagaaacgactcgggggaagccatcgggggtggtgtgagcagggagtcgactcttccaagtaagatatttaagattagatctttcttgacgtccgccccccacccttttttaggacgtataccatgtgccttttgacccgctttctctagatcattgcaagtcactgctattactggaataaacttagtatgaacaagtcagataaatccattatatgatgtttaaaataagtttacggagctcttgacagggtaatggtattttattttccctttggttataaagacttggagaatgacgttttctgattcatatgtgtacctgcgttagatttctgttgttgttataagaacaaaatgtaaagggctctttgctctctaaatcttgtagagttttaggttatagttgtttctccctttaaactaagaagatggattacacataaccactaatttatgtgctgcttttattcagccgtaagtcttaggcacaacccttctctctgagattaacaatcggtttgaaagcgctattttgtaagaagggaatagacttagaccagctgtgttagtggcctctggatgcaggggttagcgtgacagtggggaaaattattaagatacttttcttctttttcattttggtattagaaggagaaaggcaactaatactagtgacgggaatacatttttaaaaggtgaaacgccttattgcatgttcagggagggggaagaattttagtgtataacttaggtttcccccctctctccccaaatcagcctcataaatgttaattatctgtactacataattataatgggatttttgagatttatctgcttagc

SEQ ID NO: 44994 - DNA, 1050 bp, Homo sapiens
caccataacatgccataagatcaaaagaagattaaaaatcttaaatgacccttaaatatagtaataaatattgtaaaataaaatgtaataaaataaaaaagttaaaatgcaggggctaggggcaggcatggtggctcacgcctgtaaccccagcactttggaaggcccatataggcagatcactgaggtcaggagttcgaaaccagcctggccaacatggcgaaactccatctctactaaacatacaaaaattagctgggcatggtggcgggcactgtaatcccagctacttgggagtctgaggcacgagaattgcttgaacccgggaggcggaggttgcagtgagccaaaatggtgccactgcattccagtctgggcaacagagtgaaactctctctaaaaaaaaaaaaaaaaaaaaagcaggggctggtttattgctacgcatgcttattattaaataaacactgtcatcatatcctgcaggatgcaaatttgttctttaccaaaattaattaccgaatattgtgtacttttaagactgctcttaaataaatgaaatagaaataatttcaggtccttagaatgtatggatttctctcctatataaaaacttcggcataagagcttgaccacagcatttgtggcttcatgatgacttatggtgcttttttcagggttttccagagtttgaaatagttgaagaaaatgaggtgtcacgtgtgcatagctaaggtccattgtaacgggtactaaaccctggtctgatgctatcttgtttagtcacagctgtctgcatttattcacagcttgaaagctttttcagaggtgataccacaccccagctatttttgtttctgtcatttcctgttaactttaaagtgtacctaattgttctatttgagcaaattttggagaagagtgggtatgtgggagaggtttgtattttaggtgtcctttaaatagcagctttcttaaattgaaggatgtggctgggcgtggtggctcacacctgtaatgccagctacttgggaggctgaggcaggagaatcg

SEQ ID NO: 44995 - DNA, 1107 bp, Homo sapiens
acaccggcagtaccacaaatgtgagtagtagtgccttatgccgtgatgttaagacaggtgaaaacatcactaggtgatagaaacttttcagctccattataatcttacaggatctctgtcatatatatatagtcttgtagactgaaatattgctatgtggcacatgactgttttctaactttagtcttagatattgaaaggatttaaggctgggcgcggtggctcacgcctgtaatcccagcactttgggaggccgaggcgggtggatcatgagttcaggagatcgagaccacggtgaaaccccatctctactaaaaatacaaaaaattagccgggcgcggtggtggacacctgtagtcccagctactcgggaggctaaggcaggagaatggcatgaacccgggaggcagagcttgcagtgagccgagattgcgccactgcactccagcctgggcgacagagtgagactccatctcaaaaaaaaaaaaaaaaaaagaaagaaaggacttaaacctaaaatgcttaagaagaaaaatgatgaaattttccttttctatagtatagatagaattttggaagtgatgtattcataaatatttgatgagttcctattacatggagcacatttctggttatgcttagaagggttaaatactacttgaaaagtactcatgcggtgtagcatataatagcctctcaaaaatgtcacagaaatttagaactatatagtgacctatgactaatcccactgcaaaaggagcaggtgactaaattgtagacaatacctggtgtgaaatgtttgttcccttgatctataaattgataatcctttaatgtttaatctgactgtgactagtggcctgaagaggtaagacttttgtgtttttttatgtgtgtgcctacgtatgtttttttcttgtgacctaaggctttgtggaagtttaaaatagagtgattttaatgaatggctggagtaataaagatagttggtgggcttctccatggaagcaagttggttatttttaactactttgcactgctttatggaaaacatatgccactatagaagttattgtttctgttgactgtgactggtggtggttatta

SEQ ID NO: 44996 - DNA, 1076 bp, Homo sapiens
acatttgttttcagagactcaaagtttattaatctgccacagatccctttactgataggtagattgctatttatagtgtttcatatgctcatatgaattcttgctaccagtatcttcttacattggagatagtagttgtaatgaaaacatccctcctagtagagcctcaaagaaaaggtctttgttattaaaagaaattttagaggataatcacttcttaaaaagtccctctgtcaaaagtcagctgcaagagggcaagatacaaatccttccagcccttggtgacttactggaataaacactttaaatcagcagctaattaccaggaagttttaaatctactgttggtggatgtttaaattggtgtaagttgagcatggtggctcatgcctgtaatcccagtacttttggaggctcaggtgagtggatcacttgagcccaagagttcaagaccagcctggtcaacatgttgaaatcccatctctacaaaataaaacacaaaaaattagctgtgcatagaggcacttacctatagtcccagctactcaggaggctgattgaggtgggaggatcacctgagctcaggagtttgtggctatagtgagttgtgatcaccactacactccagcctgggagacatagtgagaccctgtctcaacaacaacaacaacaacaacaaagatgtgaggtatttgaagagcaattttgtaatatatttataaattttaagtgcatgtccccttgatctagcaatttcatttgtaggaatttattatgcagattgtgttactttttaaatgctgcataaaaaattatcacaaatttagtggctaaaaagaacacatttattatctcatagttattgtaggtcagaagtccaggccacagtgtggctagattctctgtataggatctcactgaaatcaaggtgttgccagggtttcagttctcatctggggcttagggtctttatccaaggtcacttgttggcagtccttgtaactgtaggattaaggtccctgttgtcctgttagttgttgaccagggatgactcttagcttccagatactgcttgc

SEQ ID NO: 44997 - DNA, 1049 bp, Homo sapiens
agacctccccccgtcgcactggcttctccttccccacccaggagcctagaccccagacccaggtgaggtagcctgcctccaccagagagtcgacctcctcctcacccctcatcccccacccccgtgacttgtccacacttgggactccttcccagacagccctgggacataggagtggggtgacagggcagaagctagtatggcagccccaccctggcctgggggacctcaacctaccgagctctagccgagggagctctagatggaatcccaaagccggcccaggctcctgaccctgggtgttcttggttcatccatgctggcgtccagaaacccaggcactgaccttacttgggcctcagttttctggcccctgtgaaatgaaatagtcacagcaggtgtccctgtgccctgggggtttggaggctaagatgaagccgtttgtaaggcgtgctggcaggtggactgggaacgcccattttgggcctcctccctcaggcttacatgtacccatcgtcttcctccctctgacatccctttcttcctgtcaactcccagaatcttggcacccctggtccagctctgtcccactctcgaggtcccagccatcccctggacctggggacctcctctcctaacacctctcagatacactggaccccgtgagtaccatctgagggctcttgatcagacgtggggggggtcactggcaggcaatgccccatattccaccctcccccaagtccccacctgtggatttgggaaacttctaccaggtagcccttgtcctcgaagagcttatggtgatttggggcagggaggaggcgctggtctgtgatgttcccaatccctcctggcagctatgtggccttgtggccttggtctcctcattgggtttctagccctgaggtcggtgcatgtataattgaagtgtggaactggtggaatggacaggaaggcaccaggtgctcagaggaggcgagggttcagtgcttagggcccagagggcaggaggcaggcctgggaaagactacggtgagcacaggctg

SEQ ID NO: 44998 - DNA, 1054 bp, Homo sapiens
attgctcagattctttggtggttgagtgtgggaagtgtagctttgcccatctaagcttctgccgctagggggcaggaaggaggagagcaaatccaattccctctctgggctcccctacagaactcccctacagttctgggcactgccggcagggggcaggccctcacccctgcatccctgttaaagaagggagtggggaaagctcttcctgcctttcctctttcaggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggg

SEQ ID NO: 44999 - DNA, 1075 bp, Homo sapiens
ggtgtctttgtccccccggtgtcgctgccctggcccgcaggtgggttggggggccccctgccgcccctctgccccttcgcccctccgcccctccgctggccgaggggctgcgagggccgggcggcgaagatgcgtggggcgcggaaggggccgagcccctctttggactgcaagtcccgtctccctggcaacggcctcggccttgggggcgggcgggaggaggagaaaccgcgcgcctcagtcctcccttggtggcctcgccgcggctctgctgggagacccggcgctggcggctgctgaggccggagcggagggcccgggagcgtgggagcaggagggtggcgcgcagccggtttcgcgtttggtcggccagggagctgccttcccaccagccggtcgaggaaacaacgggtcgggcttccggggagagggcccacacagtctcctcgccggcaccggcctcctccatttttccgggccttgcgtggagggttttggcggatgtttttgaacgaaggaatgtcatcggggctctctcgagcccctcaccccgccagctactctgggggtggcgtggcatagtgagaggagcgctaagttgttgggaggcctgggtgtgagtagcagttttgtcactacctggttatgtggccccgggcaagtctcttgatctctctgagcatcagtttccttgtctgtaaaacagcatgacagtatcatgcaccactaggttattgtcagggcaaactggaacaatgtaatttcttgtttcatttctttcttctctatattctctccatccattgctttcattcattcttattacccacctccctgttttccgaaatatccttacttaagattctccacttttccgggtatagatggaaatttcccttataagctgttaatttctttctttttggattgaagccttttccccacgactctgaaagaggacagcgttcccaatgtcccagtttaagcgccagcggatcaacccgcttccagggggacgcaacttctcaggtgatcactgttctccctacctggcctcatcctgggaagtatgtgc

SEQ ID NO: 45000 - DNA, 1024 bp, Homo sapiens
ctgaggcagcatcatcatcctcagttttgtgtggccttgcctctggcgcaggctctctagaactgcagggcctctgcgtgccctgcaccagagcttcagctctgaaggcagctggaggtgtctatgcagaccctctcccctggggatttcagtacagacgttcttcccttctgtccccagttccactgtgcgtaccagctggccgactggtgtctccaccacatctgcaccaactacaacaacgtgtgccgcaagttcccccgagacatgaaggccatgtccccaggtgagcatcggggccagtcctggcagtacctgctgccctccccttaggggtgcacagctcccatgtaatcccagggaccccgaggctgccagtaatccttgaccttggggctgggagcagcctgcaaaggagcctccagccaagccaaggggccccaggaaaagtgctggcctggagggcaactcaccctgcctctctgggcttctcattctcagaggtatgaagaggatactggactaaagttggtagatttcagacttttctggacagaataccgtaagaaatacatttcatcttgtgacccaggacacatataggaaaatatatacatctttctaatgctgctcatggcccactaaattgatggtacaacccaggaatgggtacaggccacagcttggaccacccaggtctgggcatcctctgaggcctcctgtctcttcttgattaatttcttaggccctagaactcaacagaaactgcacaggctccagggagaggtgtccctggcctccctgaagggtctgccactctttccatggggtcctctctgggctccctccagtctgccgtgaccctcctccctgctgccgtgtttttgcctcatgctgccaagtctccaccccgatctctccttttcactactacaacacttttaaaaaaaaattatttatttatttatttttttgagacagtcttgctctgttgcccaggctggagtacagtggcacaatctcg

SEQ ID NO: 45001 - DNA, 1049 bp, Homo sapiens
gatccagggagtcagaccagaggtggggacatcttttcaaaggcaagaagatgctgccagtgcgtgtatatacatatgagggtggaaggggtaaacccagggtgtgtctttaactgaagaatcaagaaagctgctttccttagtcacccgcctctgtggttcgtttgctaaacgttggcttgcgttagcctgattcacagtaatgtggctcccaaggaagattcacatggtatttgtgaaaatgtagcttcatcccctgcccttcattgaatgactgaattacagtcagcaccacataacgatgtttcggtcaactatggactccatatgtgatgagacagtgatcccatagattatagtggagctgaaaaattcctattacctaggggcatcacaacgcattgcatttcgcccgtgtttgggatgatgctggtgtaaacctactatgctgccagtcatgtaaaagtatagcacacacaattagtaggtaatgcttgcaaataataatgaaagactctgctactggtttatgtatttactatgctatactttttgtcattactttagagtgtactcctacttttttttttttttttttgagatggagtttcactcttgtcctgtaggctggagcgaagtggcgcgatctcggcttactgcaacctccacctcctgggttcaagcgattctcctgcctcagcttcccagagtagctgagattacaggcatgcaccgccacgcacggctaattttgtatttttggtagagacagggtttcaccatgttggccaggctggtcaccaactcctgacctcaggtgacccgccctcctcagcctcccagagtgttgggattacaggtgtgagccaccgcccctggccttttttttttttttttttttaagttaattgtaaaagagcctcaggcaggtccttcaggagggattccagaagaaggcattgcgatcacaggaggtgccagctgcattgggacaagatgtggaggtggaagacagtgatattgatgatcctgaccctctgtaagcctag

SEQ ID NO: 45002 - DNA, 1031 bp, Homo sapiens
gtgtggggagaagggttatctgtgaaaggagttagaaacctcaagtgtacataagtaagactggagatctctctgttaatgaaattgtgcttaaaaatttttttttcttgaaccttggcttctcaggcaataactgaattttaaggtgtgtgtgtatatatatatataggtatatatatatataggtgtatatatatatatatatatatagtgtatatatatatatatatatatatatagtgtatatatatatagtgtatgtgtgtgtgtgtgtgtgtatatatatatatatttgggccaggaagggtgaagtgttaaattgccttacttagaaaattaaggtagatttgtatttagcccttagagcttcaaaaatatcagctcagaaatgacttttaattgtgcaggtgataaaatcacaagaaaaaaattcatctacaagttggaatgactcttagctacttatttgtttttaaatttttttttcaaattttggaaggaagtagagaaggagttagaactgtaatttgctattatgggggttggggtgcagtgcgtattagtacaatgttaggtggtggcaggttccgtttatccttggaattagcactgctccccccacaggcttctgggagttgggagcaggctggttggtgacgctttgcctggccttggataagaactcttgttttcaaattcccttgaggtctcttccaagaatcttttgcattttttctgataaatcaatcataaggaagtttctgaaattctctttcagaccctacaacccacaagttactgcaaagctgggcttctaccagaagtgagtgatttgaaattgaaaacagatttcggatctcacctgagtagctcgagtgtaagggagggactgggagagccacagagaacatttgtcaatccagaaccaaccattcatggtgttgcttgactggagggcagggaaggaaaggactagaagcaaggcgaaagcagatctttctgtagatacacacatataagtcttggatttg

SEQ ID NO: 45003 - DNA, 1066 bp, Homo sapiens
ctgtactccagcctgggccacagagccagactccatctcaaaaggaaaaaaaaaaaaaaaaaagggaaatgctaattctggccggcatggtggtttaaaactgtaatcccagcactttgggaggccaaggcaggcagatctcttgaacccaggagttcaagaccagcgtgggcagcataatgagaccccgtctctatgaaaaatacaaaaattagccaggtgtggtggtgcatgcctgtagtcccagctgttcggaaggctgaggtggaagaattgcttgagtttgggaggttgaggctgcagtgagtcgtgattgcaccactgcactcagccagggcgacagagcaagactgcctcaaaacagaaaagaaaacaaaggctaattctcaggctttacaccgaacctactggatcagaatccctggagctagggaccagaatctgtttattggtgattctgttgcatgcttttgcactattctaaaacctatgtgtgcatacacacacacacacacacacacacactcactctcttagcccttgttaacccttatcgatcctagacaaatgtatggggaacccatcagaggctattctttagggctagtgttcaatttgactgtttttaatatgaaagattatggatcacatttcaaacagatgtgaacgtggagagaataatacgatgtaccgcagtgtgtccatcactgttcttcagaaattcacattgggtcattttgttttagccatctctttccacattatcttctttttgttcttttaaatttcgggggtaatatgaagcaagcctcagctgggcagaccagagtctgttccctttttatatatcccggcgtcttagccgggtactcgtgtctgaatagtgagtaccttttgggcctggcactgggcaggccttcagctgggtcattctctacctggcgatggctttaggtgagttgtggagctcttttcacctttttgcctcatctgaaaatagttcctggccagaagggagaattggtgagaaaagtttcaacattttaagtctcatgctataagtttg

SEQ ID NO: 45004 - DNA, 1089 bp, Homo sapiens
gactctaaattgcagaggagtggtctttgggatgcatataggaaattattttgtaaagagacagaatccagggttagaatctgagaggtgcagcaggagtcagagtggagacttggtggctctaaggtagcacagaaggagtcattatgtgatggaagggcagtgcccactctcataaacctgggctggaagtgtgggtctctgttgagcaggtgtactgctcacaaagccccccaggggcgtgtggccttgtgccactctcctttgtgtagctctttaaggaattccagtggctaggatattttttttttaactttggttttttggaagtatttgtgggtttccggagaggatgcctgtccttccatgttggtgcaatagagaggcatgagtgtgactcccaaagcagctggatggagccgtggtagaggctccccagctccggatttgagaagacccagcagggctgggagaagtgctgcacaggaggctgagggtaagtctcgcttctgttctctggaggcgttggccacactagccttccagctcttgctcacagacttctctccactgtaaatgttctccttccatctttccactgatcttagtctttccagccttcagagttcagctcaaatccccatgctaccataaaaactggctggccctccagagaagacagcttctgtctctgtaactcctttaagctgtaatacactaactttgtcatcagagaggctgaattcaaatcctggctctgccatttgtcatccatatgacttggcaaattacttaacctctttgagcctcagcttccttatctgtaaaacagagataattataatgacaataatcctagcacctcttctggaggctattgtgagcattaaataagataatacacgtgaggtattagtaaacacatggtaagcatttaataaatgttacttgttattagcagttatttgacactcagatcagacagccttatattactaacattttcacatatgatgttctctctttttgtgcagggtataatttccttgatgccatatacattgtcgttttcctgttcaataaatattt

SEQ ID NO: 45005 - DNA, 1030 bp, Homo sapiens
ggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggtaggaaccgcggctgcgcggccagcctgcgccagcgccagcgccgcgcgcccccgacacttgggctcgtgcccaggcgccctctccgccgcgctccctggtggccgctcgctagagcacgcgcgccgcagacctagggtatttgcggatcagcgtcctcgcccatctcatcctccacactccgcccccacccacctgccccagctgctaagggtcttgacctttttcagaaacgtgcatcttttccagttctaattttgcacgcttgcacgtttaaagcaggagggatgaattcggtagtggataaatcagcaactttaggatagcttatgcagaaacgcgtgtattctctacttttccggcagtgatcggaagagctctcaaaattggcttcagcccaaagggctcagatgggaatggccaggtcagccatggagtttccccatgcatgtttgtgtcctgttgagacgtgttctaagtccactggtctccgtgcgtgatgtgcccaggaagtgtcctattgtcttactgatcttgtatgttcatttgagaatcgcttagatttaaaagaaaaagggggtgggacggggggctgggagtcaggtgtcagcgaggtttgcagaagtggagggagacgggaggaggccagggggaaggggtagcaagtggtttgcgaaggaagttgctgtttgcaaggatgagtctggggagattctctgtgtctgtttcaggacaccatccagcagctggaaaatgagcttcggggcacaaagtgggaaatggctcgtcatttgcgcgaataccaggacctcctcaacgtcaagatggctctggatatagaaatcgctgcgtaca

SEQ ID NO: 45006 - DNA, 1730 bp, Homo sapiens
gtaattctatttattcaaaggtagctaccacaatacccagaatgtaatgaagctcagaaggcctagtgaaatttttactatgtcttatgttcttggattttctccttagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaa

SEQ ID NO: 45007 - DNA, 1134 bp, Homo sapiens
aggccaggaatgcaacaaattcaaaaccactgcttgtcttgatatcttaatgtcaattatttataatttctcatcctggagacagtgagaagaagaatagaatgaatcagcaattttctttgcaaagctgtgcagagaataaaaagtatctgcctagcaggggcgagaaagaaaggtatatattctttactatagtacttaatttaaaatcacaaactggcctacccttactgattttgttattttattattatttttttaatgaccagaccacagtccagtaataggtgctctaattaggcagcagtttatgtgaggcagcgtagctcttccatggctgcgagaaacaaagtgatgttttgagtggcatcagaacaagatgttgcccgcgagtggtggtgctgcctgcattttatgtctggcattgccacttatgcaaatctcaaggatctagtctacaggatctagtctcttttcatccacggggccaaataagggtaaaagaatgcaatggggccaggtgtggtggctcatgcctgtaatcccagcactttgggaggctgaagtaggtggatcacctgaagtcaggagttcaagaccagtctggccaacatggtgaaaccacatctctactaaaaaaaaaaaaaaaaaaaaaaaaaaagaatacaaatattagccaggcgtggtggtgtgctcccgtagtcccaactactcatgaggctgaggcaggagaatcgcttgaacatgggaggcggaagttgcagtgagccgagattgtaccattgcactccagtctgggtgacagagtgagactccgtctcaaaaaaaaaaaaaaaaaagcaatgagattacaaatgttcagcaggcttcaggagaaatgaagtatttgttatggatggctggggtctggcttatttgcaaatgaaaatcttactctggggctataataataataaagttttctaagatcccaaagctaaattcatgtagggtcctctcagggattgaacagtatatcctgagaaatgtcttctagctaaagtcagggcaaggcagagcgtcccccttaataggagtctggggatgtatttcccttccaggaaagagaggacagtgataatagcttccaaagcg

SEQ ID NO: 45008 - DNA, 1017 bp, Homo sapiens
ccgtatgtctgtggtcaaggaacacacagtttgttcttcactaaatattttggctgggcaccgtggctcatgcctgtaatcccagcactttaggaggctgaggctggaggattgcttgagcccaggagtttgagaccagcctgggcaacatagtgagaccctgtctattatttaaaaaaaaaattagtagaaagaaaaatcgttttccccttcctcaaacaggtaaaatcacccagaatatgcctactctccgtggacattaaaggacataataagccctttgggagtcctttgactgatttataactacaccagcatacctccggaataatgggggttttattgtcaagctttataaaagtgttttttgagaaattattttgaggcagagatgtggatgagcacgttaattgtgtttttccaagtaatgtttgggccatgtcctctcagagcctgggctcactcaaacgattgtctgaatgctggcagccacttcccaagcaagagacagaagtgggctttgtctttcagaaagctctgtgccattgcaaagccactgttgttcgaatgggttcatggtcattatccaccttttcccaaatgtgccgtttgctctcatatttccacagctgattaaaccctgtcactatccacatcagataatagttggaccccaaagatgccctctctttaaggatcgtgtctttgtctttttttttttttttttttttttttttgagaaggagtctcgctctgttgccagggtggagtacaatggcgtgatctcggctcattgcaaccttcgcctcctgggttcaagagattctcctgcctcagccacccaagtagctgggactacaggtacatgcaaccatgccaagctaattttttttttttttttttgagacggagtctcgctctgtcacccaggctggagtgctgtggcgcaatctcggctcactgcaagctcagcctccctgtttcacgccattctcctgcctcagcctcctgagcagc

SEQ ID NO: 45009 - DNA, 1142 bp, Homo sapiens
gatgctttgattagtaaacctgttacaggttgtgtgtcccttatggaaagtacttgagaccagaagtgttttggattttgtatttttttcagattttagaatatttgtgtatacatactgagacatcttggggatgggacccaagtctaaacacaaaattcattggtttcatatacaccttatgcacgtagcctgaaggtaattttgtacaattattttcaataattttgtccatgaagccaagtttgtgtacattgaaccatcagaaagcaaaggcatcactctctcatggcaacgctctaacagtttcagattttggagcattttggagttcaggtttctggattagggatgctcagcccttagcaggttctgttgtctccctcactgacccctctgcttttagagaacgaattctctgctttgcctgttcctctttgatcttaaccttggatattttcctctttctcctggatgtttggtatccaggagggcacagagaggtgagcctggaccccgtgttgggtgtgtgtcttggggtcaagggatcctgggcacatgagtggggaagccatttctgagcacctttgaaaaaggaaaagtggcattttcacagcaaatatgggttgtgtctaatctggtagttcccaatttcaatctcctatttacctcttcaacatccaggcgggtgacacacactgtcagtatctataagtatacacagtgattcctgtaccttcactgtaagactgtcagctgccaacccctgacccccaagccccactgccacttctcttaaagtgtgacttaaatgccatcccctggcacctcttttatcctgtgggaatagtcttatcgattcagcagtcatcggttggtcattaatcttccacaaaccacgcactttatcattgcgaaaggggacagagaggatcaggatgttgggttgtgacacgcgagagagccccatctgtccctggctgctccgctgaggtcatggtacagcacagaggaccagatgggatggctagaatctgtgtcctaccctaactttgtttttatccgccactggccagctgcaaatttgctcttgccagcagaggctagggcctggaatgaaagacttcctatactgctggctg

SEQ ID NO: 45010 - DNA, 1090 bp, Homo sapiens
gtcttcaaggttagttcccaacatcccagtttagttccccacagagatgatagtcagcaaatcatttgccgtggcgcagtggcacagtggcacagcggcacagcaggcagaagaaacacccagagttccttaggcctcctagggacaggcctagagcttccgaactgcagaaatcaggccccagaggaatcacacgcagtttttgaactgaacaccctcctttctcattgctatattcatcagatgtttactcagtgcctgctgcatgcctggcactgcaaaggacagttccctgttttgatcattaaaaaaattaaatagaccaggcacatggctcatacctgtaatcccagcactttgggaggctgaggtgagctgatcacttgaggttaagagttgaagaccagcctggcctggccaatatggtgaaatcctgtctctactaaaaatacaaaaattagccgggcatggtggtgcatacctgtaatcccagctacttgggatgctgaggcaggagaactgcttgagcccggagggcggaggttgcagtgagccgaaattgtgcgactgtactccagtctgggcaacagagcaagactctgtctcaaagaatgaataaatgaatgaacgcatgaatgaataaatagtcagaagacttatctccttctttttcacttcgatggtgtgcctatgcgtgtatgttttatactgatagaattccatggccaaactcacctgacctgaggggtggcgcattgagaaagtgtcctgtctactgtgccccacagtagacacacatttaatttttgttttcaattatttgatcagttttccaaaatggttctgaatcccacctccataatgaaagaggtcattgtcaccttgtgtctgtgtgtgttcttggtctcatcagtaacgggattagaattcacactcatattccccacgcctgcccccgtctcaaagcgaggaggagaagggatgtactttttatttggggctttgtgtctggtggggaagcacatgcaggatccactctgtcatcaccaatgctaggggcagtttaatctcaaatgttcttgctgtttcc

SEQ ID NO: 45011 - DNA, 1025 bp, Homo sapiens
gggaggagaggatgttatgacacaggcgtttttgttgcagtgacttgtggataattgctccttattaacactgctaaaattatgttcacatgttttactttgtgtgggagccgatgactcttgtcctttcgttttttgagtattatctttcaaatgagcgttggcctcaaacccgctcattccaaaatgcatcacagatgggaatttaagcctcttcacaaagcaaaccactggaaattcataggtagtatgcaacattggtctgtaactgataatagggcaacatcatttctttggaacgtaattttcttgattccacaagaagtgacaggataagaaaactcatagttaaatgagaacagtcttgttacaggacagttatctcccaggtgtatgtcatcaattctaatttccgtgttgttaccaaagggccttattttcattctgactaacaaccaatcatcagaacacattgaaactgttgctgggtcaagttcaaaaggattccaaaacagtaaaaaaaaagaggaagggcccaccaagagcacagaggtcttcatcgctccagactcccagatacagcacagggaacaagaaatggcagaaccatcatttcatagacaagtggtcaagatgtcctcaaagccgtacagctctttggtggcagaaccaggaccaaaaaccaggtctcctgccctgctggagaagtcctctttccggtgggccgtgggctgcctccactgccacccaccatgttggaggaaacgtaggtggggaggcacattcacaccaattagggttatacaggatgcccagttacattggcaattcaaatagtaagtaatttttcatagtaagcatttcccagatatttcatgggtcacacttattctaaaaaatcttactataccagaaattcaaacttaactaggtctcctatatttttcctcattgagcctggcagtcctaccaccagttccaatttgtttgcttgctcttgctttctccttttttctttttgctaa

SEQ ID NO: 45012 - DNA, 1035 bp, Homo sapiens
ttaaaataatatttaaaattatattttctagtatttcttatctctgaaattataattatttctccattcataattcactcatttagtacatttgctagagtgcctacttataccagctatattctagggacacacaaatgaacaaactctctgtcctataaaggcctaccagctaagcagggaggcagatgagccagtgtaacccagggttctccatgctatcatgggaacaaattctgggcactgtgggtgggaccgctaacatgaagttgaagtttcaaggtagagacatctaagttgagactgaagaaatcagaattaccagttggcagagggtgtagtgtgagtcagaaaaggataggggtggggtagatttggaggaagaggacaaaagaagaaataacatattgagaggatctggagccttggagagaaatggatgtgactttgcatggaagggaacatagattgttggggtggagactggtatgaaatgcagctgggaatgtgtggaagagtcaagatatggaaggatcaagatatgtgtctggaggacattgagactcactggagggctttaaacccaggaggggcatggctagagttttagggtacatggatgatttgatatgtttgtgagtatgacccactgtttaccctacaatcaccagtttccacagttgcaagaggggagggtgtagaaatggctcgggagaaagccattcctattaatatattttcttaaaatccctggatgcatgcagcttactctatgacacgattgattaaataacaccttataaagaatcaggctaggcgcagtggctcatgcctctaatcccagcactttgggaggccaaggcgggcagatcacttgaggtcaggagttcgagaccagcctggccaacgtgatgaaaccccatctctactaaaaatgcaaaaattagctgggtgtggtggcatgctcctgtagtcccagctattcaggaggctgaggcaggagaatcacttcaacctgggaggtggaggttacag

SEQ ID NO: 45013 - DNA, 1030 bp, Homo sapiens
atgttgggggaaagccagcctgggagcatgtgaaaggatccttgcagagctttactgaggccctccatattgagctgcaggagctggagccatgggtaggccattgaggagctgttgggagcagattcaagccgtgtcactctgaagaagtgcaggtgtgaacgtcatgacctgctccagcacctgcacaggcagtggaggcctagtggaggccaagagcattgccgggaccaagtcccaccaggggccatcgtgccagtcagagggcatcatctcagctcacttgcagctgccactgcagacaagtagaacaaactgagaattccacaaaccagccagagtcatatatttgagttaatatatcactttttacaaatgatatcacaaattagtggagaaagatacattatgcaaaaaaaaaaaaaaaaggtttttggagaaagttagctagccatttaagatcccgaagttagattccagtctcacaacttatgccagtgtaaattttagatgattaaacatacaactgtaagagctagaatcttaaaatattaacgggaaaatagaagttttatgtggtagtcatgggagggaggccgttttaaagattcagccaaaaaaagaaaaattgataggtttaaccacccaaaaactgtaaagaacttaatacatagaaaaaaatcgatacagtctttgcactgtgtttgagaaaggatgaatatttgtaatatataaagaattaatagaaattaataaggacatgaagggaatacacacacatacagaaatggtgttgtacatttattgaggatgagtgaaatgcaaatcgaaacatcaaggtttattttttatcttgaccacactttagtgtttgggtagatataaggagacatacattacttatagagaatatgaattgttacaatgcattagaagtcttaaaatttagatatttcaaaaaatgtactccatgattaacagtgattatttctgttgatgtaactcttggtgattttgctcctgtttttgt

SEQ ID NO: 45014 - DNA, 1013 bp, Homo sapiens
atttttagtaaagacggggtttcaccacgttagccaggatggtcttgatctcctgacctcgtgatccacccgcctcggcctcccaaagtgttgggattacaggcgtgagccaccgcgtccggcttgtttgttttttaagacggaatctcactccctcacctaggctggagttctgtggcactgtctctgctccctctaacctctgcttcccaggttcaagtgattctcctgcctcagccccctgagtagctgggattacaggtgtacatcaccacacccagctaatttttttttttttttgtatttttgggagagggggggtttcacaatgttggccaggctggcctcaaactcctgacctcaagtgatctgcccaacttggcctcccaaagtactgggattacaggcataattaccgtgcccagtcagcacttgacttttcttttttaaaaatgtcattaatattcttgccagttgtttgttggcaacattaatattgttgccagttgtatgtaaggacctcctgggagagcggttttaaggagaatctaaagtcagctcggtatttccaacagttcctaaaagagcaaaatcatgtgttccttaatctttaattagaacaatctgcaagtggttcattaattagagaattttgtctttaaaacaggaacctcaggaagtaacaagcaagtaggaaaagatgacccttttaaaagaaattattcttctttagtctatacttattgcatgaccttaaaaaccaggggacagggaaacagcaatgtgttggatcccacaggagagctggttacatgcatcccttctcaaccccacgttcagtgatatcacattagtagctggaaattgaccatggtggaagtctttacaccagggtaactggcaaacatgataaagcaagcgtttttttgttttgttttgttttgagatggagtctcactctttcgcccaggctggaatgcagcagcatgaacttggctcactgcaacctccac

SEQ ID NO: 45015 - DNA, 1033 bp, Homo sapiens
aatatatttacttgcttgttttttattctctcctctagaaggtaagttctgtgagagcaagatcaccattgtattcctgttgtccagctgatcttctctttgtgcaatacatatttttatatgaatggacaagtgattttgaaagacattttacaagacaacctgggcccaagtgttgcttaaaaaggaatcatgtgtgggctaccaatggaaactgctcatttcaaacatggctatgtttgcacttgcccaggcaaccacacctgtgagacaaattactcccatgcctggggcctaggaaatctctttggggaaaaaaaaatgattaaagagattatatttacagtctagagtggagaaaatagtatttaatgcagtaattttctattagactttcaggattggctggggactgtggtacattgcttctgttctctgtcactctgtttctgtgccagaagacacattgcttctcctcattctcttatgcagtgctgtttaagtggtggtccacaaattgttgctggatggtgatgagatcgattaggagtttatacctcaatgtaaattaatgcacttccttccttccttaagaatgtcttgccatgaaaatatcagcatgcctgtggatgtcattgatttaaatgagggcacaagttccgtatttccttgcagatgggtccagactgtttgcagactggccatggtccttgggccacactggaagaagaactgggctaagtattttttatgcctgtgatttaacttctccaataaaccgcagctcttgtaggatatgatggtcgctgtcaggcaaggactagattttcagtgagaacttgatggtggggattgaacgttggctggggagtgcagtggctacctcagtacccggaactccagttgcctctccactcttcctatgtaatgacttccctttctgtgtctcacctgcagaataaaatcttcatctatcggggaaaggagtatgagaggcgagaggacttcagcctgaggttgttaacccagttcc

SEQ ID NO: 45016 - DNA, 1071 bp, Homo sapiens
atagaacttacctagtaaagcgtcacagaaaaaaaaccaacatgcctctggtcaaagcacctgttattctgtctcccctgagggttatacaaactgattggtggaccccagaacccaggcgcactggaaatgaagcagcatctctggggatggcagagccacactctctttagaattagcttctaggggccaggtgtagtggttcacacctgtaatcccaggatttagggaggccaaggcaggtggatcacttgaggtcaggagcgcgagaccatcttggccaacatggtgaaaccgcgtctctactaaaaatacaaaaattggccaggcatgatggtgcatgcctgtagtccgagctactcaggaggctgaggcacgagaatcacttttaaccccagaggcaaaggtttcagtaagccgagattgggccactgcactccagcttgggtggcggaattagcttctaggacccctgcctgacttggtgtgccagaggttgtatggacaactgatggccctgactctacaattaaattagttcaactaagtattcttagttgagacatgaaagcagtacttggcacaatttaatccatgggatagggttaggatgtaacagcatttaaaatacacatcatgcattcagtgtatgttaggtataattaatggaggcagaatttttcattgctgtggtatgtttacagtggttaaatattttttgaatataaactttttggatataaatcaacatttgtcaaggacgcccctgtggagccgcctggagagtgggtagaaattaaaggagccagaggggaagggtgagcagcattaattgggtggcactcttgtgtccgtgtgtgtgtgtgtgtgtgtgtgtgtgtgtgtgtgtcccgggaagagcaggagctttgcactcagttgctcccaggacccagttctggcttccaattggccactgtgtgctctgggcaacatgcttcacctctctgagctccatatatctgcaaagtgagaagaatgcctgacttggccaggcacggtgactcatgcctgtaatcccagcactttggg

SEQ ID NO: 45017 - DNA, 1040 bp, Homo sapiens
tgctcatccacggaagtgccccaggactccgttagatttgcctcatcccacagtccttccccagtttagggccaacctgtattcttggtgtgcacattttcccacatcattgaccaaagtccatccagtccacaagtcctacactgagaagtggccttcccattggccagcactatgtctagcagtttacctttccaccccatccctcccttccccaaccaaatcaaaacgatccctcttcctgaagcacactgcactcattttttgcccttctttccagatgcccctgctaacagaagggatccgcatccatggggagaaactcacagagcagctgaagccgctgcatgagcggttgtcttcttgcttccgggaactcaaggagaaagtagaaaagcactatggggttataacactggtaagcatgatctaagtagccttcacacctttttctaggctctgtgaccttttatgacactgattcgtttttcagatgccaagtgagttgtaataacttagctatggcatggaaatagtgaggctggtgggagagagtgtgttcccctcttggtgaccttgagcagtccttgtgctggtcagaggttctccaacttgaacaactatcagaacctcccagagcgcctgtgaaaatacagatggctgagccatcataaccctggagtttatgattccatagatctgggggtggggcccaagtagttgcaattctgagaagttcccgggtgatattgatgctgctggtctggggacaacactttgagaaccactgtactagaaatcaggccaggtgcagtggctcacagctgtaatcccagcactttgggaggccaaggagggctgatcacttgtggtcaggagttcgagaccagcctggccaacatggtgaaacaccatctctactaaaaatacaaaaaattagctgggcatggcgtcaggcacctgtagtcccggctattcaggaggctgtggcaagagaattgcttgtacccaggaggcggaggtttcattgagccgagatc

SEQ ID NO: 45018 - DNA, 1064 bp, Homo sapiens
gccataccctggctattaagataaaaagatttgtggacattaaaattatgaatatgtcagtaataatccagcacacattgaaatattgacacagattaccataatttgtgcaacatcttataaacaatgtcatttccatagtagtctaaggcttcaccagcctggcccactgtatctagactttaggttcattttaataattatgctttccttctctgtatcatttgggaagttgataaatatcacttccttagataccttcattcagtgatatatctggcttttacaattaaattggaaaaggtaagtttctctttggtgggttgagagttggaccatcaattctaatctacaaaaggaaattcatgatttcactctgacgcctaggatctagccaaggctggtctgcagtatcagatgtccaaactcatctactattagccatattttgtgagtcgtttgtctaaactttgtcaaaaatgcctttgccatgattttgttgctatctggatttcaaacatggacagttaggaagatgtgcattgaagtaggaaaattttgttcagatttgctgttatttattttttaaattaaaaatggaaatgtattttaaagtttattgtgtgtttagtttgttattgcccttaagttgatgaaatcattcctgaacttggcagtttttccttatccatgcctccttcatgacacatcacacctagcatttttctggcttgtttccttacaggtcctgttaggttaaacctgcactgtggggtcctggagtcatctttgcccagaaataagaaaaattacaaaccacttgcttcctttcaccctatctatttttttttctatctaggctgacagttttctgatagcaattcatttaatgtacataggttctgtttctttacccattccccatagatatttagacaggtaaagagagaaataaaaaggttaaaggggatatctaataacttacatgaaaaggataggaactggttctaaaatggttgaatgtttgtatcacctggggagaggccattcccagaccaattaca

SEQ ID NO: 45019 - DNA, 1034 bp, Homo sapiens
cactttttgacctgtcacctaggatacaggagggtgtatgatatgaatagtaataatgcattttgttttcatttatggcaaaaataagagaaagtttaagagcaattaagaaaatataatactgaaagagcaggatgtacctcctttaacaatcacaaacagggttgggctcagtggctcaagcccgtaatcccagcgctttgggaggccgaggcaggcagatcaccggaggtcaggagttcgagaccagcctgaccaacatagagaaacctcgtctctactaaaaatacaaaattagccgggcatggtggtgcatgcctgtaatcccagctactcaggagtttgaggcaggagaatcgcttgaacctgggaggcagaggttaccgtgagtcgaaatcgcaccattgcattccagcctgggcaacaagagtgaaactctgtctccaaaaaaaaaaaaaaaaaaaaaaacacaaacagaagattgattctggctaatgtccttcgagcagtagaaatgaagtttacttgtgaagtctgacttagatggaaaagaaggaaatactatatgagaatggaattggatcagagaatagcatttagaattggaggataatggaagtcttgaatatcacagggcactagaccaggtaatacataagacaaggcgaaagtggcacgccaccctaactttcattctcaaaaacatcactcttagacctttaaaaggctggattcattttgtgtgcttaggcatatgtccaaaattcagggtagtgctgatggtaggtatcagaaagaaacaatcatcttgaagaattaagaacctgagactgcatgtacctaggtggagatcttacctttcagttgctggggataaaactgacttatttagaaaaagaaaaatactgagtcaaaagcaaaagccatctgtgtgtaggaaataagaaacaaaaatgaaaacttaaaatgtgttcatgtatttattcaacaacttttaataactgttctatgtaccaggcactgttctaggagca

SEQ ID NO: 45020 - DNA, 1050 bp, Homo sapiens
aaattatttgacctttctctgcctggtttccttatctataaaaatgtaaagttggtaactacttttagagtaatttgagcattaaatgggataatataaaatcaccacgagtgtctggcacttcagaaatacaaatctttttttcaaaccataagcattttaacatacaagtatgcctacaagcctgttctgatttgttctgaagccaaaaggaactaaattaccttctatttacatggatcattgatggtcaattgctatttgtaaagctttaacaattttgttcaaagagctgatttggggccaggtacaatagctcacacctgtaatcccctgactttggaaggccaacactgaaggatcgcttgagcccaggagtttgagaccagtctgggacaaaaaaaaaaaaaaaaagctgatttgggtctgtaatacacacagcactgtttgttcatatcttctcctcaaaaagacttaacatctgaacgatccatggaactcttactttctaacaatatgacacagcaaatattaagtcttgtcattagaatcatgtgaaaacatttacaactggccgggcgtggtggcttatgcctgtaatcccagcactttgggaggccgaggcaggtggatcacaaggtcaggagatagagaccgtcctggctgacacagtgaaaccccatctctactaaaaatacaaaaaattagccgggcgtagtggcgggcacctgtagtcccagctactcgggaggctggggcaggagaatggcgtgaacccagggggcagagctttcagtgagccgagattgtgcccctgcactccagcctgggcaacagagcgagactccatctccaaaaaaaaagaaaagaaaacatttacaactaatgatctttatactaagatggcaaaaattaggaggcatataaaatgtgagttgtttgctgacttttctgatttagttaaaaataaatctaaaagtaaacatgagctttgttgtataagttaacttattttgcaatattggtatgtacattttcctggtcagaaaa

SEQ ID NO: 45021 - DNA, 1030 bp, Homo sapiens
atcaaaaacactcagggctgggtgaggtggctcacacctgtaatctcagcactttgggaggctgatattggaggattgcttgaggccagtagtgcgagaccagcctggtcaacatagcacaaccccatctgtattttcttaatatattacttaaaaaaaaaaattcagaaaaacccaataacaatacaacaattaaaaaaataaaaattttaaaatacagcatattaactatgtagcatttatattgtacttggtgttaagtcatctagagatgctttaaagcatagttattatgctgtatttttacagtataatgctgtaaaaggaagtttacatatgctctatgcaaatactgtgccattttatgtcggggacttgagtatctgcagatttttggtatccacaggaggtcctggaaccaatttccctacagatactgagggatgactgtgtttactgttaaaatgaaaaaagcatgttataaaacaatatatgtggtcaactactggttatggactgaattgtgtcccttcccaaatttatatattgaagtcctaactcccaggatctcagaatgtgactgtatttggagatttggtctttaaaatagttattaatttaaaatgagatccatagggtgggtcctaatccactctgactggtgttcttataagaggaggaaattcggacccacataaggacaccagggacgagtgtgcattgagaaataaccatgtgaggacacagcaagaaggtggccatctgaaggccaaggagagaggccccaagagacaccagccctgccaacaccctgatcttgcactgctagcctccagaactgggagaaaattagtttctgttgtttgaactacctagtttgtgacattttattacagtagccttacaaactaatacattaccctttgtctaagaaagtagagtacacatatagttttgatttttcagttgaagaataaaccaaagagaaataaaaaactggctatagggagaagggaggagacaggagaga

SEQ ID NO: 45022 - DNA, 1474 bp, Homo sapiens
taaaaggaaaaaaacatactgtaaaaagtactataaaagtcagtatagtggctacccttaagctgttggaaaggagttgtgatcgggaagggctggggaggcccttgtgggctatcttgactgggatggtggttgtacagatgtttgtaaagagtaacctggacatttttgtttcaatttttggttttctttatctgttacattttacagtaagaagtttttggaaatctaataatgtattaaagggtttaggatgaaaaatggcagtcccctacctccccactccttaatccctagtccatctcctaagagcagttgttcaactcttccgctgggttccttggtgcttcatttcctttttgggaataaaatggtatttctatatcttgtcaattttagtatttccagctgacttgctcctctagtagatgataactaagctattcacattatcacccccatttctgtccccattgtgccccgatgttacatcacacactatgattaaattggacgtcagtgcttaaattgttatgaccacgcacacattctctgctgaaccagtagtgctctgcagtgtttatttcatcctcaaggtaatacagtaattgcttgtttgttaatttgactatttggttttttaaaaaacgtaatcaatctggaacattacagaaagtatgtggaatagtataatgaacccctgtcacccggcgttgtcaatggccagtgttgccccatgtatggttccatcactggaccctttcccatccttttgttatttaataatgtaatacttgtttttaaaatctgaatttaacaaaatagaaagccaagttcatttcttaaagtcgaacagtaagaaattttttctaatgattttgataatgtgtttaaattttacttgtggaaataaattattaaaaattcaaatacatgtggataatctgaagtgtgtaataattggtcaaaataatagaacaggccaggtgcagtggctcacgcctgtaatcccagcactttgggaggccaggcgagaggatctcttgaatccaggagtctgagaccagcctggacaacatagtgagaccttttctctacaaaaattaaaaatattagcagggcatggcagtgtgcaactgtagtcccagctactaaggaggctgagacttgagcctgagaggtctgctacagttaggctgtgattgtgccactggtctccagcctggacaatagagtaagactctgtttcaaaaaaaaaaaaggaacaacttaaccattcaagatagttattttaattattttaatgtagatttttcattgtttagtaatcttaaaatatcagatgttattaaatatttaataatgaacctcatctgcatatttgatagtcttaaactttcacaggaaattattttaggatattatcttataaagtcttattttatgaaacttggatccaagtacattgtgtgtt

SEQ ID NO: 45023 - DNA, 1043 bp, Homo sapiens
tttaaaaatgaatatgaatgtttttagttaattttggcagtagttgattacaatatcatctagatctttgctcttggcatatgtggaatccttggcaagtcgttgaatacttctatataccacattgccgggagttacgctcttgtagcttttagtttctattggttaaatcctctctgtatgttcaaataccagatggagttttctcttctagaatcttcgaatgatctctctttttccagttcacagggtctgtggaccggtgatctggtttaagaacttctgctctaatcttgagttatgcctgtgtttacacacttactgaaacttctgtgctggattctaaatttggaagaatcaaggatatttgtgtggtaataatggtgtttagactatttaggagggtattttttcttaccggtcctcttattactttttcctgagataatatgggagggattaatcatctgtaaaataccagacttgacagatttagtgtgttcccatcttttttttttttcctttattaaaaactgtctctcatgggtaaaaacattagaaggatatattggattttgaaccagttgcttattttatactttaatcagaaggaaatttaagtttttcagtagcttgtattaagagagaaatcagagtaggtaaaagggattgggggcaaaattttaaaaattttctaaagatccagaagaacatggttagatctggagcagtgttacttttcaaacctgccattgcaggctcattgtaggtctgtctgctctgtatgaaagtagaaatagtacctttttggtgttaccctgcgtgtctgttttttcctgcttaccacaaggtaagattcttaagggtggatgactttctaagggaacaaaagaggaatctttccttttggctaatagagtgggaaggctctaattcaagagaaacaggctattgtaggcaataaatagttctgaccaaatttcttatcaaggcatgcaacatgcaaaaatgtttgttaaaggaattggtagtagcaaaggcat

SEQ ID NO: 45024 - DNA, 1034 bp, Homo sapiens
atattatagaaaacatataacattaaatttaccatcttaaccattttcaaatacactgttcagtagtgttaactctattcatattgtgaaacagatcctcagaactttttcgtcttgcaaaactgaaactctatacccgttaaataactcccttcttcccctcccctcagctcttggcagctaccattctactttctgtttctgtaaatttgactgctttagattcctcctccaagtggaatcatacagtctttttgtgactggcttatttcataatgtcttcagggttcatccctgttgtagtatgtgacaggatttccttcctttttaaggctgaataatagaccattgtgtgtatatatcccttttgtttattcattcattctttgatgggcattttggttgctttcatgttttaactctcgagctcctagtctttttatatatatggggttcggtgggaaggaaccaggtaggtactttctgtaattaatttgagtagtctaggtagaacatgaaagtgtcagtttaaaggatttagagattggtgtagttttatttttaaaactcctgtttgattgagtctacatctctgatttttatggggagggggcagagctaaggtgagacacagccacaagtcaacaggtatctgttgagttcccagcactgtggagaatgtgaaggagatagaagacattattccttcattttaggtacatggaggtccattttattgaaataaacatttcccatagcacttggcatttggtattacaccctacgtatggtactgtgaaaaccttctctaatgccatgtaaaaattttacagatgatactagagtctgagtagtaaattactttcccttttctaagttgattttatgctgcttgatattgagatggggatgtagtacaaatatttacttgtttcttggagttaaattttaaaaaatcccatattgcaggtctaagaccataaatttgtcttttactgctttcaaatggtcgtgagttggaattttccaattag

SEQ ID NO: 45025 - DNA, 1102 bp, Homo sapiens
ttttatgttttagtaactaggttaaaaaaatctaataaaggttgggctttattagatgatgcatgcctgtagtcccagctactcaagaggccaaggcaggaggattgcttgagcccaggagttcgaggttgcagtaagccatgatcgtgccactacacaccagcttgggtgacagaaaaaattaatacatatatagaatggtaaatcaagaggaatacagcaaatgtatgcttctctcttctttctcccagtttcttcgtcctctcaccagagatgccatcacaggtttcttatatatcattccagaagtattttattttgtatttgcaatgtttttaacagcgcatctttatcattttggacttgaaagtaggaaaatgtattctaggaatccatgaattattaagcaaggtctataggccctgccttaaagaggatctgatgagttgcctgagaaattagcattttcttttaaccagtagattaaaaccatacagatttctatatggagagttgctgagaaggttgtacacatttggaatttacatctagatgtgtaattagtggactctaaacaaagctaagtaaaatctataatatctaagatatacaagtctttaaaaataacagtttgggttcacagatactggagtcttcggattgtagaccttaagtcttctttctccacttgaatctgattgttcctggcagtgtgtaaagtgatcggttcattttggtgatttatttaattaagactgtactacacattatagaataggctagatcctaaagacataatgtgtgttcttaagtgttcagtaaacacgtaggcctttttggtcacttgtccaccatgtctaattctcgacctaatttcttgggagttttgttaatattccttaaaatgccaaaatgtcataatttgtatactgctcaggttgattggaataaagctttgttaaattcttgctatgcagaattcttttaatctttaagaatttttgtttgttaaaggaaaaacaactttgattataaatgtctgagaaatttaaaaaataagtgctcaagagactgagctgtctataagtgctttatatgcatt

SEQ ID NO: 45026 - DNA, 1108 bp, Homo sapiens
gcttcctctcaaattgataccttctcaaggtcaggttcagtttctccagaaggtaaatgtgttctctattttagagtctagcttctctgtgtcttgcatagatgtttcaaccaatagctgttttgagtctcatgcttcactgcagccctgcaaggtacctggtgcttctgtgtcctgacttgacaaccccttttgcatgctcagaggtttcactttattttgctgagttttctatttttcagcacattggttgttaccttccttctgctgttgccttgcgttttctttgttcttattttagactgtttttattagtttaccgtcattttagtgggtttagaagataaatgcgtgttttacatctacatgtttaacaagtgtatcaaaatgtttatagtttcttttcattcatgtctagaacacttggtaatcactttctatgcaatagaaaaggggaattcacagaatttatataaaagtagatttgttttcttaaatctaaattctgatattgtgtacttctttttttgaggtggagtctcactgttgttgcccaggctggagtacaacggtgcgacctcggctcactgcagcctccgcctcctgggttaaagcagttctcctgcctcagcctcccgagtagctgggactacagacacctgccaccacgcccggctaatttcttttgtatttctagtagagatggggtttcaccatgttggccaaggtgttctcgaacttgtgagctcaggtgatccacctgcctcagcctcccaaagcgctggaattataggcctgaaccaccatgcccagcttgtgtactgtttttaatggccttttctttcttcaattaatagcaaaaaaatgatacaaattaaaatagcttttgtctaagatactaacctgcatttttagacctaaatttcaggcatgaagcagtcagccaaaagccgtgaggttttaaagaacttaatatatcagagaaaacttcagctttcttagataaaaatcagtttatatttttttactcctgaaataatttaaattaacacatatatttgtcttagaatgaagacatttgtcaaagaccttttgggctgctgttaac

SEQ ID NO: 45027 - DNA, 1041 bp, Homo sapiens
atgttgtactccaaggtgtcagatcagcaaatacgttgctgcctgattcagttttggttgattcttcccctccgatatcattaatattctcaggagatagagtgaataagctattgggagagggtaaaagagatacatgatgtagggaacgtttttttaattgttaaaccagaagtgggtattttggtttgtgagttaaaatactgctggtattctaacttacgattagtctttaagtattatgtatattccacagtgccaggtgcccactgctgggcatgcagttgtaggtacttctttataactctggctagtttatcctgtctgtgcaattagttcatactgctgagcagctgtgtctccctgccttttacaattgtaggtatattgttagtgttgctgtgctcactaagttttgtgatgttttaaacggaaccaagtttggtggtattattattatttttttaaaagaaagcagttacttaaattaacatggtagaaaatatcctggggattgatggtgtagattaaaaatctttgttttatccaacaatagaattgaattatatggctaggaacaccagcaagcacttcctgtcacagttatcgaaacagtcttttaaagaatgtctagagggccttacttaaacaaatagcttgtcttgactttgggaggaggatggttacctaagcccatgtgttaaaacagacagatgacacactgaaatgaccaacgagcataataaggagaattcagtatccttggaaaccctggaacggtgccataactaaactaaaaaaattttagcaggaaacagtacaaacaagaaacatcgtgagagaaggccttagtgttcatttctgtggttgtgaagcgctagtaggagtaagtgacaggacctactttgaatagccagagttagaattgaagggggagccactggacaattggttcatgtattctgtactttgaaactgggattgaaaactaaatggctcttaccaagagaaatgtgaccagagaaatgtgacctgagagag

SEQ ID NO: 45028 - DNA, 1081 bp, Homo sapiens
gtatgtgcaagcacatatggccagacagcagaggaatatttactaaaataatagtggtttcctcagaagtggggttaagagtgatgattatcctttttctacaaagtagtttatttgtgagattaaggaatgaagttaattttaattaaaaacctatgttatgataatctcattactacaagtgatctttaaaaatcatattgtatataaacacatctgatacataatttgcagtttgcatgaatctgctaaatgactgttccaggggtgagatttcagggtttcttacactttattttttgtgaattggttagtttatagtgataattgtatcttttttatgaacataatgccatcttaaatatttacatatttagattcctataaaactttttaaagtacctttattgcagtactgattttaaggttcctaagtggttgatttaaccattggctattaatctttagctattttgttgtggtcagacagtatggtctttataatttgatttcttggagtttctctgtgactcttaattgcatacctttttagaagaaatatatacttttaatttggtataatttttctgtgtatttgtcatttatattttttaggtgtctatcccttctccctcccagctcccatcactgttcctgtcttctactacctttttttcaactccttattcctaataaccctgaaattgtaaagttaaaatctgcattgggcattgggcataaaaatttatgactgttacattctcaccataccttttatctacctacctgcatagtacaaaacccccttttcctattgaattctttttaaaaaaattccaccagactttggggacatcatctgtatttattaggcatgggtcaagtatgctagctatttggcagttagcaggacagttttgaacaagaaaaattgttcgatggtctgcatagcttagaatatactgccaaatgttcgtgatgctggaaaaaagcttggttattttctaagcctacaaactgttttacttaccaagggttttttcaggggatagaggccacgacttttagtactaaagtttac

SEQ ID NO: 45029 - DNA, 1146 bp, Homo sapiens
aattccagcatattgggaggccgaggtaggcggatcacaaggtcaggagattgagaccatcctggctaacacggtgaaaccccgcctctactaaaaatacaaaaaattagccggtggtggtggcaggtgcctgtagtcccagctactcaggaggctgaggcaggagaatggcgtgaacccgggaggcggaggttgcagggagccgagatcgcgccactgcactccagcctgggcggcagagtaagactccatctcaaaaaaaaacaaaaaacaaaaacaaaaaaagtcagtatccactctgtaatgttttagacctgtgctgtccagtctggtagccgctagctacatatgggtatcagaacatgagaagaatattttctaagagtagattattttctaaaaacctggataccagtatttagccagccctgtttgggtgtagcatgaaatggtatccctgtttgcaggactgtgcttcctcactttttgcatgtcatggcattcctaaaaagcagcgatgtttgtatggcacactgggatacacagccgaggatgcttacaactagggcttaccgatctgagtgctctgcagcaccaggcaagaccataccccattcttggcatgccggtatgcagtggcacatacggtacaaagctgcttcagcgtgctccctataactcattcctggatgtttttcttggtctatgagcggaatttgaattcattctcccttcttatttcatcatttttatatgtcatattcccagtgagactgtgagacattggcatttcacaacttagaagagctttcaaagcatcatccataaacttagagatttagtgagtaactgtatatgatctttctcttctcttttgtttaagggagaaaggaggaaggaacaccatgacgtagtgatatatttaaattctgttttagaaaccaggaaaatagttttcctaccagaaatatgattacattaaatatatgcggtataaagatcacagcaaggagaccatgaatctgtccatctacccctccccgaaataaaattactctacactattcagataaaaagtgacttggttggctgtttctgaaactttctgtttattggcttttggcaagataaatagtaacaaacacc

SEQ ID NO: 45030 - DNA, 1049 bp, Homo sapiens
tttatttccctcaaggattttacagtgagttgacttttgtggtgtaaatctttggttcttgtcctttcctgatatccagccacttgctgtttgggccagttgtttctaggattcctcaccctacacaagggtccctcttaaaattctttacctttgctacaaaactagttcactgctaaacacataaccacatcactgtacgctaaaaatgtcatcataaaataattgttcctgccataagaagtgatacgttattggagcaaatgtcttgtttctgttgcatcttgcaatcaagtctttttcttctccccacacacccttcaccttcctcttccattcacatgttcagtgattacattataactggttgtgagagtcccctgtcttcagtttggaatattgtacctacaatcattacttgattcttgttctgtcttctcataataaaataggtaagggctgggtgttgtgttttgtggttcatgcttgtaatcccagcactttgggaggtcaaggcaggaggattgcttgatgccaagagttcgaaaccagcctgggcaacatggcaacaccctgtctataaaaaaataaaaataaaaaaattagactggcatggtggtccgcacctgtagtcccagctacttggggagctgatatgggaagattgcttgaacccgggaggtcaaggctgcagtgaggtatgattgaaccactgcattccagctggggcaacaaagcgaaaccccatctcaaaaaataataaattggcgtggaatgtgccttcccaccccacccctcagtctcaaatctcaattgttttactgtaatgctgtccttactgacttaatcatctctaggttttacgtgttcagttcacttaaggaatattaaggtttcttccttattagaaattgagcccggctgggtatggtagcgcttgcaaacttccagcagtttggaaggctgaggtgggaggatcactgaagaccacaagctcgagactaccttgagcaacatagtgagaccctgtctctacaaaaaaatttttt

SEQ ID NO: 45031 - DNA, 1045 bp, Homo sapiens
agcttatcaaatgtatataagaaaattagcaagataatgtttaagggtgctatcagaatgattcacaaattgttgatttctttgcattcacaaatttagtgaaatgttaataaattagtatttgttgtattctctgttaaaatagtttcatactggtttattctgaggagaatttttattagtggatcaaaatatttatgaaagaactttagattcatgttatttctgatgggtggttgatgtacttcaaagatatacttcatagacttggaatgtttgggaaaacacgctaagttctgaaactagtgagtcgggaaagaaaaactaatatctttttttgttttgtctcaattatacagcagatataatttctacagtagaatttaatcattctggagaattactagcaacaggagataaaggtggtagagttgtcatctttcaacaggagcaggaggtaagtgtttaaagtttattgtctaaatttcagtttgatcttaggactagagcttgtgttgcactggagaatctcatcagaggatgttggaattttaaaagaagtgtgtgtttattgaatacaatgtccaatatatagacagctctggttctcttagctttgtatgtgtgcatgtgtgtacatgagcgtatgttgttttggtttaaaaacataacactaattgtaaaaatacttgattagagaagggggtggaaagtgatggaataatccaagattttaacggttttgaagccttggcccttcattataatttttcctttgaaactccgtaaagcaaagttgctttgacttcttctcaatgcttggtttactttgtacaattgaggggtgagaggctagtttaaagaaaaagcagctcaattattttgatgtcagttcataataatactgttacaatgatttaaatgtaaaggtttaaatgacagttgcatgtacatgcatgtaaagtaacttaaaagtgcagtgctagctttttgaagaaagaaaattgcagaatcggtaattaaagtgggcttttgttttgttttt

SEQ ID NO: 45032 - DNA, 1571 bp, Homo sapiens
atgtggataaattgcagggttttacaaatacatgtctaaatcataacacagagttaggttttaaaggattgtgaaattccttaaataagcaaagaatctagtaataatactactactttgcacttctatagcgcctttgacctgaggatctcaaagtgctttacaaacactaatgaattaatcctcacaacaccccagtgaggtaggtaatttaattttaaaagaaatgattaatagtgtctgattagaagatgcacaaacactaaatatgtcttttattatttttttcgtttggaagaaaatatgaaaataagactcaagctttgcttgacaaagaatggtctcgtgggaagtggggggctaaatcagttttctgtttttaagtagccaaaaactcgaccataagaatcttgacatacttagagttgacatggaaccttacattataatttcattataatttccctttatttactaacaggaaagtcaagatataaatagattactttattacttagtggcagaactaacaagcagaacctgaacttttgacatgtcgtttttcagtattctttgctgtttttcatgctagataaccaaaatgtgaaagtttttatctagagtttagagcagaccttcccataggtgttctctgcccttgaatgtattttttactgaaagttattgactctctacactttacttttattttaaagaaaagtgtttgagaaaaactcgtaaaaattgattttgccctaggcttaacattctgagggtttcagaaagtcttcatttttaatgaaggcattgtgtcattgtcaattctaaaatacaagtttgtcaattaaaagctaatttggaactattttgcctgagaatgaagtcattttcatctcctgtggtcgtttgttgtccaagtcaaaatcaagtgtggaaaaaatggctgaaaatttttttaattgggggaaatgtttgttttaatatgggtttagtaatgtagtcagaatattagtatttagtattttcctaaaggctgttagtaatacattaatttgtaattaaattccaaatttaatagttactgaaattactcatttacttgtattagaaaataagacaaaattattttaaagataatcatttcccgtgattcttttctgaaaccccactgaagattctaaagtgctaatattttaactacattttcttgtaagaagaattgagcagaataactttttgggaagggccattgataggaaaaataggacctccttttcatgtgtctcattcttcttaactatatttaagaattctagatggagagttttgtagaaactcagtaacatgtcttttgagaattacttagtggtgtaaatatcagcatgtttttaagtgatagattaagtaaagatgatgatggtgattgactcttcacttctgaaacttgatcttgactattaatttggtgtgttttgcctatttaattttctacattttaaagccctgtcttagagtttctaatacagtattgtcttcagaatctatgtcattggtcataaatatgtatactt

SEQ ID NO: 45033 - DNA, 1305 bp, Homo sapiens
aatatggaaaaaaatgtgaaatctgaaacacttctggtcctaagcatcttggataagggatactcagcctgtaaaagcacaatggagttacttatatttagaagtagctgttgaaaaatgttaagtgaaattctttcagaagtttgcctttaagtcttgactattcttagtatgtttattgcagaaaataggaaaaatgtgtatcatttccacaaagaataaaatcaaaaccatcccataacaggaatgaaaaatgaagacctgtgtgtgtgtatgtatgtgtggttttctcagggatttttgttttgttttacagaatgagactcatgttgtacatatcactttgtaatgtttagttttatttactgtcaatgttttctcaggttgaaatattgcctcccagtcagggagatgaagagactgttggaaccattgagtagaaaggggcacttgaatagttgggaagaacatactccatcttataacttaggtgacaaggttcaataaacttgtggcttgtgggaacagcttatacttctaccagtagtatgtgactttgcctttctgtcactaaaacaatggtcattatcacatttttaattttttgttcatttaagggaaaataatattgcttagttttggtgggtgggtagatgtgtgtgtgttttgttggggatttttgttttgttttacagaatgagactcatgttgtacatatcactttgtaatgtttagttttatgtactgtcaatgttttctcaggttgaaatactgccttccagttagggagacgaagagactgttggaaccattgattgggttacttccaccttttggctcttgagaataaagctgtaatgggcatggctgtccaaacacctctctgaggtcccattttcagttctttgggataaaatccagaagtgggattgctggattatatggtagttctatttttagcttttttgaggaatctccacgttgttttccatagtggctgcaacatatgtgtggtatatattttaaaatctttatttaaatatacactgaaaagtacataaaatactagcagattattacatagcaaacatttaggtcaagaaatagaacttcctacgcttccacaaacccttctcttttcccttcctctcctttatgagcctgtcttattaatgattattttggcctgcagttttagaactttgaatagatggaatccacagtttatccattatgagtaatgttgctgtgaacattcttactcatgttttttgctgtacaatcatgagtagaaatattatgccc

SEQ ID NO: 45034 - DNA, 1423 bp, Homo sapiens
aaagatttgtggagctttaaagtgatactggagtatttatatatgttaatggaataggctgtctaattttgtgtatgggtatggtgatgagaccaaggctctgagtctgatttttaccccttgtgtatccccgatatgtggatcgttttgtgggacatgtattcttaacattggcagacttgccctctaataactgataactgctgtccaagggttcaaatacaaccatccatgaatgaacaacccagatcatcaggctgctggaaaaaacaacccaaaacatagactttcaagatgattcagtgaagtttccttttgatatggagaatagtaataggctgtttttattatcaagaagttctaaacatttcactgggtaactcacttttacttaaaatagttgactgtcaataatatctcattctattttttacttaaactttttccataggtggttctttgaactagactttcaaatttttttatgaaaatgtttttaatcgtgtgataataggtcaaaagatgaaattctgaacatgattataattctcacttttgctgagatattaatgctaaccagagtagttcaaaagtagtccctttatgagatagcttaaattacattttttcaaagtgatactaaatgaaattagtcatcagtgtgtgccaggttcataagatgagaaagcaaatttaaggcgagtaagcagttgttgatgggggtgcatggggccattgctgggtagtgctgaatatggacttgattggtagcaaagctgtctggaacagtggtcttggggtgggaggtaggggtcaaatggtatcccttcttttataagagctctttttttaagctttcagcagcgaaataaccaaaaggcgggcagcagaaaggaaaaggacaatacatcatattaaataacagatcggggagttgaccctaaagtgggcataggaagaaggtgtgcctcacctagctctttctgggcaagactttatcattatttttagatgaacttccttattatgggtgctcagttttttttcatcagtttttttcatagactataccatcaaatacataagagtaaattagcaatcaaattgatccatatttaacgtcattatttccctaatgaattgagcttatttattcagctttatttagccttttcccccgttaagttttctcatttaatccttgaaggcctttagaaatataaaaaacagaatgtaattgtataaagacacaactaatggggtattgagaatgtgcagggtcctttggaattgattacatatttgattattttgaaatatttttcaacaatggtccatatatttttgttttcattttagaacaaaatccagtctcatagcagaggagaatataatgtttacagcaccttccagagccatgaac

SEQ ID NO: 45035 - DNA, 1060 bp, Homo sapiens
aaagcaacattcacagcgatgcagtactgccatctaatccggagacccactgaaactgaccagttactgtaactatgtcctttatggcacagaacaaagtcagtctggttcagtatccagcatttagttgtcatctcttgttagtctcctttattctgaaacagttcctcagtctctccttgtctttcatgaccttggcattttgaagaacacaggccagttattttatagaatgtttcctcatgattagattcaggctatacatttttggcaggaataccacagaaatgctggcctaatgatacctttttaaagtttcaagtagccacagcctaggtgtcctaatacattaaaaccacgcaaactcagatgatatggggatgtcaatctaaattacacaagccatttttaaagaaatacagttttgtcatcttcaggggcacgcattaccttgagtttgattaaagttgttgccaagtgtcctttgggaattgacattactaaatagataataatttgtactcagtaggtgacctttgtatgtaagtattactttgaacaattccccagtatcctgtaatccttatttacaataataatttgaaccattggtaagcagcggtagcagaccctttccaaattaagagcttcaaacttacgaagttttgtttgtgaggatacttaataaatgtcgagcagtaatgggtggcaaatagaactgacaaggaagtgtcttgggcagtttaaaaattttgccacccctttaaactgatacttttataaatatttgcttaaaatgttctaagtggtaaaagtaaaatgatgttctgttaagaaaatattacagcctgggcaacatagcaagaccctgtctctacaaaatatttaaaaattatctggacatggcagcatatgcctgtagtcacagctactcaggagactgaagtgcaaggactgcttgaacccaggaggttgaggttgtggttgcagtgagctgtgattgtgccaccacatttcaacccgggtgacagagtgaaaccctgtcttgaaaaatacatat

SEQ ID NO: 45036 - DNA, 1098 bp, Homo sapiens
tgttaattatttttaacaagtgttcttttacatgcaggaggagaggtattggttctctatgaacatattttgaatataggttttattaaggatttcacaatctataaatgctactagtttttttttttttttttaccatcatgagggtattggatacattgtgtctctatttaactcattatgtgttaatgaaattgttgtaaatgggaaccaaatttgtagaacttaatttctactttttagagtgcttaatttcatttttgccttactaaatagtcaaagacttataaaacatttttaacaagttagaacttttttgttattcagtcatataaaatagcagaaaactaacatcaagtgacactgcactaaatactttttttgtattttactgctatcaaatcagaatgaaatatactttaccatagatatttttcttctatttttggttttccaaagctatatgaaagacaaatttttaaaggtacagcgttcaaaaagtgcttaatgaactccaacagctgcctcaaataaaaatctgtatatgaatacattttccctaagcggtgatacattatccaaagatgaagagtgctcctatttttaataggtagaatgtacctttgtcagtcttgcagaaactttaatggagaagaaatggactttatttttgaaaggtgaaatgaacaggcatttatattattagagaatggtagtcttattttggtggaacataatgtaacaaccttgaatttcagaggactctgagtgcttctatgtccactacctattgttctattcttcaataatgaaaaagaattcaacgagccgaccgtgattccctctactacaaatattatgtcttgtaagttagcatttttagcacacaggagaaattttatgtaataaaattactgtatcttttggatttaacaaatttgtatttgaaacacattctatgtctgataattcttaatggcacttttactaatttatttggggatcttgggtacattcttaatttgtgtttattcttcacgcttgacttgcaagtgggatattcccctgccacaagtgtcaaacagtgatattcttcct

SEQ ID NO: 45037 - DNA, 1037 bp, Homo sapiens
acttctcattttggttgacaggggcagggtagagacgtcacaatattttaaaagctccccagccgattctaatatgtgccatgggtgaagctctaatgcattccaaattgttaggaggagtaaacagtttagagaagaggttggtaccagtgtgaagaagcatatagaagcagagcaatgcttccataggattcttgactttgtcaccctgactgccttgacctggtcacggctatgtaaggctgacccttaacttgatgtgtagctgtgaacccaacagttatgagcacaaagatagtaaactgaggccagtaggagtgcccagttcgggttgactcctgtgctagttcaagacaaaaatttcctaaatatatatgacgttggtttgatacagaaccagcttttctgttttcctgtccccatttaaaaatctcctatgtcaattatactagtctaaaagactcctaggcctaatctgtctgataaatttctgacgatcttatttctgagtcagtctcaccaacgtctctatacattaattaacattatatacatactcttgataactttaatagttaatatctattcttttcagcaagttaagccccaaatattttttatttctattttagattttgggggagggtttgtgtatgtagtgaaggatccccagtgactttcagtttttatacaagaaatcattaataaagctaagaaattaacttagcacattctgttcatctcttgtatcaagtgcagtttgtgatcatgttgtttttgtctaaaaacttatttgtaaatttttacagttctaagaatgtattttgtgcaatcataaaggttttatattaatatataagttatataattcactctgaaatatctcaaagcaaatatttctgaaataagtaaaatagtggttctcaaagtttttggtcattacatacctttacattcttaaaaatcattagggaccccaaaaaacttgtttgtgggtttatatattttgatatttactatattagaaattaaaactg

SEQ ID NO: 45038 - DNA, 1034 bp, Homo sapiens
ttattttattatttatttatttatttatttttgagacagggtctcactgttgcccaggctggagtgcagtggtgcaatcccagttcactgcagccttgacttcccaaactcaggtgatcctcccacctcaccctcccaagtagctgagactacaggcgtgtgccaccacgcctgggtaatttttttatttgttgtagagacagggttttgccatgttgcccaggctggttttgaactcctggctcaagcaatacacctgcatttgcctccgaatatggtggaattacaggcattagccatggtgcccaacctgcttgaagtttgtattactgagtgtgtaattttcaattgtttaaggtaacaggtatacaaagtaacaaatgaatatataataagctcccttttccaatttacaaaaaaaaaaacactgaaaaaataaatagtttagaaataaagtcataaaaaccattatatagcaaagcctgtggatgatgacaaagcagtagcctggataaacgtgcagcttcaaaggtactgattagacagtaataaacacaaatgaactaagcattcaactgaaaacagctttttaaaatcctccccaaattaaagaaaggccaatccaaataaaaggtacaaacatcaaaaagagatgactattatttgcagttactacaattatctactataaacacaacgtagagaatcaatggaaacatccagtagtccagtaaataagaataaaacgaagtgatacctttgctccttatttagacaaaatttagattttccactgttgctagggatgtgggaaacaggcacttgaatatagtgtcggtggagatataaattggtcaactttttaaaagttttagttcttatatatatataatagagatgggggtctcactaggttgcccagactggtctcaaactctaaggctcaagtgatcttcctacctcagcctctcaaacagttgtggttacaggtatatgccaccacacccagttaaattggtctatttttgagagca

SEQ ID NO: 45039 - DNA, 1098 bp, Homo sapiens
ggtaaacaggtttagggaggccagtttggataacattgatgggccctggagcatagtggctgtccctaaatgtctggttcctgaccctggggtgattagggtaggtggatattggccctgagtttaagagcttcctgaaggaggaggatggagtgtgagctctggattagttggtttgcatatgaaagacatgcctgcaggagagtcattttactatctctaggaattggttagcttgggaggtgcagtctctccaggatcggcaaggccccagatggcaaagcatcagaaaaacagaatagaaaggcatgattcatatggcactactagctggcaatagtaggcctaagatcgttataagattctggcctcatatatatataaatttaaatctatctatctatctatctatctatctatctatctatctatcatctatctatctatctatctatctatcatctatctatctatctatcatctatctatctatatatatatttagagacaggatctctctctgtctcccaggctgcagtgcagtgatgtgatcatagctcattgcagccttgaactcctgggctcatgtgattttcttgagtagctgggactataggtgtgtaccaccacacctggctcattttttaattttttgtagagacatggcctcattttgttctccaggctggtctcaaactcctgggctcaagggatcctcctgcctcagcctaccaaagggctgggattataggcatgagccactgtgctgcctataatttttcttttaaaaacttgatgcatgttcagagttatagtcacatcactaaaaccaatggagtccaaaactgcccatccaactgctggatttttaaattttaaccgtaatttttttttttttttttttttacaaatgaattatatttctgacaggacatatgattgtgccaaagctggtggtgaagatggctggaaaagaattaactggggccgggcacggtggctcacacctgtaatctcagcactttgggaggcagaggtgaggggatcacctgaggtcaggagttcgagaccagcctggctaacatgctgaaacctcgt

SEQ ID NO: 45040 - DNA, 1050 bp, Homo sapiens
tcttttgttgcttgtacttttggtatcctatttaagagcgtatttcctattccaaggtcacaaagacttacccctgtgttttctcctggatgtttcatagtttttgcttttacctgtagattttggatccattttgagttaatttttctatgtggtatgagacaggggtctaacttcattattttgcctgtggatgtccagttgtcccagctccatttattgattagcaaaagcattttaggagatggcaagaaactagagacaaaacattgccacacagcattagagaaaccactggtgccaaaaaggctgcatcgggagtgaagtcaatgaccacagctgtcaaatgttctcaggtgaagaggttgagaggactcctggagatcccagatggagaaaagatggtagaagaattgaggcttgcaagaagtgacgtgctgctgcggtggcagggactgatgggggaacccagtgacagcctagtgacaagagggtcttaattaatgcaactgaaaagcaggtctggtgagaatgagtaacagtgtgggaggagaggaatggaagagcttaggagttaggaattgggaagaagctgggaagtccatgggctttgaaggtccaaggaatgaaatggtagtgggctgttaaggatattgaagatcttaggaacagaggagttcaatgagcaacaacaagactggttattggaattattagtgacaactagtgggtgaatccttcctagataccagacaccgtgctaagccatttatatggactatttcacttaatattttttttatttttgagactgagtcttgttctgtcactcatgctggattgcagtagtgccatcttggctccttggagcctccatctcctaggctcaagtgatcctcccaccttggcctcccaagtagctgggactacaggggcataccaccacacttggctacattttgtagaaatgttgtccaggctggtctcgaactcctgggctcaaatgatccaccccccttaccctcccaaaatactaggattgtaggcata

SEQ ID NO: 45041 - DNA, 1055 bp, Homo sapiens
caccacacccagctaatttttgtatttttagtagggatggggtttcaccatcttggccaggctggtcttgaactcctgacctcgtgatccacccgccttggcctcccaaagtgctaggattacaggcatgagctaccgtgcctggccattttttggctttttaataatagccattctgactgatgtgagatggtatctcattgtggttttaatttgcatttctctagtgatcagagatactgagctttttttcacatgctttttggctgcctgtatgtcttcttttgaaaagtgtctgttcatgtcctttgcccagtttttaatggtttttttttttgtaaatttgtttaagttctttatagatgctgtgtattagacttttgccagatgcgtagtttgcaaatattttttcccattctgtaagttgtctgtttactctgttgatagtttcttttgctctgcagaaactcttaagtttaattccatcccatatgtcaatttttgcttttgttgtgtttgcttttggcatcttcgtcatgaaatctttgcccgttcctatgtccagaatggtgttgtataggttgtattccagggttttatagttttgggttttacatttaagccttttatccatcttgatctaccaaataattaaggagtaaatcataccaattctctataatcttttccagaaaacagaagcagtggggatacctcctaattcattctatgaggccaaaattaccctaataccaaaaccagacaaaggcattataagaaaagaaatccatagaccagtatctctaatgaatataaatgtcaaaatcctcaaaaatattaacaaataaaatgcaacaatgtatacaaagagtttctacattagaaccagtgggatttactccaggtttacaagagtggttcaacattcaaaatcaattagtacaatcacatcagcacgctaaagaagaaaaaaagatcacatgattataccaatagatgcagtaaaactatcgacaaaattcaacatctattagtgatagatagaaagctaagta

SEQ ID NO: 45042 - DNA, 1057 bp, Homo sapiens
atacaagaagcaagaaaagaaaaaaaaggtatatagattaggaaggaagaaataaaactttgtttgcatatgacatcactgcctatgaaataaatcccaaagaatcaactacaataaaaactcctggaactagtaaatgattatatcaagattgtaggatatgaggttattgtacaaaagccaattggttttctatataccagcaatgaacaattagaatttacattaaaaacatactattgtttatgttaacaccaaaaaaattagatataaatctaacagaatatgtataagatctgtatgaggaaatctacaattccctatgcacaaaatcaaagaagatctaaatatatggaaaggcttggtgcagtggctcatgcctgtaatcctagaggccgaggcaggtggatagcttgagtcaaggagtttgagaccagcctgggcaacatggggaaacctcatctctacaaaaaaatacaaaaaattagcttggttggggggcgtgcacctgtagtcccagctacaagggaggatgagttggaaagattgcttgagcctgggagacagaggttgcagtgagccatgattgtcagcctgggtgacagtgaaaaaaaaattatatatatacttgtatatgtagtacttgtataggtagttatatatattagcatatatacacatatactatatatacatatacatgtattatatattatatatagtatatatagtatatataaatatatagtatatattatatatataaatatatatataagtatatatatagtttatagtatatataaattatgtatatactatatatagtatatactatataaattatatatagtatatatatactatatatattatatatactatatatagtatatactatatatagtatatactatatatagtatatactatatatattatatatactatatatatactatatatagtatatatagtatttatataatatatatagtatatatatactatagtatatatagtatttatataatatatatagtatatatatagtata

SEQ ID NO: 45043 - DNA, 1027 bp, Homo sapiens
ttgtatagtggtgaagtctgagattttagtgcacccatcacccaaggagtgtacattgtacctaatgtgtagtttttttttatgcctagccccattcccaccctccttcttctgagtctccaaagtccattatatcactctgtatgcctttgtgtattcatagcttagctccctcttataagtgagaacatacagtgtttagttttccactcttgtgttacttcacttagaataatggcttccagctccacccgaattactgcaaaagatattatatcattctttatcattctgttttatggctgagtagtattccaaggtgtatatgtaccacattttcttcatccactcattggtcagtgggcacttaggctggttccatatttgtgcaactgtgacttgtgctgcaataaacataggagtgcaggtgtctttttgatatcatgacttctttttgtcccaatctttaatgcagtatgagtgttctgtggctgctcccacagaagtggttagggaatagtgaattttagggctgccccaggattgggaggttgcagggtaagagtagcagaatgatgctgctggtgagagtagtccaggaaatggaccatgggggcccagctgtgaatgaagaggttgactcatcacatcttgatgatgtggttaggggatgagggctcagatagcccttggagtgaatggctaaagataagggcaggccaaggtcatgggtcagcaaagtgaaggaactgagggtatgtgtgtatttcacacaaattttaaattcaaacaggattaagttaggagttgtggtagaaagaatactgctgctatgataaatagactccactatgtataatgactcgagcacaaaaggagtttatttgtatatcacataatagttcaaggtgggtgtttctgttgagtgggcagagaaaggtacagggtccccgctccatgcaattaactggaaagtcaaactgctggtggttctaacatcttcaacacacagctcccaaggttgtct

SEQ ID NO: 45044 - DNA, 1029 bp, Homo sapiens
cacacctgtctgtatccatctttatctttttatcatctatctctatctatctattaatatatatttatctatctagcatgacctgggataggtgaattctatagccaggtggcctccagaagcttacgaaatgatcgtctaccaaatctaccatctatctatttccctacctacctatcatttatctaatctatctatatattgatatatatctatctggtctatatctatcttgatatgacatctgtctgtacctatggtctatcatctctatttaatccatcgtctctatatctattgattatcacttatctgttttacttatcctaatctatcattaatctatcatctttctaatctatctgtatatatctattgtttatctaatctatcaattgaccattcatctgttcatctttcatataccaaagatgcagttgcatgccacctgattccagatgggttatctcacttcactgtcacttagtgagatcaggaagaagtctcaaggattgtttcaacttcaagcctatgtacatgagtttgcgttttgaacatagcaggaaaaacaacgatgtataagaagctttcttattggctgggcatggtgacttatgcctgtaatcccagcactttgggagattgaggtgggaggatcacttgaaggcgccaggagttcaagaccagcctgggcagcaaagtgaagccttgtctctaccaaaatcaatcaatcaatcaatcaatcaataactaaaaataaaaataaaaaattagctgggcgtggtgacacatacctgtagtcctagctgcttgggaggctgaggtaggaggattgcttgagccccagagtttgagggtgcagtgagctatgattgtgccactgcacttcagtctgggagacagtgagaccccatcttaaaaaaaaaggtataatgtagcttatagggcttataatcctgtaagaagacttcttatgcaagaaaataaaaattttacttttcgctattttttttttcctcctccaaataa

SEQ ID NO: 45045 - DNA, 1086 bp, Homo sapiens
aagtccttaagttatagttggattcccttcccagcaaggaaccaacaggaaggaaaacgaagtcaaacccagtctttgcacgtggaagcttgtggcgtgactgttatttttttgtgatgttctgtacagccctgtaatctcttatttttggcaagccaactctgaatctgtggtcccgtagccccaggcaaccaaaagctgagacaaacagaggaagtgtcgttattcacatgtttctctggccacctcatcgggctggacgctgccggctgccacccgtcgctgagctggagctccccagagtgcagcctggccaggcagggactgttgaccctggcccctgtaggaagcacctctggcttgtcccccagcccccagggtccctgccactcattacttctctgcactctttctgtaatttgttcatcgcctggaatttatttctggcagactttgtggtcaaaactgggaagtgtctgtttccttaaaacagcctttcctcaaacccaggaagtgaagtagggagctatccttcctcacctcctccctgtcacatgcacatgggcatacacacacgtacacactcacccatgtgcacacacacaggcacacacatgagaaagggacggggaaagctagggtgtccaccccagcctgggctcctggtatccctaagggttttggaagaagagtttcagtttttcaaagcctgctggagatgtaactgtcgtgatgtttcgtgggatctgcaagagcctgtagcgtcaggtttctttccttttgattgggatgacatgaagtctgttaatgcgggatcgtttgtgttatctgctctgataggtggttttacttgcatttgatttttgatagaatgagagatgaattgatttgttcctgatacattctgttgggatacagtccatttgataggaaggttgtttacatcacagtgtcctgtatttgggggctgccctgggatgtgaaaagtctgtttatgtctgttgacagagggtctctatgcttcttccttttctagcatttactcttatgttacaattagtgcctgcttgctgtgtgaacaggaca

SEQ ID NO: 45046 - DNA, 1072 bp, Homo sapiens
tctgcatgggggaaaccttccccataatccagtcacctcctacaggtccctccttcaacatgtgtggattacaatttgagatgagatttgggtggggacacagagccaaaccatgtcattgctatttcaaccagagaaattgaaaccatttttacgtgattaggcccagcagctgttgccctgagaacttcagaatccccagcaactgattatggagtctccttgagggctggcagatccagggatgcaccagtatgggatgcagtttttcagctgatttagaggcccctcttgtatgccaggccctgagtccttttagccatatgacagcccagtgaggcgaggaggggggatgcagggggtttgaaaggcttggatagtggcagagcgtgattagaactcaagcccacaggcacctgccggctgacgtctcctctcatggtgagtttgtcaagagggatctgttgtgtgttaaaccctgtgtgggtgataaagagaacaagtatggaacaattttgtgtgaattttagcttcccagtctacttggggaggtgctgctgatggaatgaaacacatcccagtgtaacttctctgtagtttggtgacctatccatcactagcatgatggttctcttggatttgaactttccaaaacatgttcctaacccactaggcctttcttcccaacccaccatgtgagaccacccagtaggattttccctcgttttccacccagaggattggaaaggacactagggagtgcagacatctggaactgaaccatctgtggctgagaggagtggcgactgagcctgcgtgacaatccgggcagtgcctggcattgtggggatgcaaaacagataagaaagtgatcctttctgaagggactgtggacaaggcgaggagaaagaggtagacagaaagtgagtgtagagatagaatttgacagtggctctgagctgtaagactgatgtctgggaagagagtggggacttggagatgaggataatgaagaacccttcacagggacgggcactttccagcaggccttgtagaatgacagatgtcctga

SEQ ID NO: 45047 - DNA, 1044 bp, Homo sapiens
ccaggcatggtggctcatgcctgaaatcccagcactttgggagagcgaggtgggagggttgcttgagcccaggacttcgagcccagctgggcaacatagtgagatctgtctcttaaaaaaaaattagcctggtatggtggtgcatgcctgtcttcccagctactcaagaggctgaaagaggaggattgcttgagcctgagaggccgaggctgcagtgagctgtgatcactctactgcactctagcctcaatgacagcaagaccctgtctcaaaaaaaagattaaaaaaaaaaaggaagcctagatctgtggctgtattttgttgaaaaggacagccaattgggccaaatgatatttcctaaagagggattgccacccctgcaaattaaacgaatttttttttgttttgaaataattatagattaagaagcagttgcaaagatagtacagagagaggtcccgggtacccttcacccagtttccctcatggttacatcttatataaatgtagaacaatatcaaaaccaggacactgacagtgtcacaatgtgtgggtatagctctaggctgtgtggccacctgtggagtcatgtgaccatcaccacaatcaagatgcaggtctagtccagcatttcagagaccaacctcttgctgctcctcccctccaccctccctaaccctggaagaacccatctagcccctcatctgttctccatctctaccattttgttatttggagaatgttatagaaatggagtcatacagtgtgtgacctttgagacggtttgtgtttcacttggcacaacgctcttgacatccatctaagctgtcgtgtgtatcaatagtttgttattgaaaagtaactttttaactcgtttctgctgtgtgcctcctgtgcacacctatgctgtctccctcaggtcactgggaagatggatgagaaccagtttgtggctgtgaccagcaccaatgcagccaaagtcttcaacctttacccccggaaaggccgcattgctgtgggatccgatgccgacctggtcatctg

SEQ ID NO: 45048 - DNA, 1051 bp, Homo sapiens
acacacttgaaaatatagtatcaagtgtcacatattcagtagtatataatacttgctacccatatgaacatgtggattcatgggcagtaataattccagagtcctctggggtctgtgattccaggttaggagcactggattgggtaagaaaggtgagaggcgcgcacatggctagcctgggagtgaacccacatgcctcattagcacataccggggatgcgttgggggatgtttcatgagaaataggagatgtagattctaggccagggccatgaagttggctgggactttggaaatctacataggggtttggtgccaatcacaagcccaggagggcaaaaggcctgaggagtggggctgcagtcaggctcctgctgcatgtttgggctgggactggctcaccaaggacgcttttccaccttggatccattcctgtgatcctcccaacctcagtgtggcctcagggcccatatccaagcctgtctcagggggctctccccaggacactctgcagtgaagatcgaaacggaaatgggacctagcaaccttgcccaggcctctctgggcctccacgaagtacaaagaggagccccaaggagcgtctcactttgacctagtttctctccttatctgacgtgactccctgcagtgacgtttatcagatggagaaggacattgccatggagcaagagaggaatgctcgctaccgaacccccaaaatcttggagcccacagccttccaggaacccccacccaaggtaagccaagccatggcctcataagtcctgtgagtcaaagcaaagccaggtccctgtctgatccatgtcccccttactgcacaggcaggatgccccctacagccctttctcagtccttcacccagcatccaccatcactgtcagcgtgtcacatcagtgccctggcaggtggacttggagatagcagccaccttgtgggatagctgggtcaagaatcattcctcaaaagtgtcccctgaggggctgggcttctcttctaggtgttttcttaggaacaaatgagatccccctga

SEQ ID NO: 45049 - DNA, 1036 bp, Homo sapiens
aaaccatagtgagatcccactttatacccagtaggatgactgtaatcaaacagacaagtgttggtgaggatgtagaggaaactgaaacccttgtacattgctggtaggaatgtaaactggtgcagttggtgtggaatacaatctgatggtttctcaaagttaaactgttatgtgacctagcagtttcactcctaggtatatactcaagaaaacatgtccacacaaaaccttgcacatgaaggttcatagcaggattatttataaaagccaaaaaagtgtaaataatccaatctgtgattaatggataaatgtgatatatcgatacaataataacaatgggatgttattcagccataaaggaaattctggcacacactgcaacatggaggaaccttgaaaacattatgctaattgaaataaatcagttgcagaagatcgcacattgtatgattatatttacataaaatgtccataagaggcaggcaaatccagaggcagaaagtagatgtgtagtttccagggactgaggaaagatgaatggagagcaactaataatgagtacggggtttgggatgataaaaatgttctagaattagatagtggtggtgactggacaatatttgttaatatacacaaaaccactctgttgtacacttttaaagggtgagtcttacagtatatgagttatatctcaaccaaaaaaatgagtgtccagttttaattcccatgtacacactttgaactgacactatgtattgatgtttaaagtttccaatgtcacaaacaagcctgtttgctaatttacctaatctaggttatatggatgagtttcacaacacttgctctctcaatttctacacatatttcatcgtgtagataataggttacaaaccagtaagcacactttaaccaaaccaaagaccacactttggaatagtgttattcaagcctcttgcattctatgccacttttaaaaaataaatgccaacaccattatggggaccggatcttgggccataaatcctagtcaatcaca

SEQ ID NO: 45050 - DNA, 1057 bp, Homo sapiens
caaagccaggcgacggggatggcagcagaaggttctctcagagggttgctgaccacagttcattcagctctgaaaattccctggcagggacatctatgaagataagtttttctctgcaagcttatatacttctgtactcatttcttggaccttaatatgtaaggtcttcttatcttgaagaccttacatattaagtggaattgagctgtaaatatcttagacttgcctctctcccccataaaaatttgccactaagcttttcatctcctacagtttgggtcccctgaggtatatgaagcaggccaactaagatctgcatagtgaacttttagtatgtatctagtttgacattttcatcaattgaaagtaaaaattttgttttattcttggtgtaacattttatttttgcagaaatgttctagtgctaatggtgcttgaatgtaagttttccatcattgggttgaaaatagggttgtctagtccagcgagctcagtgcagatcatgatgtgtttgtagaaaaagccctgtggaagagaaatcctctttcagtaatattctaggcagtgccagtgttgttttgtttctgttcttgaatttacctcaagagggcaacgaacactttattttcagataaaaatttatatatgatttgggtcttcattgcaacacatctcatgaatgcctcttgagaagtaatgaaagtacaatctgggagccataaaaccatccataaattacactgaattctgccaacacacactttaaatgttttgctcttttctctcagtctctatatttttatgagatcatctggaaaaaaaaaagacctgatttgtggcgtgttgttgctttgttaaggtaaagttttactacaaacccctcataatagagtttgtatttgttttgagggaaactttgtatttgaggaaataatagtctagtttgtgctatagaactagagacagaaagtattttcaagtgttggcataattgtgaaataaaaagcagcccagagaagttgtggttttgacataatgtggccctcggaaatgtttg

SEQ ID NO: 45051 - DNA, 1026 bp, Homo sapiens
acactataccacttcacttcacaggtaatgtgatacctttataataacaaaataatcctaattcctccctcctgtcctgtgtgtcattgctgtcattcatttcacttaaatacatgcataagtaagcatttgtatatatgtatgtatatacacacacataagctatctatagcagcatacataattgaatacattgttgctattgaacaaactctgttagatcattttaaaataagaaaaaggaaaggttttattttacccttgtttttgttcaacatttctctttatgtaggtctgagtttctgacccatatcattttccttctctctaaagaatttcttttaacgtttcttgcaaggcagatctattagcaacaaattccctgaatttttgtctgagaaagcctttttctctcctttattatcctttgaaagaatactttcataggattcagaattctaggttggtggcgggtgttttttttcctatcagcactttaaatacttcactgtactctcttcttgcttgcatggtttcttaggggaagttggatataatttttatttttctctatacgtaaggtgtttccccccctccccagcttctttcaggaatgttctttatctttttattttctgtagtttgaaaatgaaatgcctacatgtaggttttgggggcatttatcctgtttggtattctctgagcttcctggatctgtggtttggtgtctgatattaattctgggaatttctcagtcacttgtttcaaatatttcttatattattttgtttcttctctttctggtgttcttattacacatgttacaccttttatttattttagagacagggtctcactcttacccaagccattctcccacctcagcctcccaaataatcgggactacaggcatgtgcctccgttttttgtggggatgtggtctcattatgttgtctaggctggtctcaaacttctgggctcaagtgatcttcctgcctcggccttccagagtgctgagattatagg

SEQ ID NO: 45052 - DNA, 1027 bp, Homo sapiens
tgagcggggtgatttccattttctaagtggaaatcagcatctgccctctttctgccatatctatctccctagctttttatcataatctaaataatagctcaatttcagatcatctgcatgtagagtttctcaaataacaagaagagacttgctcaaattaacagggaagaacctttctcttgtcagctggtatgataggtctacttcatttctatacaaggggtttcttttggcagtgggtttctctgggaacagccctggaatgccttcttgggactctagtgagttcagaagggaggatgccgtaagcattacttcctgtcaccctgcctggaagccccaccattgctctctataggggaaactacgtacgcctggactttctgtttgacttaagctctggtcacccttcaaatgaaagaacaagaacatttgctgtctggatgatgcatttttatttctccaatttagtaatctattactgttctgtgtaagtttctgaatcagatgccggagaagttagtccattattaagaacttcaaggagggcagatgtgaagagcttattattatatggtgtttttaatgttgtgtttttccggtttttgcattttgactttggtttctctgatgtgagtacagtgatgtgtgtgcgtgtgttttagttttttgtaaataggcagttattctccataaattaatccttagaatgaaaatctctttatgaccgtgctggtgtctgtgggctgcattttgtcagcgttacctcattggattagctgagaagaggcactgatttggatgggagtggggtggggaggacgggtggccaggattccattcctgctttgccagtagctcttcttgtgatctaggataattttacttactctccatgggcctttatttccgtattttaaaaaagtggatgtggttatcttttacagttctgactctagaattctaccccttagtatcttctttagttctcagcatgaccaattatgttttcctaattaaattgtag

SEQ ID NO: 45053 - DNA, 1033 bp, Homo sapiens
ctgaggaagcaagccctctccaaaagtggcccaacctatgctactcactaccagctgtctatcagaaagtctgttttaatagtttgttgcaatgttgactccttatcaatgtaacttgaatatgaatagtactgttcttttctctaaatatttgacattgccttaattcattcaatttgataaagcttttctattttagatctgttagaggcagagatttggcaggttattctttgggtgaacaggtattactgaataatgctggaaaatattggtgctgccttccttagcagcaaccaagatactagttttgtggagccttttagtttagagatttctaattccaacagaacacatgcaaggaatttcttattctttagttggcctggcttaagctgttgtctctgaccaacaactcacatttctaagacagtgcctgttagacatagaattgtagtttgtggccatgggatcatttccttatgcaccccatcctctagtccctaagcagaccactgtccacttgtccaccattcatgaataaattgctggggttcagtaaagcagtccacatgccccagatctctacctgcgtgatctgttgcctcactgcaaatcctaataattagtgtttgttctggttatttattataacataccaccccaaagtttagtgacttaaaacaacaaccctcttatttccttaatgattctgtgggtcagaaattcagcagggcatagaggggatggttcctgtctgttctgtgatgtcaagggcctcagctggggtggcttaaatggcagccagttggctgggatggtgtgtctgaagtttcagttctgactggggctgtccatatgagcagcttggttcttgtccacctgtctgctccatgtggcttgggctttttaatagcacaatagctggggttctaagagggaggagcaaaggcctggtcttagaagtcctagaatgtctatattagttatctgtcattgtgtaataaattacccaaaaacttaatggctgaaa

SEQ ID NO: 45054 - DNA, 1032 bp, Homo sapiens
tttccaattttccttgtgatttcttctttagcccattggttgtttaagaatgtgttaatttctgcatacttatgagttttccagtttccatctgttattctagtttcatttctttgtgatcagaaaaggcattttatataatttcagtctttttaaatttattaagacatgttttcctgacctgacatatgatctatcccggaaaatgttctgtgtgcacttatggaaaatgtacattctgctattagtggtagcatgttctatatatgtctgttagatttaagtggtttaaagtgttgttctagttctccctttccttattgatcttttgtcttaatttttttattaattgttgaaagtggatattgaagtatccaagtcttaatgtagaactatttatttctcccttaagtcctgtcaagttttgcttcatatattttggggctctgttgttaggtgcatatatgttgataattgtataaatcttcctgatcattgaacatttatcaccatataatggtcttctgtctcttgtaacctgttttgacttaaaatttgttttgtctgataatataatcactctatgactcttttggttattagttgttttcttagtggttaccttggggatcataattaacattttaagcctccagtcagtttgaataataccaagtgagttttaatagtatgcaaacactctgctcctatacatctctgtccctccccctctgtattgttattgtcacagattacatctttttacctgtgtatccattaacctagacttaaaattattgtttaatgaatttgccttttaaataatataggaagaaaagaggagttacaaaccaaaagtgcaataatactagcttttatgtttacttatgtaattatctttattaatattctttatttcttcatatggttccaagttactgcctattctttcaattcaggttgaatgacttcctttagcatttcttatagggcaggtttagtagtaataagcttctttagcttttcttaatc

SEQ ID NO: 45055 - DNA, 1050 bp, Homo sapiens
ttatttgttgtaatcagtagatgatgacaaatggactttaaacattagatgaagcaggaaagttcagaaaagagatactctgagattaataggaatctaggtcctgtgaattaaatatgaagctatataaactttcttgtagcaaccagtaggcaaagggccaaagactatatagactttaagagaaggaaagtaacatttgagcaatgagtgtacactgagtgtatattttgtctaacaagacaataatttccttaagaagctcttatttagagatagttattgctaatccttgcaatgcgttcttgaaaacgtgtctgaaaaaagacaaagaatatccctcctgttcgctctgtaggcactgtgtaaccagcatttactttgaaacaacctttagatgatctttctcaattggaaatgcaaaatgttacctgcatttatcaggtgtcaagaaaatgaaatctcaacagaatgatggaatggagccctttctgtagagaaagtgtgaattggaatagagttgctgaacataatcttttgttgcagaacccctttgacaagcccttagggccctcttttctcatcatcctttcttctgggattcagcctgctttcctcttcacagttgccacctcctgcgtttcccaccgagttctttgggtctgattttgcaggcagcccgggaagacagtcttccaagattggaatcccttccctttattgctgtctttcaggacaaatacttagttgattttattttaaagacttttactttttgtcatcaaaagaaacctgataaataatggttggaaatataaaattcctgatgttatacattcataaaaatagaaatgggtaagctttaaagtatctagtcctttttgttttctgatggaatgttaaccaagtaacttagtccgaaatcagctttccagatattctgtattgctctatggagaagtgaatgtgtctcttttcccatacaaagggcgtgagcaactgttgcatagcattcactttttgcagggccctggcccctgaagctgctca

SEQ ID NO: 45056 - DNA, 1051 bp, Homo sapiens
ttcccttctgttagtcaagaccatctactagagggagaaattgggaagattcagtcactgttttactttctccaaatagttatctgcctagtaactgaagcttgggacatggagttcccagtcattgatagttaatgcacagaggacagtttctttccccacttaagccaaagcagttccaggtcccacaatctaagttatcataggtgctagtatttaagttgtcctattagtctgggtctttgagaatttctgaacctgaatttctcttttcctaacctaggctctccacaacaaacataagactatccaatgcatatgaaacaaattgaaataaaagcaaagttaacatcgttactaaaccaaatcaaaatgtgatagcttagaatatacttttttcataccagacctgccttccactccacccacaccctctcagctgaaattgagaatcacacatatttttgcccctggaaaagtacatacaagtcagaaattctaaagctctgtggaaacaataactgggaattattcttatttttcctgtgactttttagggatgatttctattctctgtgcagcatggctgtgtgtaatgaccgttcgttgatgaaatatttcttagtgctacatctgtgttattaaatttttgtactgtctaaaaaataatataatattgtgaagatttcctaatattttagaaccttctatatgtcagttcagtattggttgatagaggtagcatttgtataaactaattcaatgattaaaatgtctaacgcttcatactgctttaccatttataaagtacttttgcatacattatcttatgattcactcatatcatccctgtgagctaggtggtattggaatcattttcaagaagaaaaattctaggtacatagaagttaagtggtatgtttatattcacacagctagcaagaggcttgaatctgtatcttttgacttacttttcagaccactttcacagatgccttctgctacatcagttaatacaaaaatatactattaaagattaaaacacatgcaa

SEQ ID NO: 45057 - DNA, 1032 bp, Homo sapiens
cgggaggcggaggttgcagtgagccgtgattgcgcctctgtactccatccagtctgggtaatggagtgagactccatctcacaaaaataaaaaataaaataacagtgccaatccttgcctagaggatcaaatccaaagcataatagactttcacaaattggcttctacttacttagcattccttaagtctatcaactctgtaaatgccatctctgcctggaaggctcttgtagtatcccctttggtaatatcttaattttcaaggcgtggtgtggatgttatttccttaagaaatctgggatgcctagaagttagtgactctcttctccatactcaccagtgtgttttatatgtacctctatttttgtgtgtatattattatgttggaattgttcacgtttttattccttctgctagaatttaaccccttcaaagtagagcttgtctttattcatctttgtatgcccagtacccgacacagaacctcacacatagtaactgctaaataaatgtttgaattaattcatgaactttataaaccctaaatcccttagaggtggcagtagtaattgatttttgttttagtgctatacctaagctcttaatctcctagggttataaatagttctgtggttggtggggatggtgatggtaattccagtaccaaggttaccacatacttttgaatactagtattttacttttctttttttctttttctattttttgggtggtaggggacagagtgtcaaagtgacttgaattcaacattatgtgtttgtacttataagtggtgtaattaagcaaagaaagcaacacagctttctcatttctaggcctttcatgtttcttctgcatgcatattctccatctttgcttatcaaaattctgttgtacttgatccattgttaggttgaaaaaataaagtaaggtagatagcaaaacattagtatggtatcatcctggtttggttgaaaaacatatatgcatgttcattcagagtgagtgatcgggtggaattttcaccaggac

SEQ ID NO: 45058 - DNA, 1035 bp, Homo sapiens
atgaatatattcactcaacattcattagttcaacacatgtcaattgaatgtctttggtgtgctaggcactattctagatgtcgaagatgagcagtgagcaaaacagagatcctgttcttatggagtgaaaattctaatggtggtggtaaataaatagacaatgtcagatgaaaatgaatgctaataagaacaaatatggtaggtgatagggatacaatataggagagcagagggattctattttctatagagtctttggagaaggccttattgataaggaggctttggaccagggacttgaatgaagtgagaaaacaaatgatgatatctgggggcagagcgggccaggcaaaggaaacagagcagcaagtacagagactctgaagtggaaccacgcttcctaaagtcacagaacaacaggagaccaaagtggttggagccaagtgagtgagggagaatggaaggaaataagatcagaaaagtactggggctgagggtctgagtagctctggtaaggaatttggatttgactctgagatgagaagccattagagggttttaagcagaagaggcatgatcgtgaacacaggagcagcatatctttaaaggattaccttggctgctgtgtggaaatggagatcaattggaggcccctctagaagtccagggaagaaatatttatggctcagactgggcaccagcaggggaggaaatgagaagagttcggtttcttgatatattacaaagtagaatcacaggaaatgctggtagatttcataggtatatgaaagataagggacatcaaggataaccccaaggtttttggcctgagcagctagaagtatagaataaccatttatggagatggagaaacctgaggagtggaagtcaagaatttgctttcagaagggttgaagattgaggtgcctattagatacctaagtgtatatgttgagttggcagttagatatacaaatatatccatagatatattagtattgggtaacatgggaaaattgtagtgtttgcatggtt

SEQ ID NO: 45059 - DNA, 1025 bp, Homo sapiens
attagaaaatttgaaagatttgaagatacaaatcagctacagcataaagttatgtatgtgtttggcaaacttaatgatagtttcttagaaactatttgatgcatataaaacagtaaacagctagttactgggagtctgaagtcttagaaacagatattggcaaaaaaattaaagatgaagggaattcatgacaacggtctccttagttgcataaatgtctgcaacacaaccttgttttctttgtctcgaggctatcatactttttcaagacatacaactagtattttttgctcaactgtcgaaaatctagttgtatggaccacaaacaagatatcaccatttactttatttctacatattacatttgctctccaggaataaataaggttgtgagtgccagatttggaaatccaaactgttagatcgtgatagatttccccataagtaaaaatagttctcatcttgttttgttttttaggttcccagattgtgatgagccatatcctcgacttgtggatctgaatttagctggagaaccaactgaaggagccccagtggcagtgcagagagactatggtttttggtgtccccgagagttaaaaattgatcctgatctgggttattcttttctgcatgtgcgtgattgttcacctccttgtccaaatatgtacttcagaagagaagaactgtcatttgctcgctatttcataggattgatttcaatcatttgcctctcggccacattgtttacttttttaacttttttgattgatgtcacaagattccgttatcctgaaaggcctattatattttatgcagtctgctacatgatggtatccttaattttcttcattggatttttgcttgaagatcgagtagcctgcaatgcatccatccctgcacaatataaggcttccacagtgacacaaggatctcataataaagcctgtaccatgctttttatgatactctatttttttactatggctggcagtgtatggtgggtaattcttaccatcacatgg

SEQ ID NO: 45060 - DNA, 1040 bp, Homo sapiens
cctagaattcttttagcatctttagaaccagtttgagctacactgaaatatatctgtgtgtgtgtgtgtgtgtgtgtgtgtgtgtgtgtgtgtgtgtgtgtgtgtgttgggggggattaatagtgttttctgagaaatattttcaacatacggaaatgaataacaaatgatggtaataacataggtattaaactgtaagctggagtaggagtcctagcttcttttcttactttcattaattacttaactttgtaaccttggatgaacttcacctccctctgcttcagttcctcatagtatgaggatagtaatgaatctacctcctagggttgtttttaggattatgcatgtaaatacttagaagtgtggctgctagtctatggtcacaccaccctgaatgctcccgatgtcttctgatctcggaagctaagcagggtcgggcctggttagtacttggatgggagcagtgtggctactacataataagtgctcaaaatgttggctctgtattgtctattattgttgttgctaccattatttacatatagatacgttttttaaaagcccctagtactaagctttagcaaatgcaatatttgcttcagactttttaaagaagtcatagatttagctgaaacttcctgtgtacccttccctaatcctgttcctcttattcactccccagagacaaccatcatcgtgaatttggacttgttcattcccataaaagcctgtacaattaccaatacatacgtagttataaaaaaatgtttgttttacccagtacataaactatatcacacatacatgtatttctttgactaaattctttaactcaacattttgtttttgagttgcatttattttaatactgcaactctattttttaaaatgtttccttttactaatataaaggaaatgtataacatatttcaaatatatagagatatagaaaataaatatccatgtactcacaacccaactaccttgaaatcttgaaattatggcatatgtatctgtatctgtttgtgtacctatgt

SEQ ID NO: 45061 - DNA, 1028 bp, Homo sapiens
caccacatccagctagtttttgtatttttagtggagatggagttttgccatgttggtctcaaactcctgacctcaagtgatctgcccacctcagcctcccaaagtgctaggattacaggcatgagtcactgcacctggcttaattttaatttttttaattttttgtagagatgagtctcactatgttgaccaggctggtcttgaactcctggcctcctaaagcactgggattacaagcatgagccaccatgcctgatccataaattgttctactgataccatttggttttgttagaatttgggggggctatagaaaacaaggttacagtcttcattagtatttctttttagcaataacaacaaaataggcaattagaccagtgttcatttggtacagtctttaaatcggtcatccaattaacctttaaaaagtaggttatgctcttaaattgtattggttctttaatatgtgttataccagagtatgcctcaaattttatgtagttgaatttgtagaacaaatttggggatattcattttatttttccttttatatgaaattgtataagtacattagcttgacttaaattataaaaaaaaatatatatgaagaagaatgtagaccctataatgttttttgtctttgactttttggcttttatgtacctcattttttctgattgagaaaaagttttgaaaaagtgattcacttgttggttttcattgtggcaaaactttaaattttaagtcatcacactatgagaattgtttgtacacatttataatttttttaaagtatgtaaagtaaggattttttctccattcttcactcacaaaggatagcatttttatggaacctagatttacaaaggaacttgtgattcttttcaatgcttttgtgtcgttttacagctgattaagaaaaaatgtttacatttaattcagctgtatttcctagtagctgtataatcttacacattattcttatataattttgacctattttatatgaaaataattgtattggc

SEQ ID NO: 45062 - DNA, 1048 bp, Homo sapiens
ttgttatttttaatttttttctggctatacagaaaatgtttctggaaaaattccttaattgtcatctgatataatgtagagattgaggccagacgcagtggctcacgcctgtaatcccagcactttgggaggccaaggtgggcagatcacctgaggtcaggagttcgagaccagcctgatgaacatggcaaatccccttctgtactaaaaatacaaaaattagccaggcgcagtggctcacgcctgtaatcccaacactttgggaggccgaggcgggcggatcacgaggtcaggagatcaagaccgtcctggctaacatggtgagaccctgtctctactaaaaacaaaaaaattagttgggcatggtggcgggcacctgtagtcccagccactcgggaggctgaggcaggagaatggcgtgaacccgggaggcggagcttgcagtgagctgagatcgcaccgctgcactccagcctgggcaacggagcgagactctatctcaaaaaaaaaaaaagaaaaaaaaaaaagtagagattgcattagttccatatctccgcagagttctctggtagattaaatgttctctgtgcactaggccaaggaagttcctgttacctttgaaaatcattgtgtttgctctgattgtctacattagctcatatcagtcttttgaacactggttcaaatctgggtgttgggttaggatctgatgagtagagaatagtggaaagttgatataggaaggtatactggtttctggtgtgattctttagctacatttattccttgtcttatgtcatttcactggatcatgtaactgtcctggctttcagaaattatattagatgcccagcctttctcattcagagatgcctgtattattatgttatttcgattgcctaccaaaaaaaaaaaaaaaagaaaaggtttgtttttagttctctgcctctgcaagtctttgtgatcacatttgttaaattgaatctgagattcaaatatttcatttaatattttctgggttttgataatgggatattctgtaagataa

SEQ ID NO: 45063 - DNA, 1085 bp, Homo sapiens
ctccttatgttgcccaggctaatctcaaactcctgggctcaagtgatcctcctgcctcagccttccaaagtgctgggattataagcatgagccaccatgcctgaccagcaacagtctctaattcctgtattcataggtcattttgcacatattacttttctcttaaaaaatgtgttgaaatacatataacataaaatttcccacttaagccacttttgtgtataactcagtggcattcattacattcataatctgtgcaagcatcactactctgacaaaactctcttcccattaaccaaggttaataactcccaattcctttctcctcccagcttctggcaactaccattagacttctgtatctacgaatttgcgtctcttcctatatgtggaatcatacagtatggtccttttgtgtctagcctctttcatttagcatgtcttcaaggtccatccatattgtagcatgcatcagagcttaattttgacggctgaataatattccattgtgtgtgtgtgtctgtgtgtgtgtgtgtgtgtgtatgtatactgaaccacgttttgtttcttcccatgttgggcatttcagttgtttctagcttttggctctggtgaataatacctcaatgaacattggtgtgcaagtatttgcctgagtcctttttacttcttctgggtgttttcataggagtgaagttgctggatcatatggtaattctatgtttaacttcttgaggaactgccaagctgttttccacagtggttgcgtcgctacattcccaccagcaatgtccaagggttcccatttttccacatcctcttccacatttgctattttcctttaaaaaaaaattatagcctggtgttgtggctcatgcctgtaaacccagcatttttggaggccaaggtgggaggattgcttgagcccaggagttccaggccagcctgcgcaacacagggaggccccatagctacaaaaaaaaaaattatctggctgtggtggtgcatgcctatggactcagctactcaagaggctgaggtgggaggatcacttgaccccaggaggtggaggctgcagtaagcca

SEQ ID NO: 45064 - DNA, 1035 bp, Homo sapiens
tgccttgaacaagtttcctatccttggtgatacaccactgcttcatcggtgaagtggaaatgacagtactcccatgtggctgatgaaatgtatgtgtgaagtgtgttatctagagtactgtgcctagcacactgtaaatataaatcagtagcaattatgaaaaagccctctcctccccatcttccaagggtatgtggtgcattgaagtgcggactttctgcgttagctaagggatagtgctgtttgtcttccttagctgtctatgttgattgagctgccatcaatctgaatctccattactatcaattcttcattagaccaatagttttggagttagggttgtgtgctctgcattaaaatcacctgggaactttgtcaaactgcaggagttttcccccacacctaggaattctgatttagttaatgtagcacggtcccggtttgttatttgaaaaaattcttaagtggtgaatctgatttttacacataattaaactgactggtaaaacaatacgatttggatttgtgggacattagcgaactggtgggaagggaagcagataaggcaatggcataattttcaaattgaggacttatcctgggagttgagacttctgggcccaggtttgttgccaagtaaacagataacttggagtaatcaatagcctcattttccttgttaatatctatatattcagcagcggaaggaatgctcaccacttattgatgagttccttttgtattttgtgatttgtctgctagtggcatttgtggaacaccttgggatttagaaacctactcttaagcccaaagaataaattgttttccctttcaaacagccctgtaataagggcggctcaaactctggttctctggttgcatcataatcttcactcttcagtcagtaggtcaaggcacaaccagtttttcacacttcgttttgctttttaattgctgaggatgttctgtttcccttttttcatccaggctaggttacacagtaagaaaccactgtggtcgttggattgtgaaaaa

SEQ ID NO: 45065 - DNA, 1029 bp, Homo sapiens
ccatcattcagtgtcaacagcagtcagctcacggccgatcttgggttcatttctacccgcaaacattccccgccaccctcatcctgtttattttgaagcaaattccaggtatatcatttcatctgtaaatatctcagtatatactttcaacaagtaaggacttttccatattttagtgtttggttttattcccccttagagcacataaataggtaacgtctgtctggacggtttgcctgccagagtccccgtgtatacctcttgtcccagtgtatttattaatagtctccctttccacttcaaagagtctctgtttggacagtaaattatttggtgacctcatgtacataagagaaatcttttcataggggacagtaaataggttctttaatagcactttcagtattgagtatttttctaatagtatgtcactgttctatttttgttttttgtttttttttttaaatcaggagagcaagccctggaggttcactctttcaagaagtcgtgtgctgaggtgtaatgctacacaagtcagaggaaggaagggtcctgaaacacatggtgaggaaggaatgagtcagctggattgctgtgattacgccttcttttctttttcttccattctgttgtttctttgttacaatttggtcataagtgcaaagaagattcttttgaaagcaagagatttaaacatttgaatcacaaggataatgtaaatttgagtatttggtcagctgctaattatccaagtttagattatccaaatacttaaaccttttagtaatattatcatcaactttaggtctgatgtcttgtcaggtgttctttgtaatggacaaagtgactcacaccatcatttccctcctctcattctttgctgttagctgattctaatatcctcttttctttctttcttttttttttttttttttttgagatggtatttcactcttgttgcctgggctggagtgcaatggtgcgatctcggctcactgcaacctccacctcccgggttcaggcgattct

SEQ ID NO: 45066 - DNA, 1027 bp, Homo sapiens
atttaacaaattgagcttttcagagtctttttttgtaaagtatttccaaagaagacttataggttaggaataaacataaactacccaggttggctaggaaggtatttctgttcatctaaagatgatgcccaggtgtggaacaggataagaaaagaccatggacatctttgtcccatgaatttagttggtcatcgtgttacagggctataatgccgctctagatccagttaaataagaagtggggaggggttgtaaactgcagctttttggggcacttatccatttattaccccaagtaaaagacctataccaaacagcaaacaacatctctgcattgtcattataatgttctttgagacacagccagtgttccagccattgttccatctaagatttaagcattttctagaaatgtatggtggcaggggtgttgaacataacttcttcaagactgacatggttctctttcttttgcaggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaac

SEQ ID NO: 45067 - DNA, 1051 bp, Homo sapiens
ttctcttgggagagttgtttttaatttccctacatcgtgtttattgcgtgtataaaataatcttcagcttttgcttgattcacaagaaaattagctaactaatgaatgaagcttaaaaggtaaatctatatacatttattgaagtataaggcagcttttattcctgaaaggcatatgctagattttacaagcgcggagatcaggcaaaattattcagtaaatccagccatggtctccttggacctaaatacagattttgtttggcctttcataacacagccttaatttttaatgtttttccttcctcatcacaggtggtccgtactgagaagaacagtttgaacaaccgattcttaccctggaatgaaattgagacagaggccatcctgtccattgatgacgatgctcacctccgccatgacgaaatcatgtttgggttccggtgagagactaatttccaatcaaaactttaggttgcaagtgacagaaaacctggattaggctgcaaaatgaattttttggctgatggtaactgagaaccccttgcagatagtcagggctgatgtaggacgtggctggatgcaggctcgtagatggcgttggaggagtccatctctcttcatctgtaggctccgctctgtgttcccacaggcctttcctctgtggccaggaaggtggaattctttgattggctagaccctggttacctgcctgttcctggtgctgcaggtgtatcatccttaaatccaaaccacatgggcagagagtagaggcaacgggtagggtagttctctaaaggaaataggagggttttgtttttagaggaatgggaaggcaaaagtgacatgttgctgtgtgttggagcaatggaacagtgccaggatcctggacccaaaaagatttgggggaaggagggtgtcagaagcaatgatttaaaaggaaaaagaaggggaggaggaaaaggaggtggtggtaatgatgatgatgatgatgatggtaaacatatgttgaacccgtactgtgtgccagggactagcctaggactttgtct

SEQ ID NO: 45068 - DNA, 1050 bp, Homo sapiens
tttatctcttgtggagatgaggttttgctttgttgcccaggctggttttgtactcctgggctcaagcgatcttcctgccttggcctcccaaagtgctggaattaatcaccaggtaatttcatttcttattacaggctctgccctgtatttaaagagatggtttatgtatttcttcttgcatgttcaggtgttctgaggggtttttatgccattcggcctgccacattgtaatgaagctgtccctcttcatacttttttagttagacattttctaattaataataatatgactagactgtagtatggccactttcccatggctttaaatgtagttaagcatcttttttatggacagtattcaagaatgatagcccctctttgactagcccctctttgggtagtcttcaatacccaaagcccctctttgggtagtcttcaatattttgattcaaaacattgatgaaacaaacaactcggtacctacctatggctctgcaaccaagtacatactaggagtagacttactgagacagctgacactacacacgttaaggcttttggcatctgagaagcgtaggccatctcaacagaatacctgacaatgttctggagacatctggtaggcaggaggcctggggccgggctctggttcctgccatgctctgcagggatgttgcccctgaggggatcagcgtcttcaccatggacatgggagtgtgggatcggctcagctgcaagggttctgtcagtattagctgggattcccactctgtctctctctcccgtttccaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatgg

SEQ ID NO: 45069 - DNA, 1048 bp, Homo sapiens
ccttcctatcctccctccttccttccttccttaagtccttcctttctttcttggcttcgtacaacatttctctttctgttggacataataccgcctgtgtctttttatttagtttgtgctaatatggttgtgctttttgtggttttaccataaaatgcatcgttaaatgcatttattattttgcatttatgctgcaggtaattatcacatcaggattgcagtgctttgcattaaacttattttaaaattgtgcaattaagttgcttgatctagctgaattatgtttctaagtcaaagttgggaaatttgaattctaaattttttttcaaatttcaattagagttaaaaaggaaaggattgcaacatctcttatttctcacagtttttaatatttaataacacactaggagaatttaaggtcatattttgtacttccttattaagttcttcaataatccttatgtgacaatttttttagtgtaacggatttttaaagtaaagaaattggcataatttctatttcgactgttgagaattgaatatattccccaaacttatcaattcttgaatctgccacctatcatcagtaagggacctttagattctatgataactgaaaaccacattgatagagtgtgtaattttatgatatgtcctctaaccattgatttaaaatttttgctgttggtcattcacacagataagggggactgaaagagtgaggtagcatgtatatttcaattgacctgaatagaaaaaaaaatgtgatttctaaatctcagatgtagaatatacaatatgttgattcaaaactaagccattagtttgtgatagaccaggattttcagaatcatttgttttaagcttgtatcttaacttgaaacactactttgcaaaaaccagagaaaaatcctacgtaactacttaacggagtgttttgttttatttttctgaagcatattataatagtcatggagttttttaaaaaatgtttaataattattttagaagtaaaaaaccaacatgtttgttaatattttaaattgga

SEQ ID NO: 45070 - DNA, 1109 bp, Homo sapiens
tgcaatttagttctgttcatttcattgtagctcttgcttctcttatttttgtatacagctctttaaacctgaattatttctcttgggaatcaggtatttatgtagaatgttgtcataagtgaaagttggcataccactcaactttttaaatacatgaacatttatagataaaccgaatagtgctcattgaaaatgtgttggttttgtttgttttgtgaaccagctttatttagttctttggcttctggaattaattttgtagctcactttgctattctttggctagatttttctgttaacagttggcttttacttcccactgtagtagaactgtaatttattaaagcattgttgtgagtgaaaagcatggcttgtctagagtgccatatatgtacacccacaatacactcatacataaaatacttttatgtttatttatttatttatgaaattggtgtatatctatcagacatgcctcccataagaaagaatctgagccacaaatagcagaagaccttgaactttgactgaagctagaaaccaaagagtaaccagcacatgttgtccacattatagaagctgaggagattttcattatcattccaaaccattattttcacagattttgttaaaatacagttctctcaaaatggaagctattgatattgaaagttttctcaaaatattagtaagtaagacgtagcatggattcctaggtgcagctattcccccacattgcccttactggatttagggcccatcataggcgcagagtaaagatttttccatgggattatttgatgtaaacttttagttgcagtgtattcaaacataatccagtgctttagataatttgttttccttgaccttagatgaaacaagttggaaatttactataacattgttttggacactttccaagagcatttagctcctggaagggccctggctttagcatggtttttacccttatagtggtaataaagttgaagttacattaagtttttccagtgattagtgtaatcttaatgcaatatttgacagattcttaggctatagtttttttttaacatttgcaaaaaaaaaaaacagtaacaatagtctgattt

SEQ ID NO: 45071 - DNA, 1079 bp, Homo sapiens
acgtcagtgtttcaaacctgatattctggtggttgtactgggggagtcgatttgccaccataccactgacagaacatcatcttttactgtaattccttaagcagtcagatttcttagttggaagcaacaaaaactgattttggcctatttaacctagaagtaaatttattaaatagatgttaggaagctcttagaattgctaggaagactgcagccaggcttgtacaatgagaagacctggggggagggtgctgtccttggcagaaaccagtcagagccacaccacaggtgcagtctgattaggacagcaatactgttgcttgcttactgctgctggcaccactgaatgctgctgcttgactttttttgaagtctccctctattgcctaggctggagcgcagtggcgcgatatcagctcactgcaaccactgcctcccgggttcaagcgattctcctgcctcagcctggcgagtagctaggattacaagtgcctgccaccatgccctgctaatttttgtatttttagtagagacaggatttcaccacattggccagactgatcttgaacttctgacctcaaatgatccacccacctcggcctcccaaaatgctgggattataggcgtgagccaccgcgcctagctgctgcttgacttttattgctgctgctcctaaaacttgcccctgctgcagtggtcatctctatttaagagggttcgttctggttgtgacaccagcactacaccattttacataagtgatttgagcgtctatagattttggtatctgcagggttgggggagggcagaggggagtattttggaaccagcccactgcagataccaagggacaactgtacagatggtccccgacttaccatggcttgacttaatgattttttaactttatgatggtgcaaaagtgatatgcattcagtaaaaactatacttcatattttgaattttgacttctttcccaactggccatatgtgatatgctaccttttcacaatgctgggccaaatcatctaaccaaaggctattttataataaagtgttgaatatctcatttaatttat

SEQ ID NO: 45072 - DNA, 1073 bp, Homo sapiens
acatttatattcatctacagaaaaactaccgagaattttataaacctgcattgtcaaagaggatattagaaaacgattgggacttatatagtaaaatctgtatttaggaacttaaggatcaaattgtaaatgtgggatcaaatagataccccatctattaaagaatggccagtgggaaatttaacatactaattaaacacttaaaaaaatcgcctcatcagaatcatcttttcccactttaaactgtggacaggcactgttttgctaggtaagtaaatatctgaacacacgccttcacttgtcttgatcaagacaaacatctgtataaacttcagcttagcattctttgaaccacagcactgcagacagccatgacagctaatgtgacattgaagcctatttgacatccctaacctaagttagagggtcagtaacatttgaattaataaaataaatatgtggttttcatttcagtgaaaatttctttttttgctcttatttcagtgagaacttccttgttagaatatattctactttatttgaacacagtgttatacttgtaatacctataatggaaatgaaatgctttataaaaaccagtgaatgcattataagcatatgcaaatagagtgaaagaactgcaaaggaaattccgcagaacatatttttatttcttcaaaggtggctatagaagtacttctggattagatatgttcagttgcaaaataacaaattctatggaaaccaacaaactataaaggaaatttatttgtttatatatcacaaaatccaaagacaggtaagacttctggcaaaaattgatccagaggttctaagatgtcatcagtaatctttgttgttgttgtagtgttgtgttgttttactttgcattctcaacttcctagagcaactctatccaataggaatataatgcctattacattttaaaatttaaatattctagttactacattttatgaagtaaaaagaaacagatgaaattcattttttttaaagagacagggtctgactgggcgccgtggctcacgcctgtaatcccaacacttttggaa

SEQ ID NO: 45073 - DNA, 1017 bp, Homo sapiens
cttgtctgttttcagtgttaaggcaaaagcattttatctttcattattaaatatgatatatttagggttttcatggatgccatttatcagtttaaggaggttctatttctagtttgctccgagttttggtcatgaataagatattatattaacttttatcaagtgctttttcttcatcttttcttatttagtctgtgattatggagaattacattgactgatttttgaatactgaataaaccttgcatgttgtattgttcttttcatatattgctggattcagttggctacagttttgttgaggattttttcatctgtgttcatcagggatattagttttcctgtcatgtaatttaatcctctggcttttgtactaggataatatgctggccttataaaatgatttgggaaattctttcttctcttctattttctggaagagactgagtaggattgccattatttcttcattgaatatttggtcaaattggccagtgaaactatccaggcctgcagttttcttggttgtgatatttttaaactatgaactcagtttccttaagagctattcaactattcatgttatttttatttttatttttattttttgagatggactcttgctctgtcgccctggctggagtgcagtggcgcgatctcggctcaccacaacctctgcctcccaggttcaagagattctcctgcctcagcttcccaagtagctggggctacaggtgcatgccaccacgcctggctaattttttgtatttttagtagagatggggttccaccgtgttagccaggatggtctcaatctcctgaccttgtgatccgcctgccttggcctcccaaagtgttgggattacaggcgtgagccaccacgcctggccatgttgtttcttttggtagtgtatgtattcaaggagctggtccatttcatctgagttactgaatttatggacatagacttgtttatagtattacttggtacttttaacctctatagggtctctaatg

SEQ ID NO: 45074 - DNA, 1081 bp, Homo sapiens
gagggaggtgctgagtgagaactcactcactcccttgagaataacaccaagccattcatgaggaatctgcccccacaacccagacaccttccactaggccccatcaccaacagtgaggatcagatttcaacatgagacttggtaggtacaaacaaaccatatgtacccactggaacaacttttataaaaaactactactcattttgggaggccaaggtgggcagatcatctgaggttgggagttttgttgcatgggcaacaaaagcgaaactcagtctcaaaaaaaaaaaaaaaaaaaaaaaagccaggcgtggtggctcacgcctgtaatcccagcactttgagaggctgaggcagacggatcacaaggtcaagagatcgagaccatcctggctaacatggtgaaactctgtctcttctaaaaatacaaaaattagctgggcgtggtggcgtgcacctgtagtcccagctacttgggaggctgaggcaggagaatcacttgaactcgggaggtggaggttgcagtgagccgagatcacaccactgaactccagcctggtgacagatcaagactccgtctcaaaaaaaaaaaagaactactactactaccataaacaactgttctaaagtaaagatgcagggtgttatgcataccagtttgccctagtatgggaagtcaatgaaaacttcccaagaaaatacctcttgagctaatatctgaaggatgaatagaagttaaccagtctaagagagaagagaaaaccaatcaaagcagaagcccagtagttagttggaatttgacaagtataaggatcagctggtatgattagactcaagaaatctgagaggtctattgggaatgcaaattgttacatatatatacaattgttatggagagcaatatggaaattcctcaaaaaattacaaacagaatgactatataagagccagcaatcccacttgtggttatatatccagaggaaataaagtcactatccatgcactctcaggttcatttcagaattattcacaatagccaagatatggaaacaacctaagttctgtccccagataaataaag

SEQ ID NO: 45075 - DNA, 1666 bp, Homo sapiens
aataccaaaaaaccatacctgtttgcaaccacactctccaagtccatgatctcttgatctacatcaggtccctatgtgaataaggcttctcaagttcagttcccccagtatggcaactcttgattcagagacctgtcaactaaatagactgccaaataagcgatctgagcttccagcttaagaaactagataaaaatgagcaaattaaacccaaagtaaacagagggagttaaatacaagaacattaatcaataaaatagaaaagcaagaaaatcagtgaacctcccaaagctgggtgctttgaaatcaagatcaataaaattgatatacctctaggtagactgatctacaaaaaaagaagaggcacaaattaccaatatctggaatgaaagaggtgatattactgcagaatctacaaacgttggaagaataataagagaatattatgaacgactttattcctgtaaatttgacaactttgataaatggtcagatttcttgatggacacaaattatcaaagctcactcaagaagaaataatctgaaaacccctattaaagtctatagtggactttaatatgttttttaaagaaattggatttatagctaaaaacctttcgtgcaaagaaaactgcatggcttaatggtgaattaattaatgttcttccaaatatttaaggaagaaataatgaatgccaatttcatataaactctttcagaaaacagaagagaaaggtaacacttctcaactcatgaggccagcattactagaatgctaagacagagacattacaggaaatctgtaggccagtgtcccttagaaacatatgcagaaatccttaataaaatattagaaaatgataaaataacaaattgaatccagcagtataaaaataaaaggttaatacctgatgactaaaaggtttgtatatcaaaaaatgtaacaatggtttaacaatctaaaatcaatatgattcaccatattaacagactcaagtagaaaaactaatcagttcaatagatgcagaaagacatcattcgtaatgtaaaagcaaaccaaaacttaacaaactaggcatagaaaagaactttcttaaactgatagagggtttctactaaatacccaaaacttagattgtacttgatggtcaaagactgaatgaatgcttttctcttgggactggcagcagggcaagaatttctgcaggtactactgctattcataatatactatagctcctcaccagtaaaataggaaaataaaaggcatatggactacagaaaaaagaaccaaagctgtctctattcacagacaacctaattgtgcttgtaaaacaaatcctaagggatatgtttgtaaaaactcttagaattattaagttagtttagtaaagtcacaggatacatgaaataatatacagaaattggccgggcgcggtggctcacgcctgtaattccagcactttgggaggctgaggcgggcggatcacgagatcaggagatcgagaccatcctggctaacacggtgaaaccccatctctactaaaaatacaagaaaaattagctgggcgcggtggcaggcgcctgtagtcccagctactcggaaggttgaggcaggagaatggcgtgaacccgggaggcggagcttgcagtgagccgagatcgc

SEQ ID NO: 45076 - DNA, 1036 bp, Homo sapiens
ttgttcacattcctcaactcatacacaagatgtagttttaaaaatcttataattcgttgacttcacgaacttcactcctaataatttcgagatacataatggagtttttttttttttttttttttttttttttttgagacagtctcgctctgtcacccaggctggagtacagtggtgcaatcttggctcactgcaaccttcgcctcccgggttaaagcgattctcatgtctcagtctccctcgtagctgggattacagcgtgcaccaccacccccagctaatttttgtatttttagtagagacgggattttaccatgttgaccaggctggtctcaaactcctggcctcaagtgatccgcccaccttggcctcccaaagtgctgggattacaggcatgagccactgtgcccagctcataatggagatttttttgtagaacttcatcaagttgtaattgtacaccttatcgactcattaagaaacaatgaaaaagtaactttcacttttttcatttttgagttagggttgggaaaaaaaggtaaattacgatatgaatttaacagattgttgaatataacattttaggaaggactttaaagccaaaaataaagacctgttttacgttttaatgtttaaaaatgcatctattaatatataaatatatgtgtaggggtatgtgtgtatacatatctgctaatatagcatatagatactaatgtgtgtttcatgtacatattatgaaataatttaaatgaggcttatcagaatttattaataatgccatacattaaggatattattcttaacaacccatgtactaaattttatgatatgttagtattttgtataaaactgaggctttattctaagttgattatctataggctaagtattttacttgcctaagtaggatgtgcatgttctgtagataagacaaaatggtcatgatctccagttactatgttattgatacatatttagtaacttttatttttgagtgattttttaaaatttaaagttatactttgtctccata

SEQ ID NO: 45077 - DNA, 1047 bp, Homo sapiens
tactatacagttactgattttattgataattatacgaaattatttttatttaatcttcacaattctatactgtaggtatgttattatttgcagtttatatataagagcctcagagaaaggaagtgactaacccatatgcaaatggattagagcaggggtccctaacccctgggctgtggacctccacacagtaggaggcaagtggcagcagagcaagcattactgcctgagctccacctgctgtgagatcagcagcagcattagattctcataggagctcgaactcttcattttcatccctaaaccaccctccctaccccccaccccgtcggtggaaaaattgtcttccacgaaactggcctctggtgccaaaaaggttggagaacactggagtagaggaggaatagatggaggccagcttaggaagctattagagtaacctatgcatgactgctgagggtctaagctatattgtaaaagcaaaaggatagaaaatggataaaaagtgatagatatcagaaaaaaaatggaagaaaaacaatctaacctagtcacacattgaatgacaaagcaggaaatatgtaagagttgagcatagtgatagtcagagagcctctgggagacagtacctgccattagaaaatgctttcactttgggcaaatcattcagcatctctgggccccaggtgccacatttatgaagagttaaatatcatgatgaagtaaaaagacagacttcagagccacacagacttaggaattagtcacagcttcactttatgttaatctgtgggaatttcagctttctataaagtggagatggttattatgagaagagttatgagaattatttgagataatatgtgcaaatcacacagtagaatgcctttctcataaccattgttagaccagtgttctttttccatctaagcttcttctagtttaatgctttgactgtgaagtcacctcaagatttctgtgttagagagttcagtggcactagaaatggagatttgggagtcatcaatatattaggtacagttaaag

SEQ ID NO: 45078 - DNA, 1035 bp, Homo sapiens
gtgtcccctttccctgctaccaaaaaagtctttcaaggatggagctaaggtcaaaaatgagtgaaaaaacttgcagtgtttgtatccattaaacggaagccccctcactctgagaggtcactagaggacttcatagtggggttgtgctgcttatcacagatgcagacacttgcccagataggagcagagaaaagcaggggacgtttcctactcacattgtggctgtatgagaacacgatgggactgctttgctgttctctttactctgtccttggagaggtgtgaaaagctgtattgctacaggcaatttatttaataattggaagccatattgataatggatgtggtaatatttgtaaagtttaatctactttaagcggcagtaactaatggaatttttttccttgatcacatatgtagcacttttgttactttttaaagatatttatatttgataaatctttttttcattttgagaactcaaaataccaaacagtgaacttgcattctaaagtcaccctgtgatcaccttgtcatctagtagcaaaatgatgaactattcatgcatcaaagaaaattacatctgctggccttgtatgaaaatgatctcttggcatcccgattaaatgacacactgtcactgtgggtaagaggaaagagccttcaatgtagcagcacagggtgcgcctgaaagaggcacaactgctgtggattttctgcctcgctccatctctcctatgtataatgaagccttgtttaaaggggcatgtggggctggatgttaagcacggcttctttttgtccgttacctgaaaacaatttctaagataaaaggaaggtgccatttccttacctcttcacccatcctcctccaccaaatgtattcaacttaaaactgtgagagagagagactgaatgaccttcctcagttttccctttctcattcaggagatactgaatatccgccagtttgtagttggtttccttccacttaaggcacacgctgactgcatcatttccttatctgttaatcct

SEQ ID NO: 45079 - DNA, 1063 bp, Homo sapiens
tacaaacagactcattgaatcaagagtctccagcctcatcctgtgaatagctcctcttctgtttccctctgactaggccttcagctgacttctttgctggaattttctaatcttgtgacagcagggaaaagctggatgtggtccatctcttaacacagacactcctccctgtcttgaccagctacgtattccactgaccagcctcatcatctctgccctcaacagtggaaatgatctctttcccacagatgttctccctccctccttccttcccttccccttcctacaaacgtgaactcttaagtctttactctctggtcttcagaagggtttggttacaagcagtcttcccatttaatttgtggctctgccttttaaaattgttttttgtcttttgttgttcagagaacgaccagagtattttctccccagtgtgtcccaacagattcttaggcaataatttttcttgttgatgatcccgtgctcagtagcacactacattgaagaaccctggccctcaccattgtgtgttggtttctgtgttaatctctgtgatctgaatcatgtcagagtgatgatagattttgtcattttgttgtgattattagtaatgttttactactgtattcattggggctgtgttgagaccagccaaatccatttatagctttactgagccggattgatttgtcaggatttcccaagtgaaagttgggcatattgcccagctcctgctggtggtatctttggggagtgtgggatggggtggggggatgtcctggggcaggggtgggaatgacacatataaggcattccattttttttttttttttttttttttgcttgtgcttattaaatagcaagggtgtttactcaggatttggggatcagttgtagccatgttgaatttggcaaactgagctgtgtgccctgaaagccctctttttatttcttcatttccatattgtctgacttacttcacctaggaatacctgagttatccagtccagtgttccctgatgagagtggaagattttcctggagaggcagctgtgcatggcca

SEQ ID NO: 45080 - DNA, 1088 bp, Homo sapiens
gatgtagattggcatggtcataattaaaagaatttctgtcttttatgtgattggaaatggcagcgctcccatcccctgttccctcttagcactaatgctcccaagaacatttggaacagcagctccataaactaaaataatgacatggtgctcgtgttctcccctaagtgaaacagcagaatttggagttgtttcagcttcaaaatggaagcctttgattattgttccccatttgacttctaagttctttgaaacttcactcaacatccagttccaacttgctccacctctggcagaaaccacagtcaggaccccagaagaagcccctctgaccggcccccactgcattccagcccatggtctggccagctccgggcccttgcttgcctaactcgaggatgttgctgcttgctgggctctctgggatcttcagatttcccttggttgcttgatatttccattgccgtcactatcagaaagcatttcccaaacagaagtttacagaaaattgaatcgaggtttcctcattgaatcctaagactcaaagcagacaacatgacaggacacatataactaacacaggctttaaacaggtggaggcgtgaatggagtactattcacgacattctaaagctactggagcacgggacacgtgtctgtacgctcctctcacaccccttactcggcagctgccccactcccgccgttgccgttgccctgagtcttccccactgttctgctgtgccagtgtgagcatctccccggcactcaagtccatgttctctccctcccgctcttcctcctgtctcttccatgctccctgttgcacgggacatcatgtgggcttgatgccgtacacagtccctgaccatggccccctactcttctccagaagtgtcacactagacaggagctgctgagtcaccaactcacctttccctagaatgtgggtttgttttttctcccccatcacttgcagaggtcttttttcaattatatgatcaagaatgagtctacaagaataccagcaccagacatagtgccaaatggccttttgtaagctgtttcgtgcccttgaggctcgcact

SEQ ID NO: 45081 - DNA, 1046 bp, Homo sapiens
cctcttacacaaatgaaatgctttgtgacaggtattcttcctcttgaaaggcttttttaagaaaaaaataatttttaactgtatactagataatctgagattgcaaaaggagcaccagataagggaggtgttaccatgctgtgcagcagaagaaggcttataattaagtttactacactttaatgttggggttattctgagctcaagatactcatagacctttgtctgatttccagggtcttatatctcacttcaccctttgtgtttagttactgaaagtttagggatgaagatagatttacagtttatttttacaagaaactttatactgtatgctttgcttccagtctcttgaagattatttgaattcatctgtgggtttatgcccatacacatggttagtcacagtaattcagatattaactgttaagcttgtaaattctagcagagggtggtgggaacagagcaaatccaaacctgtttctatgagtgagagattaagaccataaaacacttatctttcaactgtaattctgcagagttttgtatttagaggcagtactccgtgtgtgtgtgtgcgtgcgcgcgtgtgtgtagtgggggcagaatcaggaatttttttttacttcaaaagccagtagaggctgggcatggtggctcacacctgtaatcccagcattttgggaggctgggttggggggcggtgcggatcacttgaggtcaaaagttcgagaccatcctggccaacatagtgaaaccccatctcttctaaaaatacaaaaattaagtcgggtgtggtggtggcgcctgtagtcccagctacttgggaggctgaggcagtagaatcgcttgaacccaggaggcagaggttgcagtgagccaagatcacgccactgcactccagtctgggtggcagagtgagactctgtcccaaaataaaaaaaaagcaaatagaatgtctaatactatgaaagagaagcgttgtggcagtttacaaccatagaaaccagccaatagaataaaatactaaagaataaacctgagta

SEQ ID NO: 45082 - DNA, 1034 bp, Homo sapiens
ggttgcagtgagccaagatggtgtcactgcactccattctgggtgacagagcgagaccctgtctcaaaaaactaaataaatatgtactatgttcatgcagtagactataatttggccataaaaaggaacaaagtactgatacttgctacaacatgaatgaatcttgaaaacatgctaagtgaaggaaggcagacccaaaaggcctcatacagtacgattccatttatatgaactattcaaaataaacaaatctataaagacagaaagattagtcattgacaggaaatgaacagaagaggaaattggaaggtacaaggcttccccttgggggtgaagaaaatattctggaattagataaggataatggttgtacaatattgtaaatataataaatatcacaaattgtatgttgcaaaatatttaaaatggtgaattttgttgctattttcaaaacatgtgtttccctggaaatcgtatcctaaaacttaatctccaatgcaacagtgttaagaggtggggtctttgggaagtgattaggccatgagggctccacctccatgaatgggattagtacccttacaaagaagcttgagggagcctgcaagctcctgctgccatgtgagtacacatagaagtcaccttctacaaggaactgaatctgctggtgcctcgatcttggacttccaagcctctagaactgtaagaattaaatttctgttgtttctaagttatcccacttaaagtcttctcctatagcaacccagatggactaagacatttgttaagtgaattttacctaaaaaaaaaatttctgtatcagagttgttaaagaatgatgaaactagcactcaatacctgaaataaaagagcaaaactgaatttattgcttctataatgaaggagaactataccactacactggtcaggcatggtctccaggagcagaccagactgctgatctgatctcatttagggttttggagaagttcacagatataaataggttgacatcatctgtagaagtgtggtcacat

SEQ ID NO: 45083 - DNA, 1033 bp, Homo sapiens
ctggagtgcagtagtgtgatctcagctcactataacttctgcctcctgggttcaagtgattctcctgactcagcctcctgattagctggaattacaggtgcctgccaccatgcccggctgattgtttttatttttagtagagacgaggtttcactgtgttggccaggctggtcttgaactctgctgatctcaagtgatccgcctgcctcggcctcccaaagtgctgagattacagtgcctggcctgtatatatgtttatgatcgatttatcatatatatctttatgatctgtttatccataggtagaggttagagtgttatgatttgctaataaatacccagtaaataaatcaaagatttgaattactgtgttaatgagaaaatgaactttgaggaatgcaagtccttttaaatgatcaggtccagagggactttaaaatgagaccacagtcaggtcctactcccctcttgagctatatattcacctctctgtattcactgcttgctgttgctagaagtagctataaattaactaataatgctgcactggacactgtaactcactctatagtttaacaatgtatatagccaatcactaatcagtataatttgtgtaaaccaatgagaattcctggcaaacaactttatatcagcccactcccttgtccctgctcctttttttttttttttttgcctttaaaaagccacttgtaactgctttttaattggaatgcataagcccctgggttgcagtcttcaagcttggccaaaataagctctacttatattaattttgcctcaccttttatgttgctatcaacttcttttctcaatctaagctgaagagggaattaataatcattgctgtgcgaggtagtgggtctgtaatgaagaaatgttgagccttgccctgcagtggaatgttccctcctctcctcacttcaaagtgaccattcattgtatcagtatttgtgcaaggagatcccaaatttaaaatgctagaaaaggggataggtcttatcaaaattatttt

SEQ ID NO: 45084 - DNA, 1033 bp, Homo sapiens
actctgtaatcattggctagaagagggcatttcattgttgtgttttgtatttttcttattaaagaagtgtatcattttcaagtgttcattagctatttttagtttttccacaatttggttatcttttgtctatttttctgttagattgcatttttgattttgtaggcactctttattactattattattattatttttcgaggcagggtctcactctgtcacccaggctggagtgcagtggcgtgatcttgtctcactgcaacctccgtctcctgggttcaagcgattttcttgcctcagcctcctgaatagctggggctacaggcatgtgccaccaggcctgtctaatttttgtatttctagtagagactgggttttaccatgttggccaagctggtctcaaactcctgacctcaagtgatccatccgcctcagcctcccaaaatgctcggcctcccaaatctgttttagtggtacaggtactcatgcacatgagtaccgctcctggccttggcactctttatacgttgtaaacattgattgtttttgtctttaatatattttagaaatattttccctagtctttttgcttgtccttttaaagataggcccctgttatcatttgctgtaaatgtcatcatctgcatagaaaatccaagattatcagttgaaaaaaaaaaaaaaacagaactaataaacttcagtaagatgtccagatgagaaaaacacaaaaatcacagggttttaattttatttttaaaaatatggctgggcgcaatggctcaggcctataatcctagcactttgggaagctgtggtgggtggattacctgaggttgggtgttcaagaccagcctggccaacatggcgaaaccccatctctattaaaaatacaaaaattatccgggcatggtggtgcacgtctgtagtttcagctgctcaggaggctgaggcaggagaatcgcttgaaactgggaggcagaggtagcagtgagccaagatcatgccattgcactccagcctgggcgacaga

SEQ ID NO: 45085 - DNA, 1062 bp, Homo sapiens
aattttctgtagtttttgtagcgacaaagtctcactatgttgcccaggctggtctcaaactcctagactaaagtgatcctcccgccttggcctctcactcaaagtgctgagattataggcatttattccattattactacttttatggaaattcctatcttccttcaaaagctaaggctaggttccttaatatattgaaacgtatatatagcatgagtcctctctgcatccataatttaagtatgtattttatatgtgtatatttgatatgtagcgtaattttaatttcttttttttgaaatggagtttcgctcttgttgcccaggctggagtgcaatggcctgatcttgactcacaacaacctccgcctccctggttcaagcgattctcctgcctcagcctcctgagtagctgggattaaggcatgtgccaccacgccccgctaaattttgtatttttagtagagacggggtttctccatgttggccaggctggtctcgaactcccgacctcaggcaatctgcccacctcggcctcccagagtgctaggattatgggcatgagccaccgagcccggcccggtggctttttttcttaaagggttttggtaagagttagtgtacaatttgtcaggcacttcctacgtcccagatattgttctaaacatttttacagacattaacttcctaagttctcctaacaatcctaggaggaggtacagttctgagccccatttcatgggtaaaaaaacagcagagagggaaattaacttgcctgaggtcacacagctgtaatgtgatcaaggctggcctttgagaccaggcggctgctgactcttatcgatggtgttgttcttaaccaccactctatgctgcttcccaccgtgcccaaagagtgcctgcaggcttctctgtctctttcctgaaaagttacttacagtcccttgactgcactgctttaaagacgcagcacggagttcagcagtgaaatctggcagtgccggtgctgaaagatgtgaggattttgacagatgctggagatgctggctcaatgttcatgtcc

SEQ ID NO: 45086 - DNA, 1048 bp, Homo sapiens
gatggtcaagtcagatggagattccagataccttcgaagtatatctgcctggttcctcctacaaagggaatccagtctctgcaattaccagccaggcctctaagatctactcagactgtgtgaaccaacagacatggggcaggagaagcaggacacacgtcagctccctgtgggggaaacacaggaaataaaggaaactacacagcatcagactggacagcagctcaggtgtcctgctgctttctcccaattggggcagtctcagagcagagtatgaatctcatctttctctttctaagtaatagaagaacctctccaaaaaagccaaaggagaagaatccccattggttcatatttggaagaggagctccatagctgataagcactgggccatagggattagtgtttatcagatgtcaggcattaatccggccatttacaagatctcatttaatctttacaatgaatgctatgaaatatggactatattcatccccagtttacagcagaggactgagacacagaaaggttaaacagtatatccaaggtcaatactggagtagtatttgaatctaggaagtcagactcttaaatccacactcccgattctcacagtgtaagcctcttgttcctggggaggttccacaaaattgattgtgatgctgagttgggatgtctcttttataattgtgactataattaactctagctgatggtactcctagacacctagttttctcgatacctttgccagttgtagaaggggattgattaaccaagaccttcttctcctggttgcttttctaatccttctaggttcgggggcagacatgaggttttccccattttgttattggagcagttactacataccttaaacacaatgtattgttttcaccataggaatttggcttagtggtgggagggtgtgagtttgagtgccacagtttattcaaaggaataaaagtgaagccaaatgtacattgtattttaagaagtggcctagtcactaggaaatattaaaatctttttatccctctggttaatg

SEQ ID NO: 45087 - DNA, 1058 bp, Homo sapiens
tcctctcaacctgcagctctgtgaaggtcagactgtgaggagaagccaccccttgagcgctccgtctcctgatagtgccagcctggcctggtttcctgtttggtgaggctttctaggagcacctggcttagctctcacaggaggaggggcggacggggaggccaggcctcatgctcacagcgccagcctcctgtgagagtgggctgggtctcctttcctttcccaggcccttcctggaggcgatttctttctttctttctttctttccttttcttttcttttcttttcttctctctctctctctctctctctcccctctctcctctctctctctctctctctcttttctttcttttctttcttttctttcttcttttttttttctgaggcagagtctcgctctgtcgcccaggctggagtgcagtggtgtgatctcggctcactgcaagctccgcctcccgggttcatgccattctcctgcctcagcctcccaagtagctgggactacaggcgcctgtcaccacgcctggctcattttttgtatttttagtagagacggggtttcactgtgttagccaggatggtctcgatctcatgaccttatgatctgcccgccttggcctcccaaagtgctgggattacaagcgcctgggggcgatttctatgcctgcctcctgatgcagggcctgtgctctgagctgcgcctttcaggagagctctgcggggcttcatttcctttctaagctcatggcaagaaatgtagggtggaaaagacaggctctggaactccctggccacacaggagctctgccatttacacgctgtgcgacctcaattgagcaagtttcttaacctctctgggcttcaggaaaagggccaataatccttcacataaacacttaagagaatgcccggcatattagaagggcttcatgtttgctttaaaggtagcccttcccaaggatcttttaaggggcacttgaattttcagtaaggagaaggaagcccaggactaagcctaagctacccacaaggccgtgacagttaagacacaggat

SEQ ID NO: 45088 - DNA, 1556 bp, Homo sapiens
ttttaaaggggggtttaaaatcctttaaaggtacaatgtgaagcattatgaaatgataaaatacatgttttttaaaaacattaattttattttaagttccaggatacatgtgcaggacgtgcaggtttgctacataggtaaatgtgtgccatggtggtttgctgcacctatcaatctgtcacctacatattaagccccgcatacattagctgtttttcctgatgctgtccctcctccaggacccagtgtgtgttgttccccatgtattctcatcgttcggctcccacttataagtgagaacatgtggtatttggttttctgttcctttgttagtttgctgaggataatggattccagttccatccatgtccctgcaaagtacatgatcgtgttcctttttatggctgcatagtattccattttatatgtaccacattttctttatctagtctatcattgatgggcatttggtttttttccatgtctttgctattgtgaatagtgctgcagtgaacatgaacatgtgtgtgcttgtatctttataataaaatgatttatattcctttgggtatatacccagtaatataattgtataacccagtaataggattgcagtgtcaaatggtatttctggttctaggtctttgaggaatcgccacactgtcttccacaatggttgaactagtttacattcccaccaacagtgtaaaagcattcctatttctccatagccttgccagcacctgttgtttcttgattttttaataaacgccattctgactggcatgagagggtatatcattgtggttttgatttgtatacaaaaaagatttgtatttctctactgatcagtgatgttgagctttttttcatgtttgatggttgcataaatgtctttttttgagaagtgtctgttcatgtcctctgcctactttttaatgggattgtttgttttttttttcttgtaaatttgtttgagttccttgtagattctggatatagacctttgtcagctggatagattgcaaaaattttctcccattctgtaggttgtctgttcactctgatttgctgtgcagaagctaaaagacatgattttagaaaaagacatgtcaaagtcatacatgctcaacgacatagcgagtacatatgtaaataaaaaattattttatgctgtgaatttgaccgaaaataacctttacctcgtcaggaattacaatcctcacgtatggtaaaggatttccctattgcaaattattccacaacattaatgttctgtgtgctttttatctatcccaagatacaagtaaatttgacaaagatattaggtttgtaaacaaatttacgttcaaatctttgcctggaagtatctagatagaattttgcatgcaaaagagtatttacatctaaaaaattacatatttcaaattaaaatgattttagtgttatagatagaaggaaagagttattgaagtttatttctgttttggcagtgtaaatgaattacttacaaaattttagaagtctacaggtgtttttataaagtttgtgttatt

SEQ ID NO: 45089 - DNA, 1060 bp, Homo sapiens
caaagagtcagttgttacttgtaaacttcaagtcattgtttaggtcagagttgctgttgtctaaatgcaccaggacctagttgttgaaagggtaaactggaataaactttaattgggtttacaaaatgagaattcttactgtatattttctctttttcgggttgactttaccagtttgttctagttcagataatttagacaacattaactttgttgaattttttgtttgccagccggtcttcagcattttaaggcaacattattattacagttgtaatacgaatataattaccagagaaaaaactcaggaaaataaatgcttttatgaaaatgggattagaggtttgaaaataaacttgttaggagaaataatttcacaatgggatggttttttctttgttaagttttctttatgacttcattagtttataaaacattaattgataaaacttagaactataaattgaatgcttcagtgaactttattatttcagtgaacatttgttatttgatgtgaactttgtgcctgttttgaaatttactaaactcaaggcatgtgttcggaagagtgtttttgaagatgacctccccttcttagaattcactggatccattgtgtatagttacgatgctagtgattgctctttcctgtcagaagatattaggtaagtgatttgaatttcctgattttatttgaatttggacccttagaaggtactattatggtaatgtttgtgaatatactgagttttacaggtgaggtgtgttcaatagataattatttctatgtatacactatcaccaagttttacatttcaaataaaagtcactgaattaatttgtaatctgtcagtttgttcattcataagcttttctattacttcagacagtttttttttaacttttttaatatatgtgctgctgaagcgagcacgacagttttttaactttcagtacttaagatgttatatatagagctactgaacatactgtgtttattttaccaatttagggaaaaagtgcaaaaattatttaacctttaaatgcacctttatatttc

SEQ ID NO: 45090 - DNA, 1039 bp, Homo sapiens
atttcacatattttattaatgaagttcttaaattaaattctcatatttagccaagtattcatttggctgggaggtagaaagcctactaaccaactttttttcatgaacaatatttttaaagtccaagatttttaatacctacattagggaaattctagaattaaattcttacaatgtggactgcatatgaggcttttagtgacagggaatttgttgaaggctatctgtgggttgtattttggtataacatttcctaattttatttgtggtatgttcatttgatatcatttggtaatacctgaaaacaggaactgattttactgtgttgctttttcatcatttctagctgaaatgcacagagacctggagccttaacagtctggttaaacacctcttaggtaaacagctcctgaaagacaagtctatccgctgtagcaattggagtaaatttcctctcactgaggaccagaaactgtatgcagccactgatgcttatgtacgtgcttaaagatctttagaaattgtgatgtgttttaaaaacattattataaatgactttagaaaaattttattatagtagtggcagaaactctaccaaaatattttatatcaatttggcattgaaaaatgcttaggaagacatttagtgaaactattcattttcgatattaattagcaagtaccaatcaacagattgttcaatgctagtttattttcattgtcatgaagccaaattaatgtctaatttgtatgttaaaaaatgtgaacttgctgaaaacatgaaaggctaataaatccaggctgagcaagcataaatagtactgatgatggatttgatatataaacaattcagaatgaaaataattatagtacagtttctattttaaaactggccttatttcttatatataaaatgtggtgaaattttagaaaaattgcctccaaatttagcttgttgctgccattagatatatttttatatttacatgtttgtatgtagtgaaatctgggcttatctttatatatagcactattgtgt

SEQ ID NO: 45091 - DNA, 1066 bp, Homo sapiens
agggtgggatccatcagggcccaagatgagtgtttcatctttgttacttgtggcaaagcagcccttacttcttttactttgtagcattgctatgtatttggcttctagagttggggctttgtggctttcttattgcagtgacacaaccagctttctcctagtctggagattatacatccttgctataagtatttaaaatgctttctatataatgctttaaaacatgtaagatggcttatccccaagatggtagctaataaacactaagtgataaagtaggtaaagatctatttattcatttattaaatattgttggtcattttacagtgctttctaacatactgatttacatttctaattttcttctgtcatttttctccaaaaataatggtcatgtcatccaacctcagtgctgtttttagaggtcttgataagccagtgagagcagaaggagccacgtagtagagtgggtgagcccaggctttttgttgcacagaccaatgtgaatcccagccatgtgacctgggatgtacctgtttctccaaacatggaatgtagatactagcataatgtccgttttaccgttttatagaataattgtgaagacttaaagggacaaactattcgaagcatctgtattgatataaagttatcactattctcgtagcttccttttggagattttaaatgattgtgtttgttaagatgttaattaaattaggccattttgctaaatgctcttaaaaatatggcatgactgcctcatataaaatgatatgatattctttataattgtcgttgagcctctgtgggtggcaggccctcctttatatgttaaggtagaagagtctttattcttacttctcctccctggagagccacttcctatgaatgcctgctggttctctgtagtcagaggtcttgtggctgtaacttagagtcagtctccatatccctgggttctgcatctgtggattcaaccaaccacagattgagaacattcaagccaaaaaaaaaaattcacagttttaaaaaaggaaaagttgaatttcttgcatggagtacc

SEQ ID NO: 45092 - DNA, 1120 bp, Homo sapiens
tggcacatgcctgtagtcccagctactccgggggctagggaatgagaatagcttgaagccgggaggtggaggttgcagtgagccgagattgcgccactgcattccagcctgggtgacagagtgagactctgtctcaaaaaaaaaaaaaaggaagggcttacattttattttggtgctgactgggaatgaaggcaatgagggatgactgttggagaaggctgtgcttactaaacagtattattaagtagcagcatacatggtgttatactgacttctgattttgcaatagtacagacaggttcagattctcatttccaccttctccttctgcctaggtgaataactgctgggttatagtacagatgactgcagatcatttggaatttactttaaatgtaaacagtaaaaatttgaaagagagggaaagtgattgaggcaatttggggattgaataagaaggtctttttgttggaattcatttaaggaaagaaaatgaaaatttgatccctaatattatttaatgaagtggctaaatgaatatctctgctttgtggtttgaaaattaatattgattttttttccccctagaggaagaaatcctacttagcgacatgaacaaacagttgacttcaatctctgaggaagtgatggatctggctaagcatcttcctcatgctttcagtaaattggaaaacccacggaggttaaatattaccttttttttttttaacttaaatcaattctgtttatttttttatcacattttcctatatgtgaagaatactattcattaaggctgactcatagaaatttgcttgaatacacacacacagactgatgcataaatttgagaaatatctttccagttgttgaatagtgaatccaaaggtttaagccttttctgtctgctttgtaggatgttttatgaaacaaaggaatagaaattgtattcatattatacattttgaaattatatctatattatattttttgtcaaagcaaaataaattatacattaaggaaaatatttaagattcaaagttgtcattttctttctgttaatgagtatctttgatttaataacatttatagtttggtcacttgaaatctatagtgacca

SEQ ID NO: 45093 - DNA, 1028 bp, Homo sapiens
attccaaaacacatttattgtttgctcatagtttcagccttattcagaaagaatgcgactgacacatgatatagagaaacttgttccaaaaataacattaaaatccacgtttactacttgagaatcgaaaatattgaggtgcaataaagaataaaatgttttaaattatccaaatttaaaatttatgatagctttccccaggggcagtttattatatgctattaatgagccttgtttatgctggaaatgttccatctttggccttgcgccttagaaaccattcatgagcacatatttaaaccggagcacacatgttcttttgtagtatggcttgcacatctgccagctttcgacaaaattgtaggccctgttaataatagtccttttgtgtttggtgaaaaagatacgacactgtcagtggttttgcttttaagatttcttttaaactttcagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataagggtaagcactgaagtatgtttgaaatgactcacctgtgatacctaccactgactttaacttaggatccagttttggatggtttggaggtcagggactttgtggcatatagttaattattggatccttataagcttttgtctccttagtgcttttgtctccataaagcacaatcttactacttagaaaaatagagtaatagcattatgatgataaaaatatctttccctttgtttttttgtatttctccaaatcattatagctctcatttagaattattaaagctgagaactctaacaatgaacttttattgtttagtggttaattatcttgattctttgttttgccctttcttggccactcaggaatctttcaagctcactgtggacagggaaagtgacttgggtagagctaacataacttcattgtgctg

SEQ ID NO: 45094 - DNA, 1031 bp, Homo sapiens
ccacacagttcttttgaagagcagcagtttttcattttgataaagtccagtttgtcgattcgttcttttagggattttgcttttagtgttttgacccaaggtcacaaagatttgcttttatgttttctcctaaaagttttatagttttaagttttacatttagatttacgattcatttttagtaaatgttgtctattgtatgaggtattgattacagtttatgtatttttcacatattgttccagctccattttttaaaaagactatgcttttacactgaattgactttgtacctttgtcaaaaataaattgactacatatatgtgggtctattgctgcactctctattctgtgttctgtggatctatttgtctgtcttgattggtgtcttgattactgtagctttataataaacctggaaatcaggtagcgcaaggcctcttgctttgctcttttctttcaaagttgttctggctattctatgtcctttgtatttctgtgagcatgtcagcatcaccttttcaacccatatgcctgctgggattttgaatgagtttaccttgaatctagatatcgaaacaattagctgtcttgatagttattgtcaccgttttataccgaagaaactaggcatactaaagtaacttggctaacatcacttaccttgtaagaagtagaactgggctgtttgacatcagagcttattctttataccatttcctatgttaattagaatacaatattaatttcataaaggtaaaggcatatctgttttgttcctatttgattccttgtgaaagcacaatgcctagcgcacaatagacacttaaacttatctgttgaatggacaggtgaatgcttttaaagtctttccatatagaaaattaagtttcattacatttgacttgatctaggttttcatttcatagaatggagagcagactctgtaaatattttgccccagacctagctttattacaaacattgtcttaattaggattctgtctacccagaatagaaattaactcaag

SEQ ID NO: 45095 - DNA, 1031 bp, Homo sapiens
aattagccagcccttaggaagagactggaattgggtttggaaaatacaataggtctttctttttatctgtagtctttagtgagtcttcctcatttttctctctgaagagataagcattctctgcatatatatagcattcttttagattttcgtgacataaagtattatttaaactttcataaggtatcttgattttaagttgtaattccttgagatgattgttttctttattgttaatatgtttcccttcctgtttttttttttttcttttttcttttgtttgtttttacagaggtaaataccggattgtatacgtaactccagaatactgttcaggtaacatgggcctgctccagcaacttgaggctgatattggtaagtgataaagaaagatctctgtaaatacttactgagttaatatttaaagttaaacctatggatggacactggatttcacttctgttaaagtttatttcaaacattacttcctccaggaaatctctgactctctaacttgctgtttcacctatcttatcccatgatactctataattccttttgctatagaaattaggctctgttatcataattacctgtttatatatctgttttcttctgctaggctataaacttttcaagggaaaaatatcactttttaaaatttatgtttccccagtgcagtgcttggcatataggcacttaaacatattgttgaatgaatgttgaatcctaggttctgtgaaattttaatttacttgtttttcatgttctgtatctaaattaagtcagtgtagtggttttgtaccctctttgttcataagaatcacttttcaaactttaaaaaaaatgtaggtaaccaacacccaactctgaaaattctgatttaacaggcctgggttggcacctggcattggtggtttctcacaggtgattctgatatatagcccgggttggaaaccacagtacctttgattagttgccactagtgagtatgatttattacaaaaaccaaaaacttagataagtcacag

SEQ ID NO: 45096 - DNA, 1013 bp, Homo sapiens
ttcttttagtaaccctttaaaaatataaagagttacatttttcactggtgggccataacaaaacaggctgtgggccatatttgtccgaatgtcttctcagtgatctttcatccgtatgtccttttactctaggatgctgtgaaatcctggttaccccttcttgtatcacattgaaaacctaaagtttgaactattctatagaaattttattaaagcttttggtattagaatttccctttcttccctaattataaaaaatagcaaattttggccgggcatggtggctcacgcctgtagtcccagcactttgggaggccgaggtgggtggatcacctgaggtcaggagttcgagaccagcctggtcaacatggtgaaaccctgtctctactaaaaatacaacaattagctgggcgtggtggcaggtgcctgtaatcccagctacttgggaggctgaggcaggggaattgcttgaactcgggaggtggaggttgcagtgagccgagattgtgccattccactccagcctgggcaacaagagcgaaactctgtctcaaaaaaaaaaaaaaaaaaaaaaaaagtgaatttttacatgaatattctacatgattggcatatttacatgaatggtttaaaaacccacaataatagcactgttttattttttattttgaaaattgtagattcacaagaagttgtaaaaaaaaaaatacctatatagaggtcctatgtacctttcatccagtttcctgaacagtaacatcttgtgtgactatagtacaatatcaaaactaggaatatgacatttgtacagtatctagagtttattcctatttctctagttttgtaagtactcttttgtatggcatgtgtattgttctatacagtttaatctcatgtacatttgtgtaactaccactgcagtcaggatgccaaatgttcccttaccacaaagctccctggagctgttcttcccacccctggccctagccactggcaaccacaaatctggtctc

SEQ ID NO: 45097 - DNA, 1048 bp, Homo sapiens
tgcagtggcgggatcttggctcgttgcagcctctgcctcctgggttccagcgattctcctgcctcagcctcctgggtagctgggattacaggtgcatgccaccatgccctgctaatttttgtatttttagtagagacggggtttcaccttgttggccaggctggtctcgaacttctgagctcaggtaatccgcccgccttggcatcccaaagtgctgggattacaggcgtgagccactgtgctggccttaaaataagatttttatacactaaaagaaaacttacatttttcactccattaagtagttcactgtgaatttttgatattgaagcccatttggttgctgtcaaaaatagatttgaacagattattcagtatgactcttgtagtgaaattattgccttgtttcctctgcttaagttttcagtggcttttgccacagtccttaaaggttttataatttttttaatgtttaatttttaaatgtttgcttaatatttcttagtatgagtgtagataatgatgaacatttagatgactttttactattataatgttgcagtgaatatttgtttacatttatcttttggccaataagcaaatatttttgtaaattagaatcctaaaattgaaattggatcaaaagttatatgcacttgaaattgattaacttttcctaaatctaaaatagtatagtcttttttatattgtcagcataaatgaatgcacttatgtaaatgaatatttttaggcgttaagtaaaatattctgtggaaattgaacatttaagttgtttatacttctatggaaatcgtttacgcttttaataaagaagcacaagtttctacaaaatacattctaacagatgttttctataacattcagtctcaagattactagtaaatacttctttgaactgtaaaagcaatctttcaatattataagaaagctcttgctttagtaaacatttagaaactcagctttattatcataagcaagaataagaacagtgtaacaagttttatgcacactcctttgtaaaccctca

SEQ ID NO: 45098 - DNA, 1198 bp, Homo sapiens
attggagtttagttaaagagataatgtatataaatatataacatagtagcagcatataattctgtcttacacaagatttttctgaatagtataaacagttatgtagcctatctaggagtttgtgaatagagtttaaaattttgttttgaagctgcaaatttgattagaaattaaacagtgaagttattacttaaggaacttcgttttagctgtctgaacaacttactgtataaaaatctttaaacattctgtataaatatgtgataagatatgcaatgaccttaattttatagattagaaaataaaaacacactcattaatttacataactgacagattaagtgaaacttctcttctgatcacgttagcagaatgccaaatcttgtcgtggcactagaattagacggtagttttgataatacatgatttgactatagacatttgttgaaactattggtagttttaatcactcttgtaattttcaaactatctaacgggagaggattatccatcctgttttctagacaaactgtttcatctgaatgaaatatattcctagagataattatcactacttcatcttttggttttattttgcacatagaattatagttcacaatgactttctgaagctctaaagttgcagctgtgagcttctttggcctgtagggactgggaaaaagcacccccgtcctcccccaagcccccccaccaaaaaaagttaaagtgtttttaacaatagctgtgggctttttgtagtttcagaacttaggagttgcccaggctggaatgcagtggtgtgatcatagcttgatgcagccttgaactcctgggttcaagcaatcctcccacctcagcctccagagtagctgggaccacaggtgccaccccacccagctattttttttattttttaatttttttgtaggtatggggtctccccatgttgccctgcctgtctcaaactccagggctctcaggtgatacccaccacccttggcctcccaaagcaccgagagtcactgtgccaggctgagtttaaaatttcttgagttggagtttatggctattttttccactagttattaaacatgtatttttgtataaggcactgtattacattttgtggggggattcaaagctaaattagatgagacgcatcatctattatggaagatgttacttaagaagaaatgag

SEQ ID NO: 45099 - DNA, 1032 bp, Homo sapiens
gccaacaatgcttcctcagtaaatacccattttgtcttggtgggatttctataaattgcaaaatgcagctattatgaagctgtaaaagagaaacagaaacatgtaacacctgggactgttttattaggcccaccgtatgctcagaacatgaaatctccactgctagggttatttgattgaaattatcttttgtgttgatgtgagagtttagctctgagattcttccacatgtaaaatgtaatcccccaaagtatttggcaagcacattttattgccttgggtcagataattgaaacattaggcatcatatatatagcatgtaaaaagtaaaacagaaacatttatgtttctcaccaagcagtaaattagtactcaactaataaatttcttaaactccctaataacagaatatggaaacaaaaaataaatctttccaaaagaagagctcatggacacatttcctcatatatgtatacataatatagtagaacacatgataaataacctataaaaatgataccaatatcattcatcaagagacgaggctcttctttaaattattaatttcatctgttacaggttttattatgactgtagtatgctgttttcatctaccttttatgtgtagttaaaaaaatagttttctatctctttacctttatttcagcctttaaaaagattccattattttttcattaatcttgtttttcagtttttcccattttttcttttaaacatttcttaaggaaccatatttaagattttatagaatacttagatttctagttgggatgtatcatttaaaattagatatgtagagagagtgttatgatatatttccttacgatatattagtggttatagtacctaaatttgaatagtgattctgttcattcattcattcattcattcaatattcacttccaggagattggggacttatttaaagacagagtagttcacattatagttcctttttttagtccttcttattcgttaaagaaaagactaggaaatgtttgttattacaaa

SEQ ID NO: 45100 - DNA, 1021 bp, Homo sapiens
aagtcacgtcttacatggatggcagcaggcaaagagagagcttatgcaggaaaactcccccttataataaccatcatatcttgtgagacttactcactatcatgagaacagcatgggaaagacctgcctccatgattcaattacctactaccaggtccctctcagagcatgtgggaattcaagatgaaatttgggtggggacacagccaaaccatatcagttacttatactatttggtgttctctgagctttctgggtctgtttcagtttctgtcattatttttggaaagttttcagccattattacatctaatatttcttctgcttcattttttccttcttctactgatgttacaccttttgaaattgtcccacagttcttggacgtcctgttttgttgggttcatttccctctttcttttttttctctttgcagttcagtttgagaagtttctattgccttatcatcaagctcactgattttttccttggctatgttcagcctactgatgacctcatcaagggaatcctttacttctattactatgtttttgatttctaacacctccttttgagtctttcttagagtttccacctatcttcttacattacgcatttttatatgttgtctatctttttctgttagagcccttaacatactaatcatagttattttaaattccccatctgataattccaacatctgtgtcacatctgagtctgactctgatgattggtttgtcttttcggactgtttttcttgtcttttggtattcctcatagcattgtattgaaagctagacattgtattgtatactaggggctgagataatatgtttttagtgagaaaatttatgttaatatgggtttaatatttgttgtagctatagctgccacagatttcagaaccattcagtgtccttgtttttgcctctatccttgagggattcctaaattctcttcttcagagaaagtcagtgtcttgtagctcttttgtatgtaatcaattattattatactg

SEQ ID NO: 45101 - DNA, 1035 bp, Homo sapiens
tctcagaatgccctctgggctggaaatgtcttattaaatttcaaagattcaagtactgagacccaagggagatggtttgctcttttcttgtactggggtagggaagtgagccactttctctttattgggaaaccttgcctgatgggtagaagttgtaggtgggcatattttgctcaaaacagacttctccatataaaaagctctgctcagtaaaggagtgacctatcttggaaattcaagcatcctctgacattataatattaaagcagaggacaggtgtctgttagtcgaagatgacaaaaaaattgagtgaggttcccaacaatggtaagattatgtctggattcccccacaaagactgggttgaatctagtggggtccatgacttatgttagtgtccactcacgttgaccaatctccagaaggaaaatgctggatatatgggaaagttaaggatttaaagagaccatacatgatgaattttaaaaacaggagacatgggagaaggactacgtgtggactctggttttgtctttgccactagatggctgagtaaccttggaccagttatttaaatgcccaagcctagggttgctcattatgtaaaatgaagagactaagccagatgttttcaaacacccttttctactctcagaatctcaaactcagatccttgacaaatgaacagagggagggaaatgagctatagagccatgtcatgaatggaaattcagcattactagttagtgaagataggcctcaaccaaaaggtatttgatagatgtaaacattaatcaaagtgatggatttcttctaaaaaaaaagaggaatatggtgaccactctaaaactttgacttttttaatttggatttttccaaactaaaaaaaaaaaaaaaaaaaaattaaaagtagcatgccaagcagttctgtcttatcactctcttcctttgtgttcttgacagcaacctaataatttctggagagacatgagatataggtagataagtgaataactgttgcttaatgaaaatctt

SEQ ID NO: 45102 - DNA, 1051 bp, Homo sapiens
aaagttcatagccttaaatgcctacatcaaaaagtctgaaagagccccaatagacaatctaaagtcacacctcaagaaactagagaaacaagaacaaaccaaacccaaacctagcagaagaaaagaaataacaaagatcagagcagaactaaatgaaactgaggaaccaaaaaatacaagagataaatgaaagaaaaagccggttccttgaaaaggtatataaaattgataggccattagcaacattaaccaagaaaagaagagagatccagataagctcaattagaaacaaagcatgagaaattacagctgataccacagaaattcaaaagatcattcaaggccactgtgaacatctttatgcacataaactacaaaacctagaggagatgaataaattcctggaaatacataaccctcctagattaaaccaggaagaattagaaactctgaacacaccaataacaagcagcaagattgacatggtaaaaaattgccaataaaaaaaggccaggaccagatggagtcacagctgaattctatcaaacattcaaagaggaattgataccaattctattgacactattccacaagataaagagaaaatcctccctaaatcattcaatgtattttgcatttctctgtgtccttcatttccagaaatcatggtttcttatttaagctatgtcactgaagatttttctctcatatcttgtatcatttttttttatttcattaagttagacttaacatctttctggtgtcttcttgattagcttaataatggatctcctgaattatttttctggcaattcaggaatttcttcttggtttggatccattgctggtgagctagtgtgatcttctggtggtgttaaagaatcttgttttgtcatattaccagaattgtttttctggttccttctcacttgggtagactatatcagaggaaagatctgtggctcagtactgttcagattcttttgtccaatgggatgctcccttgatgtagggctctccctgttcccctaggggtgtggcttcctgagag

SEQ ID NO: 45103 - DNA, 1049 bp, Homo sapiens
ctcatttattccacaggtatttttattttagagcagtttgaaatttacaggaaaaaattgcagttgatagagttcccacatatcctacagccaattttctctattattggcatcttacattagtatggtgtattagttataattaataaattaatgctgataaattattaactaaagtttatacctaatgcctatttatttagtttttttttaaacaaaatatcctttttctattccaggatcccaactacaatacgacgttgcatttaatcataatatctccttaggttcctcttggctgtgacagtttctcagacttcccttgtttttgatgatcttgaaagttttgagaagtactgaacgggtattttgtagaattttcctcccttgggatttatctgattttttttttttatgttctaactagactgtggttgtgtgttttcagggggaatatcacagaagtgaagtgcaattctcatcatgtcatatcaagagcacacactaacaaacaacatgacttattgctgaatattgaacttgatcacctggctgaggtagtgtttgccagatttctctgtaaaggtactgtttttacctccattctatattgtactccttcaaaagaaatcgccaaccacagttcatacttaaggggtggggaggttatgatctatttatttgaggacagaacatctccataaattatttggattcttctgcatggaagatttgtctactctcaccaatttactaattcattcaactatttatatccgtatggactcatggatatttattttatactttgggttataatctaataccactttacttattttgttgctcaaattgctgtggctttggccactgggggctctttcagttgattctcatgtttgtttgatatgccctcatgcatgtggagttgttgtattttatttgagcactgccttatttttttggtactaaaggatgttccaggatcatcacagatatattctgccccagtcttagaatcagcccattttccaaggaaccctaactcc

SEQ ID NO: 45104 - DNA, 1052 bp, Homo sapiens
gtggaaagctatcatttcctaaattaaggaacttaggtcaaagttaaatgaaaaagacctaaaaacagaaccaaagacagcctctagatttcttaccctcaagtctcctgttagcatactgcctatacacacagacacaccctctgccacactgctctcttccttccagaagcttggttctactgtaagcaacagctccttcatgggctgagaaggggaaaccaggatctccccaaccaagggcctatacttttatttttcaactctattaactgaactatgcttggagagagccctgaatcctttaactttaatgccatcttaggcctggaagttagagtgagggaaatgagcttggcttctgggactgtgtcaagttgaattttctgtcatttaatttcagatcctagctcatcatcagtgaagtccagcctacttacttgtaactattaacctttctaaaagttttcatcgccttggtaaagctccagaaatggacaatgctagtgactgcacaatattgtgactgtacttaatgccactgaactgtacactttaaaatggaaaatttatatgtatttttaccacaataaacaaaaaaccctaaaaaaactttaatgaaaggtggaaaataatttaacttacaatgtgaaaatacaatgtgaaatgtacaataaatcatatttatggacagatgcgtgactgggagaaaaaagttttcatctctatctaaatactcctcattttcctatggtttgggtgcctctcagccctcgttattcaacttataatcggctctgttttccatttcccatgcttcaccccctcatacgcatacacacatattccttttctacctccctacatttattcactctcccttcttggaatcttggtctctgctctttaaagacctgacaatctgattcgattttattcatccattgattcattctcttccagtccattcattctttgaatatttgtatacctaatactaggtactgaacatactttgggagaatataatagatgtggttttccgttatcct

SEQ ID NO: 45105 - DNA, 1101 bp, Homo sapiens
aaaagactactgttgcctttctgaagactaaaaagaaaaaaaacttaaaaatttaaagaaataaacttctgagccatgtcaccaacttaaccacccccaggtacctgcaacggctcgcgcccgccggtgtctaacaggatccggacctagctcatattgctgccgcaaaacgcaaggctagcttccgccagtactgccgcaacaccttcttatttcacgacgtatggtcgtaaagcaataaagatccaggctcgggaaaatgacggagaggtggaactatagagaataaatttgcatatataataatccgctcgctaattgtgtttctgttttcctttgctaaggtagaaacaaaagaataatcacagaatctcagtgggactttgaaaatatccaggattttatacgtgaagaatggatgtatcgcattacggtagtcaccctatgtgtaaattagtggcacatacttggcactccttaatgtcaactataagatgatccttttgtagttcatgagcgtgatgattgggtgttcatacgcttgtgtgagatgtgccacccttgaaccttgttacgacgtgggcacattacccgtctgacctgaacttcaaggatcgatttaacacttgtatttgtgggcttgttacttatgataacaggtggcctagtttcatggctttgtgtttaccgttttcgggtgcccttttttctggctgtatgctacacgcacgggtgcttttccgttgtccaactgtgtaatgtgtttttgtgtttgttcttttgtgagtcggagtctcgcgttgtcgccaggctggagttgcagtgttgcgatctcggctcactgcaacccccacctccggttttcgagagattgtcctacctcagcctcccgagtagctgggactataggcgcgcgccaccacgcccagctaatttttgtataaatattggcaaggatggtctcgatctcttgacctcgtgatgcgcccgcctcggcctcccaaagggctgggattacaggcgtgagccaccgcgcctggccaatgcagagctttttaatggctttaattttttaggtttgggagatacctgcgcaggttt

SEQ ID NO: 45106 - DNA, 1377 bp, Homo sapiens
tgccgccctccagcattggctaccacggctccatcgtgggcgcctacgccggctacccgtctcagttcgtgcctggcctggatcctagcaagtccggcctcgtgggaggccagctgtctgggggcctgggcctgccgccgggcaagccccccagctccagcccgctcaccggggcctccccgccctccttcctgcagggattatgccgcgacccctattgcttgggaggttaccacggcgcctcgcacctcggcggctccagctgctccacctgcagcgcgcacgaccctgccgggcccagcctgaaggcggggggctacccgctggtgtaccccgggcacccgctgcagcccgccgcgctctcgtccagcgccgcccaggccgcgctccccggccacccgctctacacctacggcttcatgctgcagaacgaaccgctgccgcacagctgcaactgggtggcagccagtgggccgtgcgacaagcgcttcgccacctcggaggagctgctcagccacctacggacccacacggccctgccgggagccgagaaacttctggccgcctaccccggggcctcgggcctgggcagcgccgccgccgccgccgccgccgccgcctcctgccatctgcacctccccccgcccgccgcccccggcagccccgggtcgctgtccttgcggaatccacacactttgggcctaagccggtaccacccctatggcaagagccacttatccacagcggggggcctggccgtgccgtccctccccacagccggaccctactattcgccatacgcgctgtatggacagagactagcttcagcctcggcgctgggataccagtaactacagctcttcctccaccccagccccctcaccctcctccctctccctcctcctccctccccacctgccgtcgccgctgcaacctccactactgcttgaccctgccgggattccccacccagcccttccccaccggactgtgtatttatttactataatgttagcttacaagctgggaatataagtgcattaacggcccacatgagtcaatggtatgcaaaaagtctgtgttctcccaaataataatattaatcccacaaataacgacatgatccccgcccctgttcctttctgttattttttcttagatataagttttacattttttattccttttcctctttttttggttttgattggtttggtttgagggagagttggggtctttgggttcttctagacgttttgttttcccttcctggggagtttcttgcatgagtcttaacttaaaactacgtttccgccttctctttttccctcttcccccttcattccctcttgtttccttccatttgcggttctgttt

SEQ ID NO: 45107 - DNA, 1033 bp, Homo sapiens
aggcatacacaggtcagtccataacacaaactgttggggaaatctgaataaggactgggtattaggtgatattacagaattattgctaattttcttaggcttgggaatgataccatgagtgtgtaggagaatgattattcttaagacagtgctcaccaaagtaaaggagtaaagtatcctaactgcagcttactttgaaatgttcagaaaaaaaaaaggtcaataaataaggtaaaatgttatcagtgttgaattcaggtatctggatatggatgttagttatactactctttcggcttctctatgtttgaaatctttttataataaatatttgagggcaaagggagtgtgacaccaaagtaatagtgaagacagtttaagaaacattgatcataacattccacagtaaccttctaagttctgaaaacttcaccttgaccctccttagtcttttccgtgcaactgattaatcaaaaggcattgctgattccaaagatatgagttactctttcgtactggtccccaaaagtctcattcatgtctttgtagagatgttcctaggcagtgtgatttctcaggagagtatgttgttgccatgagccctgcagaacctcccacttggagatccaagctgccttccaacttcccgtgaactcttctactccttttctgccaagccccacatcttacgccatcaccctgggggactgcaccatattctaaggcttcccagtgacttcttgtccattctccctccaatagtggtggtgtgatgatctactttgacagaattgaagtggtgaacttcctggtcccgaacgcaggtacgtcttaacagtttattcccaccaccagctcactttccccagcatgccactcccgtgtctgttgtagcaccttggaaaaggagagctgccgtgtctgagggcattttgagtcttgccttttcttatgccaagccctctccttccctctcagtgtatgatatagtgaagaactatactgctgactatgacaaggccctcatcttcaa

SEQ ID NO: 45108 - DNA, 1034 bp, Homo sapiens
gggatataaataggaaccagtctatgtaatcaagaagttactttgtctcctgatctaaatgcttgcctccagtctagggctcagaaaaaaagcctggttatttgaactggttgtcaatcaaggtccccttcattttcactttcttggcttcccattcagccagctcttgcagtggcctcttgctcatgcctttgcgctccagctgtttttcaatcactttggcattctgtgcatacgagtcagcaacttccctagcctcaatctcctcttcctcttcatcaatggtagacacagtgacagaactgaacttgcccatgtctttggtccgtttggtcatcatcaccttcttaggaggctcttgtttctgagtatatatgttcgttttcccaaagccctggccaaacttgacgactgctccatccacaatgaaggtaacgggagcattcttcggctgggattggtagaagagcagcagtccacactttgcacatttctttctgtactgtagttcaatgccttcaggtctccgcagatacatagtctcttcgtcttctgtgttacaaaacttatgggcatgtttggcagcatcaatcacacgggaccggtcccggggcctcatgggcaatttctctaactgacagtccagcactaggaccacctggccgcacaaacagtagtacacatggaggggcttctcgccgtcgtcatattcctcccggtcccgagtgtcagagcagactactgaccgagacactactttcggcatggtttccaggagcaacctgaaaaactctacgcaaagaagagggtcgcgccgaaatgacgtcacgagcgcgccttgcgccttttccctgcggctaccttagtaatacaatttaaatggcatttatcaacatttccataacatataaacatcaatattactaaaacaacttgaaaagtatttctttcacatttttccggtaagctactagcccagggccacaggtttccaccttgacagatataatttggtctgaggaatgacgttatta

SEQ ID NO: 45109 - DNA, 1034 bp, Homo sapiens
ttttttttttaacagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcctggcattcttgtctgcatgtgtgtgagttattttagaggtgtgctttcttgagccctcataaggaagtactggtgctaggttttgcaagattttgtatacactttgctccttgccctagggctcagagtggtggtttctgactacatttctagagtcagagcttgatcaccacaactcaattatttcggcatcttttcacctatgctgtgatttgttttttttttttcttctcaaaaattctgttcattggttccactcagcatcaagaagacagggacaaacaactcaagtgtcttaacagctgctggagtg

SEQ ID NO: 45110 - DNA, 1036 bp, Homo sapiens
gactcctgggacttctggtcctgggcacactttttgcaggcaacaaaatgtgcctgggagtgatggattttaatgtgctccagagtcctttcagaaggtggtcatttcccttggccgggcgcggtggctcacacctgtaatcccagcactttgggaggccaaggcaggcggatcacctgaggttaggagttcgagaccaccctggccaacatgcgaaaccccatctctacgaaaaatagaaatattagccgggcatggtgtcaggcacctgtaatcccagctacttgggaggctgaggcaggagaattgcttgaactcgggaggcagaggttgcagtgagccaagatcatgccatcccactctagcttgggcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctcagaaaacaccaattcaccacagtagaaccgggagcagggatagctcagcttctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagta

SEQ ID NO: 45111 - DNA, 1057 bp, Homo sapiens
acaatacagtaaagtaagtatagtaaagtaaaattaagaattatagtaaagtaggccaggcgcggtggctgacacctataatcccagcaccatgggaggccgaggcaggcggatcacctgaggtcaggagttcaagaccagcctggccaacatggtgaaaccccaactctattaaaaatgcaaaaaaatagctgagcgtggtggtgcatgcctgtcaagtcccagctacacaggaggctgacgcaggagaatcgcatgaacccgggaggcagaggttgcagtgatccaagatcacgccactgcactccagactaggtaacagagcaagacttcatcccaaaaaaaaaaaaaaaaaaaaaaacaagaatcatagtaaaataaaattaagaaagacatggagatcttgagtaactgaacttatttcccttaaggtataaaaatttaaataacctgtatatattttgtaacagctttattagggaggtaagtgacttacaatacattgcacatatttaaagtatagaattcgacgagttttgatgtatgtttgcacctgtgaaaccatcacaacaaacagtgagcatatctatcacccctaaaagtttcctcctgtcccttggtaatccctctcttacctgtcccacttctcttcctcaagaaccacttacctgcttttgtcactgttaatgtacgtgagtttacattttttagagttttatccaaagggaatcatgaagtatgtactcttttttgtctgacttctttcattcagtgtagtgattcatcatgttcatacctgtatcaaaggttcaattctttttatcattcagtagtattccattgtataagtatattacaatttgtttatccattcacctgttgatgaatgttgggttgcttctgatttttgactgttgcaaataagttgctatgaatatttgtgtacgagcctttgtatggatatatttccctttttcttggaataaatatataggaatagaatggctgaatcacaagttaagtgttatgtttaactttttataactgcaataaaaca

SEQ ID NO: 45112 - DNA, 1101 bp, Homo sapiens
cacctgtaatcccagcacttgggaaggctgaggcaggtggatcacctgaggtcagaaattcgataccagcctagccaacatgatgaaacttcatctctaccatacatacaaaaattagccaggcatgatggtgtgcacccatagccccagctgctcgggatgctgaggcaggaggatccctcgaacccaggaggtgaatattgcagtgatccgagatcgcgccactgcactccagcctgggcgacagagttagactccatctcaaaaaaaaataaataaataaaaaattatggtgagcaccagtcaatgaatatctttatggggcttggattaacagtgtaacatagtgtgaatagaagcatgggctttgaaatcagacagaccttgggtttcagctacactactttccagtattgtaaccttggataagttacctaatctctctgtacttcagtttccttttttggcaatggtatcatgagaatgcttacttcagagggtgtggttaggactgaatatgataatccaggcaacattgttagcacagaaccctacacatgttgttagctattcgttaagaataaatgtatacagatcaggcatttgattgcaaccatcaaagcaccagtattcaccaaatcttagtatgcaggaacacagtagaggcatctgttttctagataacgtcctagagtcagactacctgggtttaaatcccaattatcaatagaaatctgaaatcaactataggtcaagtctttattgtatcatttcttgataattagctataatatgccctatttaaagactgaagtaaatgttactagtatctccgcctaataaatgggggcaagacaatatcaatagctcttataactgtataacaaataattgcttgctgcagatttctcttccagttgttaattagaaagttcagttaaactttgctaatatatagccaaaaatatttaacatgtactttatactaaattttttgcaactccattaaattaataaaactataaaaattcttgatttagaaaagtaattctcaggttcatctggcattttggcaatgcaaatcttcctggtatcccaaaa

SEQ ID NO: 45113 - DNA, 1058 bp, Homo sapiens
caggatgggatattttgcagagagaaaattgagccaggttgtgagtttgtctttcgttacgcatgatgggtggcaggttgggtttcttccagattttcatgaaagccagttcctggagtttggacggcttgctctcctggattgggcccacctgtgcagcctcacagtctctgaaggcgctgggcccttgtctgccctgaagccagcctcagaaggcttgagacgccacaaaacctcccaatagtccatcaagactttgatctcttggggagctcctcacagattctatcacagttcttaaagcaacctcttaatactcaaatggtaccccccaccttttgtttaacattgatggcatatgcagcactattctctatattctctcatttcaccatcacaacagctggtagacttgtgtaggctgataggcaatgtccctttgtggacggggcactggggcccagagaaggttccgtgttctccttgtctgaggtcagagtgagttgtggcaggacgagaaataaactcaggacttgactttctggcccagaacatggtcactactccacactggtatcttctatctctacctttaataattgataagtggcatattcttagatgtgcagctttcatttaaacgagccttattaccataaaataagtgtgtgtgtttctattccagtggaacagctgagaattgacgcatcttaatgcagaacaaactttgaaaccacaggcagtgggggtgagaaggaaggagagcattaaacccagccatgagtgggattggcctcccctctcgtcatcccatctccctcccaagctcattcctcatgattcaagctaatctcacaggctgcagggcccagagtgtgcaaccctgtgccttccccctgaagctggaccagcagtgaattctgttccccaaggctagacacacaggaatgaggtcagacaggacattcttaaaatccaggacatcttcatccttcagaaaagaagtggtcgtgtgcatcccaccaaagctttgaaggaggaagtactcgcttaccaat

SEQ ID NO: 45114 - DNA, 2018 bp, Homo sapiens
tcagtaggttaggtgtactaaatactttttttttttttttttttttgagttggagtgttgctctatcgcccaggctggagtgcagtggtgcaatctctgctcactacagcctctgcctcccaggttcaagccattctcctgcctcagcctcttgagtagctgggattataggcgtgtgccaccacacccagctaatttgtatttttagtagagatggggtttcaccatgttggccaggctggtctcaaactcctgacctcaagtgatctgcccgcctcagcctcccaaagtgctggaattacaggcgtgagccactgcacctggccctaaatgcatttttgacttaagatattttctatgtatggtggatttattgggacatacttcattttaagtcaaggaacatttgtattaaacagtattgctggtatttcttgtcccaatattaccgaacagggagtggatgtgactttttttcttttttttaaaaagcaaaaacaaaaaacttttaacagatagggcctcacctctgtggcccaggctggagtgtctatgggctgaagtacagtggcgcgatcaccactcactgtaactttgagctcctgggctcaagcaatcttcctgcctcagcttcccgagtagctgggaccacaggcacatgctaccacacctggctaatttttattttttgtagagatgaggtctatgttgcccaggctggtcttgaactcctggcctcaggcaatcctcctgcctcaacctcccaaagcattgggattacagatgtgagccactgcatctggcaactttttcttacactgaacaagccagtattggggccggggtctcagacactgtgactgatgctgtttatttacctgtttgcatccagcattgctgacaaggcaagagtaagtaactgctgctcactgacatttgggtatgcacagcaaagggctccatgtaatctgatggttatgcccatgaaagctcattaagagagctcagatactaggcccagaggatcagggcttcttaggtgtgcagggacacttggtgaaaatggttgtatcagttagctattgctatataacaagccatccccaaacagtaactaaacagcagcgatttgttattgttctccatcttttgggttcgttgggttctttgtagatcttgctgagcttactcatatggctgcatacagtgtacagctggactgtcctggggtggaagctccaagatggtcttacccatacatctggggcattgctggggacagctggaagcctgggagttccctctatcctcttggtctcccaacattctgatcactcagtagtctagcttgagttttatttacatggtagtttccaaggccacttaaggcctaggctcagaagtcccataacatcacttaccaagtattctgtcggtcaaagcaagtcacagggccagcccagattcagggagaggggaaatacatgcctgttgttgttgttgttgttgttgttgttgttttgagatggagtctctctctgttgcctgagtagctgggattacaagcatgcaccaccatgcccagctaatttttgtatttttagtagagacagggttttaccatgttgcccatgctggtcttgaactcctgagctcaagtgatccgcccgcctcggcctcccaaagtgctgggattacaggcgtgagccatcgcgcctggccttttttgtttgcttgtttgtttgacagaatctggctctgtcgcccaggccagagtgcagtggcacgatctcagctcactgcaacctccgcctcccaggttcaagtgattcttttgcctcagcctcccaagtagctgggattacaggcacctgccaccacgcccggctaatttttgtatttttagtagaggcgggggtctcaccatgttggccaggctggtctcgaacttctaacctcaggcgatctgcctgccttggcctcccaaatcactgggattacaggcatgatccaccaca

SEQ ID NO: 45115 - DNA, 1039 bp, Homo sapiens
cagctacacaaatggtttgaggtgtaggggtgctcctctcttcttcccttgccctgctgggaggcagggttctgggtttccctgctctgcatctctgggttggcaatcaaggtcagccttagctcacctccctcacccctcgggcactggagaactggggtgagatggatgtttctctgggccgggggtttagggtcaggctgcttggaagcaggaagatggaggacttgggatctgtgtcccttggtgatctcctcttacgcctgtctgtggacttcacacacttggctgtaatcacttgtttacgggtctttctcgactaaattacataaggtttggatctaggcactttcactacatctgacttttttaaatccctagcacctcgcatggtgctagtacaaagtagaggttcagtgagtaagtaaatgagaccagcacacctactttcaggaaaaaaggattgagcaaagaccggcaaatatgtgggtaaggattaacatttttgtccctggattgcagtagtctctatacttgaatacagttcatgggagttaaggtgtagtgtagggttttgggttttgttttttttttttttttgagacagagtctcactctcttgcccagggtggaatgcagtgatgcgatctcaactcactgcaacatctgcctcccaggttcaagcagttttcctgcctcagcctcccaagtagctgggattacaggcacatgccaccacgcccagctaatttttgtatttttagtaaagacagggttttgccatgttggccaggctggtctcgaactcctgacctcaggtgatccacccaccttggcctcccaaagcactgagattacaggcatgagccactgcgcccagcctgaatcacttttttgataaatgaggttttttttatttctgtattttctctcttcctctcccctcattgtcccaataaaattacatttcaaagttttaaaaatccagccaggtgcagtggcacacacctgtaatcccagctcctcaggaggctgaggc

SEQ ID NO: 45116 - DNA, 1046 bp, Homo sapiens
cctgagtgacagagcaagaccctgtttcaaaaaaaaaaaaatttaaactaaaattaaaagtaaacatttgttgtttttattatgatgattcttgagccaagtactatctataataatagcatttccacttttatatatatatattttttaaaaaaagcagagttaataattgctttgttttaaaaatgtgcttagttttcatttaggttttcccaaaccttccagaagctctctaaaatgcctcacagtaaggtcttgcacacagttggacttctagatttatctgcccattttttccctctctcctaaactaagacaagatttggagtaacagtttggctgctccagccctgccacacaactgtcaatgtggggttccctgaagccctagtctttctataattttggcagaacacatcttactgtattctttctgaaatgtctctatggccaggtgcagtggctcacacctgtaatcccagcactttgggaggctgaggcaggaggatcatttgaaaccaggggtttgagaccagcctgggtaacatagcgagaccctgtctccaaaaataaaatttgatttaatttaaagaaaaaagagaggccgggtacggtggctcatgcctgtaatccctgcactttgggaggccgagacgggtggatcacctgaggtcaggaattcaagaccagcctcgacatgtagaaaccccatctctactaaaaatacaaaattagccgggcttggtggtgcaggcctgtaatcccagctactcgggaggctgaggcaggagaattgcttgaatctgggaggcggaggttgcagtgagccgagattgcgccattgcactccatcctgggcaacaagagcgaaactccgtctcaaaaaaaaaaaaaagaaaagaaaagaaaaaagagaagtatctctgttatacttttacttgatttgtgtttggcaggggataagatgcaggttgaagtgaattttctgtcagattgtgaaggcgtcaaggcaccgtttgcaggcttccagtcttgccatttaagac

SEQ ID NO: 45117 - DNA, 1030 bp, Homo sapiens
caccaagtagctctgcagcaggtgtcttcagccaggctttaaggtttgtctttttttttttttagacagggtctcgctctgtctcccagactggagtccaatggtgcaaccactgctcaccacagcctcaatctctcaggctcaagcgatcctcccatctcagcctcccgcgtagctaggactccaagcgcatgccaccatgcctggttaattttttaaaaattttagtaggccaggtgcagtggctcatgcctgtaatcccagcactttgggaggccgaggcaggcggatcacctgaggtcaggaactcaagacctgcctggccaacatggcaaaaccctgtctccactgaaactacaaaaattagccaggcatctgtaatcccagctacttgggaggctgaggcaaggagaattgcttgaacccaggaggcagaggttacagtgagccgagatcgcaccactgcactccagcctgggcaacagaatgagactccatctcaaaaaaaaaaaaaaaattgtagataaggtcttgcaatgttgcccaggctggtctcaaactcctgggctcaagtgatcctcccacctcagcctcccaaagtgctgggattgcaggtgcgagccacctcacccagccttcggctgactttctgcatgctgctgtttactcctcacagacccctccccaactgaaatctctgcttttattaggtaaaattaggattcttatttttaagtaactgtggtagccatagaacaaagggcacagaggctttttctttcacttttaagtataattaatgatttaattttttttgagacagagtcttgcttgctctgttgcccaggctggagtgtagtggcatgatcttggctcactgcaacctccgcctcccaggttcaacaattctcctgcttcaacctcccaagtagctgggattacaggggtgtgccaccacgcccagctaatttttgtatttttagtagagacagggtttcaccgtgttgaccaggctggtcttgaactcctg

SEQ ID NO: 45118 - DNA, 1015 bp, Homo sapiens
ttgggcgcagtgattcatgcctgtaatcccagcattttgggaggctgaggtggaggtgatctcttgaggccaggggttcaagaccagcctgcccaacatggtgaaaccctgtctctactaaaaatacaaaaattagttgagcatggtggtgggcgcctgtagtcccagctactcgggaggctgaggcaggagaatctcttgaacccaggaggtaaaggtttcagtgagccaggattgcaccactgcaccccagcctgggcgacagagtgagactctgtttaagaaaaaagaaaaaggactgggtgcagtggctcacgcctgtaatcccagcaccttgggaggccaaggcaggcggatcacctgaggtcgggagttcgataccagcctgactaacatggagaaaccccgtctctactgaaaatacaaaattagctggacgtggtggcgcattcctgtaatcccagctactcgggaggctgaggcagaagaattgcttgaacccaggaaatggaggttgcagtgagctgagatcgtgccactgcattccagcctgggtaacagagtcaaaaaaaggagaaggaattgcattcacaaaagtgtgtctagaatgaatccagcatgtgtaagatactaggatatttttagtcagttgtgtgttgctgggttgggtagcacgtagtaggtttagatagcatgggatttaattgttggaaccaaaaaaaaaaagcatgaatggaatgtcaaaagaaaaaaaaagatggaatgtcttctgcctgtctggagcttcactaaaatcttatttaggatctccataatttatgaggttagtatttttattcctgttttacacatgaccatggctagtgagggccagaattagaattccaactcctgtattttcagccccaaaacctatcaggttttgttttgttttgttttagagacggggatcttgccatgttgcccaggctggtcttggattcccggcctcaagtgatcttcctgcctcggcctc

SEQ ID NO: 45119 - DNA, 1050 bp, Homo sapiens
atcgcttgaacccgggaggcggaggttgcagtgagaagagatcacaccattgcactccagcctgggcaacaagagtgaaactccgtctcaaaaaaaaaaaaagaataagagattgtagactcaataaacgtcatttttttcagtgagattattggaaaagatgtgtgaatttagccacttttatgggtatttttattgtggtaagcatgtatgtattatgtattttctcacgtttcttactaaaggcctactgaaaatgttttaataaacatgtgccatctggtattttttaagaagtgtgtaatagttcaaaatctagcaaaactcaactgcaaagatttttaatatctgttgtagagctcaaggggttaacactatttgtgtgcggatgcgtttttttcatgatgatggagctgatgctttattgtgcctttttttctttcttggttttcaaggctttgataaaattcaagagttatttgtattttgaggaaaaagactttgtggataaagcagagaagagcctgaagcagactccccatagtgaggtgagtcatggccataagaacattagaatcataaggccttgagcgttaggacccattccttcattataaaagtgaggaacacgaggcccaaaggggaatgaaggggcatctggtagccccactggccagcggcaagctcaccctctgcttattgtgttttgctctttatgtagtaccatgcttctgctgttagagacatgatcctgttctttcaggataactctgtagagaaaagtgtataaaaatagtggcctgcaccaccccatctgggaggtgtacccaacagctcattgagaacgggccatgatgacgatggcggttttgtggaatagaaaagggggaaaggtggggaaaagatagagaaatcagattgttgctgtgtctgtgtggaaagaggtagacatgggagacttcattttgttctgtactaagaaaaattcttctgccttgggatgctgttgatctatgaccttacccccaaccctgtgctctctgaaacatg

SEQ ID NO: 45120 - DNA, 1084 bp, Homo sapiens
ataactcaaaaattctgtgccttttgtctgacagggcactcccttttatcttcttaggactgtgtttttttgcaaatgattaaggagaggggtccaattttattgttagggaatcttttcatgtacctttctggtcaagtgaaagatgtgggctaacaaatttgatgttgatgcattcccattaaaacagctcttttcctctttttgctctcccactccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtt

SEQ ID NO: 45121 - DNA, 1572 bp, Homo sapiens
cttgtcacatttttgtacattgtgactgctttcaacatatacttcatgtgtaattatagcttagactttagccttcttggacttctgttttgttttgttatttgcagtttacaaatatagtattattctctacttcttggtacattttgtagtaatatgtttaatataattattcaagagactatattgacagccagatagtatggcagttctgaaaaaatttatatcttttcaccacttgaatatactgcaatgtgtagtgagtaaattgtctccctttttctatagatcattaggttagagtttttttcttcttttttttttttttttttttttaccacttctgctgttcatggtagtagtggaaggtaaatttggaaatggcattgacataaaatgaaaatgtttacggacacttttcttttttgcttttttattgtatttggataaagatccacttaaaagttatctgttttttcctgttttttttttttttccccaaagtgtagttatgttttcactattgctgcttctatagagggcattgtgatagagagttacagatgaaacattaaatgccacagtgagtagaaataattactacaaaaagtaataaatatgattacttggtaatatcattctccatctaaaatactagtttcacctgtgagcagatttcagctcagtttatagttaaaaacaatgagggtaaaatgggattcatgctcagggaatgaatcagccatagttagagtgggaaattattattttcttcatttaaaggtagattttatgtttatttccctaaattgcataagataaaattgtctgtttaataaaaagacatttattaccattattaacagtcattttagagccaaatttaagaaaaggatattgaaagggtctttattggccttgtttgggtaactctatgctgttagatagaagagacttaggtaaataactttttatgtctgaggtgagtacacaatattggttcttggaaaaatagctgtttcttcataagatacccaagtgataattttttttcccctagactgtcaggcctatgagtaaatactaaatctattagctgtccccactcataaaccaaaccaaaccaatacaaacagatgaggagaggaaatgtagtaaaaatactggctgggtcttatgattgggatgagtgattttataagataatatggtgataattttattctaggattttatttttggcctaatataggaatgtttaaaaaaggcttttctatgaaaattagaaatttatacttgaaattaaaagtctagaagggggaggaccttaaagctaagctaccagtaagacaatgaataattcagaagagaacactattcttttactgactgagtgcccaagatgccaatttccatgaagtcttgatttatatatatgtacacatgttatgcacatacatgtttgttttctaacagttattttttaagcttttgagataattttagacttacagaagagttgtaaaagtagtagagttcttgtatactctgcacccaccttgcccttatgtt

SEQ ID NO: 45122 - DNA, 1027 bp, Homo sapiens
tgccaatctcttctggaaacaccctcacagacacatcacagacacacccagaagtaatgttttaccagttctctaggtattccttaatctagtcaagctgacacctaaaattaaccatcacaatatggacccctctgattaagtgttctagtcaaatcagaatcttgttggattctgaaaatctacgttttaatctatgtttctgaatctacatttcagatcatgttggatctgaaaatctacattttaagaacctacttaggcctgggtgtggtggctcatgcctgtaatcccagcactttgggaggccaaagtgggaggatcgcttgagcccaggagtttgagaccagcctgggcaacatagtaagaccctgtctctacaaataaaaaaattcgcaggatgtggtggtgcacacctgtgatctcagctacttggaaggctgaggtaggaggatcatctgagcctgggaggtcgaagctgcagtgagtggtgaaagtttgaaaatcactgtcagagcccaaagccctggtcttgttattgtatagtcagcgtcagagacaactgtgaagttttcttcactctggatgcctaggtgttaatctgggattgaggacttctgcctctaaaaacaatgattccagctttggatataagatccagttgtttatgacccctacattcttggttttgctctttaaacaacttactggccattagcgttatcttctgcactaggagcatggggtcagcaagctactacctgagatcaaattaaacccctgcctgcactttactgggacacagccacactcatcagtttacatctcctctctggttgctttagtgctgcaacaggagaagtgattagttgtgacagagccttatggcctacagaacctaaagaatttatctggccctttacagaaaaaaagttcgctgcctcttgcactagaacattgaaagggaaaaagtagagattgttttacattttacctgttaaggcttgtctggtaaaaggctgatata

SEQ ID NO: 45123 - DNA, 1028 bp, Homo sapiens
gcagtgagccgagattgtgccactgcaacccagcctgggcgacagagtaagacaaacaaaacaaaacaaacaacaacaacaacaaaaagatttaaaaataaatttgataaattggagtaggatattcttattgaaactcattaatacatagtattcttgttaataggttcagtttaataggaaagctactagagaactctaatgaaatgtgttttcttttaaggaaacttacatgcttgctgtaactttggatgaatggaaaaagaaactggaatctcccaacagagaaattattattttacacaatccaaaggtaaaacaaagcatttctcttgtcgggataaaaagttaattgcgctattagggagaactcaattggtttcttttgctaagcactctgtgtaggataacctttgtcaaattttatattgaattcacagttatgaaacttaaaaacttgtagccactactgttatttacccaactcagcttatacaaaataattttcttatggaaaattatgccactgtagaataagaaaatcactgacatattatgtgagcatgtcttccatgtagaaagggactattgacagatctgttagcctaatatattttcacggttctcatttcaagccatacgagttgtatatcaaaactccagttcagattttactgtgtggtttgaaagacatgattctacacttaaaactgcattgtatagagatgattgtattgcagaatatttttattgctctgatctgttctgtttaagcttatggtgcattaccagccagttgcagggtctgatgattggggttcaacacccacggagcagggtcgaccaagaactgtgaagagaggagttgagaacatctctgttgacattcattgtggtaatgttaatcgtttattttttcttacctttggatgtatttgtttactccttaaattgtgacctttttctgtggatttagattacctcaaggcttaaaaatcatctttaatcatatgggtttattccaagtt

SEQ ID NO: 45124 - DNA, 1133 bp, Homo sapiens
agggactgttctgctatttaatattggaaatcattggcttttttggtagcataaagctactggcttggaacagttaataaattttactgagtcagctcaacttgagtttggtggcagagggtagcactcagtaagaagattagggaaagaagatcatgaactagtgattatgcacattccggtaacttatgtgcttgtctttgtattttttctcacaaaagaaaaaaagttgcaaataattttttctctttttttggtcacagtggtgtttttcctggaaattctaagtttattagaacagaatctgaattagtcctgtgatcacaagttgtgtgctaatctacaaataacagatggttcaagcttccccagtttcaggctttgtgcagcgtgtgacattcatcttccatcttactacttaataggaatggtaacagtttactcacatatttttacttttatactttttattgatgacagttcttctctgtgagcacacaagtctaactggaactgttttatgagacgtctatggcttttagtgcaataaagaatttttaaagaatttggtccagcgtgatgatttttctaatgaatgtcaaagccaagcgagtgaggctcagaggaactgaatgtctccagctgctaaggctctactgtctgcaaagcttttggtggcgtgtaattaaaaaccatagacatcagagtgctactgtttgacaactcatagaagcaagctgagggggtcttttcagagaatgagccccgcttgtaggtctttgcttaccccgtctctctggagaaaactcagaggcataaaaggtgtccctgcctctctcctgcggcgatgtatgatttgtgtggtgctgtatgctttggcttctatccgcacacactgctgtctgctccatttcataccttgacaattgtcagtgtgattgcaaactggcttgtttgtgtttcttctctttccaggagtggctgtaaggtgaagaagcatgaaactcagtctctcgccctggatgcatgttctcgggtgagtctgtgcccatctccagaatgtctctgagaccaggggtcctccagtgggagtttgcatccccctggcgggtggttcaaaaggactttccaat

SEQ ID NO: 45125 - DNA, 1825 bp, Homo sapiens
aaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggtatggaagcatatcttcatctttctaatgtacataagcatggaaatgcctgaaagcctaataaagcaggaggagccttacagagattaaagaattgggtcacttgaaggatagatttaggatgctgacctatgctttgcttctttacctggaaaagggacacaaagtgcttattgaagtactaggaacgtagagatacttgtgacaagttgtataggagatgctgatgtatgtgagactgcttgaatttctttataattttatgtgaatatggccatatcttaaagtatagtggtgtgttagttcatttgcgttgctgtaaaggaatacctgagaatggctaatttataggaaaaagaggtttatttggttcatggttctgcagactgtagaataagcatggcaccagtgcctgcttctggtgagggactcaggaagcttccaatcatggtggaaggcaagggggagcaagtgtgtcacatggcgagaggtgggaggaagagggggcggggaggatgccaggctatttttaacaaagatttcacagaaactaacagcaagaagtcgctcattaccacaaggagggcaccaagctattcatgagggatccgctcctatgacccagccacctcccattaggcctcacttccaactgttgatcaggtttcaacatgagatttagggggcaaatatttaaactatatcaaatggcctataaatatgtcatatgtttgacttttttgtgattgttatactcattgtttaacttagagaaataacaactgacatgtatggtgccttaccatgtacaggcattgttttaagtgctttgcatatactcattcatagcaaggtgttacccttttctcacttcttcagagaaacaaagtaagtcaaagaagttaagtgacttgattaaagtcacttggctagggtaggacagaaaagtggtatctttttcctcaccacaaggttcatggctgagacatctctaacaaaagatcaacaagagaaaagtgtacaaatatatttaatataagttttacatgacattagagcctccagaaatgaagacccaaaggaacagggaaaactgtacttttatagatagttgtgcagaagtataattggaggacagaagggtgtgatctgtggtaataaaccaggggaacttagcaagtcctgtttgttccaattcctcttggtgtctgtgtctttcaggataaggacattgtttttctctgtgtacagggaggacccctcttgtaatgaggtcttatgaactattttcaggggaaggtctgaggggttgctttatggcctgcttcaggaaagggggcaggagaggggccgagagacctccctgcttctgctgtgtcctcaaatgcgaaggcaccatattttggtgaagtgtgttctgaacctcatcattagtaaatggtagaactacatttgactctaagcagtctggttccatggtcttttcgccacaatgccaaagtatgaagagattattttcatgatactaggctactgtaaattttcctggtacagatgtggtaagttgagattgaccagtgcactgtaaaatctttcttaacatgccaatgaggaacctgggctaaccagggtggaagcctcttattgatggactcatcagatcattctagagctaagcccctcttt

SEQ ID NO: 45126 - DNA, 1081 bp, Homo sapiens
ggtttgtaactcctgagctcaagcaatgcacctgcctcagcctcccaaagtgctgggattgcaggcatgagccacagcgcctggtccataatactttttaaaaattaattatgcatgagagtttcaaattacataaccaccaaatagatgatagaaagcttgttaacaagaaacaaaattgattgacttgaaatcgaaatctttttatttttcctcacttttagaaaggagagttatgagccatgaaatgactaaagatgaaatcaaagtagagaagaaaaaaaggcataaataattcacacacagtgtggtcaacacttgaatgattaaaaaacattttaagtatatccctctaatttgttgctcttttattatttgtcttttaagcatttcctaggtgtaaggccctttgctgggcttgatggaaaggaagggacattcctgctcttagagagcggtagccatccataataaccaacttggatatgacgtcaaaagtgatgggggcaccaccattgagggcaggggaggacgtgatgcgactcacagagcacccagcaccggactgggtcagaaggacattgtcattcttcactagaagaaaggttaacccaagaggttgatctttaaagtctttgaataagtgaaatacttttggaattaggacacaaaataaaacttgtcactgaatcagaggtagagtgtctgaaagggtggattgactcaggaaagtctaaagtcagatcgcatctgttaggaagagcccagaagaatatctttaacttagtttgtaaaagattgactcatctaagcagaatgaatctatttccttgcagtattcaaataggtgcaaagagaaagggaaggcagttggttctataagtaaaatataagtttgactaaagataaaatcttaacaaaaacctttttagaaccttaagaaaccttatataatgtaaaaaaaaaaaaaaaaaaaagataacgagagccccaaagcagataaatggattacatacattgtcagtgtatgttaatgtgtttaattgtttgggacagcatttctccaactttcattgtctga

SEQ ID NO: 45127 - DNA, 1069 bp, Homo sapiens
aacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcaga

SEQ ID NO: 45128 - DNA, 1031 bp, Homo sapiens
aaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttg

SEQ ID NO: 45129 - DNA, 1026 bp, Homo sapiens
ctctctgctggtatgattgcccatggctggatcaagaggcagcttgccttggaaactgacgagcatgtctaggtttctgttaactctcagggtagcctggccaagaaggagtcagcacattgcctggactttttgttttaaacctcctggagaatttttagagatgtaaaatgtggtgtttcttggagtagagggaagagtgagggaagctgatgcctttcctcgtgagaggaatcccagagtcgcagctttttcattgacatttgctcactggagttagagggatggaggtgcgcatgcagcagctgcctgcccagtgttaagcaactttgcagtagtaatgatgaccatgtactccttgttaggcacccacacatgcagtttaacaacaacaatatttacccaatgtctgggtgtccagcacttttcacacattatttcatttaatcctcacagcagcctttgaagtaggtaaagcaattatctccattttgcagattaggaaatagaccctgaagacttaagcaacttttctgcgtttgaatccaggtctgtctggctcaagactcatgctctttcccttcactccactgcatggatgggatgggtaactgaaatcagcacacccttttgaatggtcatcttcttgcaaaagttccctcaaaaatactcatattggctggatgccgtggctcatctctgtaatcccagggctttgggaggctgaggtgggggggatcacttgaggctaagagtttaagaccagcctggggaacatagcgagaccccatctctacaaaaaattgaaaaattagctagctgtagtagtgtgcgcctgtagtcccagctactcgggaggctatagcaggaggattttttgaactcaggagtttgaggttatagtgagctgtgatcgcaccactgcactccagcctgggcaccagagcgagaccctgcctctaaaaaaaaaaaattttttttaaatactcatactgattattgtcacctgcacatcctccttaccac

SEQ ID NO: 45130 - DNA, 1027 bp, Homo sapiens
accctgtctctacaaaaaaaatttaaaaaataaaatttagctgagcatggtggtgagtgtctgtagtcccagctacttgggaggctgagttgggaggatcgctggagcccaggagtttgaggctgaccaagccatgactgcacctccacactccagcctgagacagagtgagaccctatctcttaaaaaaaaaaaaaaaaaaaaagggccaggcgtggtggctcacgcctataatcccagcactttgggagaccgaggtgggtggatcacctgaggtcaggagttccagaccagcctggccaacatggcgaaaccccatctctactaaaaatataaaacattagccaggtgtggtggtgcgtgcctgtaattccagcaacttgggaggctgaggcaggagaatcgcttgaacctggggggcggaggttgtagtgagccaagatcgtgccattgcactccagcctgggtgacagagcaagactctgtctcaaataaataaataaagctggaagtagaaggggaggatgagattggtgggttctgagggctgggatggccaaacacagttctgctgtggtcaggattatgcagagatcaggggcagaacaaccaggagttatggaccagaggactgcaggaatgtggacgctgagggccaaagcaagaaaatgagtgactgacagattaacactcaggtgtaagcaggacagaagtctatgccgtggtccagattgaaggggcggggggggggggtcagaaacccaggaagcaagatgtctaggggcctggactattgtgttatggagccaccagcgtcctcttactgtgagttgacacacaactgaatttggatcctctgtgtccgaacttgggataagcgggtttacctttgctcaaatcatcatttttttaggtttttcgtaggctctgtggctttcacctcacatctcaaaatgtacatcccttattaaatataattggctattatatatatatataaaatatttgaaaggattttaatcatttt

SEQ ID NO: 45131 - DNA, 1080 bp, Homo sapiens
agccctgcttaagacatcatgattccatgcggatagactgaacagaattggaaatgggagttagtctgcatgactttcagagctcttaactgttaagaaattttgcttaaaatttgtgtttttgtgatggattaatggctataatttgaaagcgtggctacattgttgagtatgtatttgtcagagttaacccatcagatattaaaagtaccttttccctcttacagtccttgtccatttaataagtgtcttagtctgtgttgctataaaggagtacctgagactgggtaatttataaagaaaagaggtttatttgattcactgcaggctgtacaggaagcatggcacaggcatctgcttctggtgagggctttaggctgcttccattcatggcagaaggggaagcggagctggcgggtacagaggtcataaggcaagaggaagcaagagagatgggggagagaggctctttttaacaaccagctcttgagggaactaatagaacaagaactctttctcctaccctggcccctcagggatggcattactctgttcatgagggatccacttcaatgaccccaacacctgttactacaccccacctcccaacactggcacactgggggttaaatttcagcgtgagatttggagaagtcaaacatacaaactgtagcagtaagtatttagtagtatcatctgagaggatgttattcatgctgggtgagggggaggaatgggagatgagtgaagggtgctagactctaggatgcctttcccccatttccccaccaaaccagttcttttctttcttcttgtgtttataccttaagatttcttttgagaaaaaagggttagggtttatagctaaaaatgtttgaaatgattgctatgtatatttataatgtttggataaagactgatattcttttttaagaaaatacattttcctccctcatacttacctaatgcattgctattttcatgtattaatacaactttatatgagtacttttattatatgcatattgtaatatgggaatgtcaggtgatttttctgtgatttgaacattttgatttttc

SEQ ID NO: 45132 - DNA, 1117 bp, Homo sapiens
aaacaaaacaaaacacacacaaaatgttcttcttcattgctgtctccagatgtatttgttatatacagatagaaaatggttaaaaaaaaggttcaatttcaatcaagccctatcaaatatattaaattaattttttttcttgtttaggaggatcatgattagatccctaactgataaaatctgatatattctgatactaatgcttttagcatagagcaaaatcataaatccttttaaaatttttcttctgctaaattggttatataaattaatgttaaaaatagacatttcagtttagccaggtgtcaaagaaaaattagtcatatttatttggcttaagatggttaaacttttatatattttcatctacatatgattttttaactagtgattattggttaatctctcatttttaattcagcccagcatttagaaatggtttattggtgctgatctgtaaccaatctggctgtttctgtctcagttctattttctgtatgtcacttcgtttttctgtccataaatcttcttccactatgtggctgcacagagtctctctgaacctgttctggtttggaagccacacaattcttgaatcagtcattctttgctcaactaaattctgttaaattaaaaaaaaaaaaagtttattgattacatcattagcttaagaggtgaaagggtcaggaagttctttagattgtcttttattcttttatctatgcattttgattgcttaaaactctacctttgtgaaatgcttgaaaatatttttgcattaaaataaaaggaacattaagaagataattcgttttaaagttctactaatttggataaaatgaagtcttcagtgctctttcattattattcactttacccttttacctgtttttcttttattcctgtcactacaatgtaacctttaaatttcttaatttgaaatgttgataaatgtctaaatgcctcaattttttgttcagaggaaatatttggattcttcatagtaacagacacatttttattttatttttattttttttgagatggagttttgctctttctcccagactggagtgaaatggcgggatcttggctcactgcaacttccacccccacg

SEQ ID NO: 45133 - DNA, 1029 bp, Homo sapiens
ggaaagcttctaccccagagtttttgcatttgctattccttctttctatagtgttttcctcccagatacacagttttgattgaactgtcacatatttgaggtgcctgtcctgactgcccttttaaaatcacaagcatcccttcctctgcagagctcatcacacccacaccccgtcgccttttttccccatagcacttattaccttataatatgctatctaatttattatataagtaaatcactgaatcataatcataacctttacatgggcagggatttttgtctgctatgttcacagtttcatcccttgcaccaagaagaatgccttgtacataatagatattcagtaaatatttgttgagtgagtggttgattgatattgcacaaaaggactcctccccacaatattcttagtagcaagaaaaagaataaggaagacaagtctttctgttattgacaaaagccttgtgctaaatgttttctttccgtgagtcagaattttgtctttgcctattcttttgtctcaaaccattgatagtttatgttctttcttttttctttctctgccagtcttttaaaatccttccacgtcctacatctagatactttttttgttttttttggtcaaacagcagttaacagtaccaaaatgttctaggcagactgcattccaatccaagaggcaggagtcagtactatcaacttttctagagaccagttagcaaagaagagtttaacatgactactcagggcaaaaaatatgtttcttagagttccttggatatacaaaagaccaagctatagatagggctgcttcttcattaactagaatgcaacatagctttcactcctgctgctacttctggtaccattgctcaaactgatgaaaagagattcagggtaccaaattcccttgaaaaaatacaaatatatgtaagatataaattttattgtatttaagatgtacaacatgttttgatgtaaatataggtggtgaaatggttagtcaagcagattaacacatccatc

SEQ ID NO: 45134 - DNA, 1034 bp, Homo sapiens
ggacccttgctgcgaaggaagtacctgtaagcttaaatcatttgctgagtgtgcatatggtgactgttgtaaagactgtcgggtaaggaattcctcccttttggaaacaggaaaaaaaaaaaaaaaaaaaagaaaacctgtgtatatcaaaatttgttttttgagatttctgagtcagcactatttttattttatggtcatgggaaaaattttatgccacttgtgtataattttaaagcacactcttttacgttaagtggtctgttgatattgttttctaagtagaaacattttttttctgatttttagagtaacatatgcctgttagaaataattaaataacatgaaaccatagaaagtagagaatgaaagatcctctattattttatactcttcaggtaaccactgttgataatttgttaatataatcacgttttttctatacaaatgtgagtgtatgtgtgtatgtgtgtttttaagtgggtaagcacagatacatatatttttactacctgcttttttcaatatgacaccatggacttttttcccattcatgtagttctataatacatggttatttaagtaatattacttgtatagttgtaccataatttctttagtcaactaatgatggacattttgattacttccagttactgcttataagagaaatcactggtgcagaatattcatactaagtttttgatatacattttatatatctttcacacatatgccaatctatacttctaccaacagtattatcaaatacttgtttccttatgccaatattgggtactagcaggcactatactcctagttaattcaataggtgtaaagggttcttgtatttttatttagtttgcatttcttttggttacaaatgaggtcatgtttctttactttccatagttaggacttacatgaattacctgttgttagccattgttcatttttctgttgggttatttaatcttttgctattgttagaatgctttatagatgtaaatgctgtggtttcacatttgattaat

SEQ ID NO: 45135 - DNA, 2002 bp, Homo sapiens
ttctggtaggctgtgtggatgggtataggtaaaggttttttcagatcacagctgcataccatgtattaggggatgtgttaatttgctcaaacaatgaaatacatttggtatagcagcttcagttggagtcaccacttagctaagcttataataatccactatcattctccaagatctgtctgtcttctgcacagggcaaataggtgaattgaatggagatgtgatgagagtccctgcccctgcatctttcaagtccttgatgttgacacgaatctctgcaatccctccagagatgtggtattgcttttggcttactattttcctaggtagaggcagttctagtgggttccacctggcctttcttaccataataaccatcactccacaggtcagggaaccagtgtggcaattctgccagctgttgagtgtgtctgtttcaattatgcattctggaattgtgggaaaaaacccacaaggtgggttcagggacccactaggcctgctgtgagatggacctgaggtaaaacttcatctatcacctgaccttcataagcccctactctgacttcttgaccacagtgacattttgggtttgctcaattatttcagatatagggttctgtgttcctgaaaggtcgaatttttttctcagtgcacagtgtcttagtctgatcaattctgtctcagtctattttgtgctattataacaaaatgccacagaccgggtaattaatagtgaacagaaatttattggcttctggaggctgggaagtccaagataaaggtgctgccatctgatgagggtcgttttgctgagccatcacatgacggaaggtggatgggcaagagacgaagtggggccaaacgcacccttttataacaatattaatcttatcccagagggcagagccatcatggactaatcacctcttaaaggtcccacctcttaatgctgtcacaatggtaattaaatttcaacatgaattttagaggggacagacatttaaaccatatctggctgctctaacaagatatactgtagactgtgtggcttaaatggcagacacttatttctcagagttctggaggctgggagtctaagatcaaagtgccagtcaatttggttcttggtgagggatctctcttttcttcttataagatcgccaatcccatcataagggtcccatcctcatgatcccacctaactctgattacctcccaaatggcccatctccaaataccatcactttggggttagggcttcaacagatgaattatgggatacacaaacattgaaggggtacacaaacgttcagtatataaccattgccctggtaaaagccataggtcccttggaaatgtctgggataatgattaatagtataaatttttggcattgtatgggagggttcttccttaaagaaacttaccctgcctttagttgagagtttctgtttctgtaaactggctcaactcaaggaattgattaagaggctgtgactttctgtttttatgattcaaattagacttttgtttacttggcctagagttttcttatttggtacaggtcaagtaagactatgggaagctgcctatcttgcttctacttagacagaaacagtgtgatcaactagccaatgccgtaagtttttacatgggtcaggttattctgattgctgctttgactctgctctccattatggtaaccttggctctccattatgccaaccttggctctccattatgcccaccttgcctttggtggttgaatgttgacactttcctatcacctagaatctgatactttcattgcatttaagtttcccaactcagtggccatagctcctactataaggtctgccctttagataagagtgatcacagagcttttcaaggatgctaggcctccccttacaaatttatttcttacagtcttggtgaaaggtgtgttttctggattcttccagggtgggtaaatacatcttaagtgacaaatcgactc

SEQ ID NO: 45136 - DNA, 1047 bp, Homo sapiens
agtctaaacactctattaactatctcttttcccctcgcaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagagttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctg

SEQ ID NO: 45137 - DNA, 1040 bp, Homo sapiens
aacctgcgaggtggaggttgcagtgagccaatatcgcacctctgcactccagcctgggcaacagagcaagactctttctcaaaaaaaaaaaaaaaaaaaaaaggaaaaaaaaaaagaacaagttgggaaaagctgacatccgatggagtggcagtgactacctaccatgttttgttgaaaatgattctgaggctttgcctaaatttgatgtaaaagctatgatacctgctagatttttgaagtgacatacgcatttatgtatcagtcttttcctaaggtgggatagttgaggccaaatttggctttacatcagaataatctctggatatttataaacatatatatttctggatcaaaatcctggaactttaaaaataattataaacttgttaataatttttatttagtaatatgtgattacattcaaaatgaagtaaaagaggctaccctatatgttaccatctttcctgattgtcaattttactatatttttaaagaaaacgactatgtttaacagtttgatggtactcttctggacttttctctagacacttagatataaatatgtgtaaatgtagacatatacggtccttttgaagtaaattataaatgacaaaagcatattgtataaatttatgtatgtcatctatttttaatatattttggatattaatcattttattttttctatatcttgcacaagttttcttcaatgtgttattgatcttttcacttgtgatatcctgatttttgtactaagtttatcaacactttcttatggcttctgcattttgttttccgtattaaggcttcccttggtacaatgattaaaacaaatagtttcccatactttcttaaagttattttacaactttagacaacgtagcctttcagtctttctaatagttttgtaactttgtacatgaagtcttgtaatccacactgtggtgctagataggaaactatatttgtatttttccaaatggataaatactgatattacatcattcccccattcatttgaaatgccacatttagta

SEQ ID NO: 45138 - DNA, 1064 bp, Homo sapiens
tgatcccatttattcatgtttcgtttggttttgtgtgcttgtggggtattactcaagaaatctttgtccagtccaatgtcctggagactttctctaatgttttcttgtagtagtttcatagtttgaggtgttagatttaagtctttactacattttcatttgatttttgtatatggtgagagggaggggtctagtttcattgtcatgcatgtggatatccagttttctcagcatcatttattgaagagactgttctttcccaagtgtatgttctgggcacctttgtcaaaaatgagttcactgtagattaatgggtttgtttctggtttctctattctgttccactggtctatatttctgtaccatatcattttgattagtatacctctgtagtataatttgatatcaggtaatgtgattcctccagttttgttctttttgctcaggatagctttagctattctgggtcttttgtgattccatataaattttaggatttttttttctatttctgtgaggaatgtcactggtattttgatagagattgcattgaatttgtagatttctttgggtagtgtggctatttcaacaatattggttcttctaatccatgaacatggaatattttttcatttttggtgttctcaatttcttgcatcaatgttttatagttttcattgtagagatctttcacttatttgattaaactaattcctagacattttatttcatttatagttattgtaaatgggattactttcttgattttcagattgttcactgttaccatatagaaatgtttttcttcttttttgatataagtgcgtagagctataaacataccttttagtactgttttgctctatcccataggttttggtatgttgtatttccattatcatttgtttcaagaaatttttaaatttccttgttaatctcctcattgacccactgtgaattcaggagcatattgtttaatttccatgtatttgtaatagttttcaaaattcctcttgttattcgtttcttgttttattgcattgtggtcagagaagatgcttgat

SEQ ID NO: 45139 - DNA, 1117 bp, Homo sapiens
atgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagatatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaagttgtctctgtgtcatatttggtgggatttggtagtaaatgatggtaaagtggtaaatgataggacactaaatttgtcagataatactagaattgtagtagtgtaccgtacaatgtagcttagtgttttaaaataaacatcttacatttctatgtcacacctctcaatttcttacctgctttatcttacaacagcaggtatattataagtaaaaattaaggagtagtcgttgacaaagcctgctctcttccccggacagcatgagcttcaccactccctccaccttctccaccaactaccagtccctgggctctgtccagccgcccagctatggcacctggccggtcagcagcgcag

SEQ ID NO: 45140 - DNA, 1047 bp, Homo sapiens
catgaggtcaggagttcgagaccaaccgaccaacatggtgaaaccccatctttactaaaaatacaaaataattagccgggtgttggtggtgtgcacctgtaatcccagctactcaggaggccggggcaggagaatcgcttgaacctgggagcaggaggttgcagtgagccgaggtcgtgccattgcactccagcctgggtgacagtgagactttgtctcaaaaaaaaaaacaaaaaacaaaaaaaaaacaaactaggcataaactcatgaggtcaggagatcaagaccatcctggctactaaaccccatctctactaaacccatctctactaaaaatacaaaaaattagccaggcatggtggcgggcccatctactcaggaggctgaggcaggagaatggtgtgaacccgggaggtggagcttgcagtgagccaagatcgtgccattgcactctagcctgggcgacagagcgagactccatttccaaaaaaaacacactaggcgtaaacaagaatgaagacctggaaccgtagagaaaatactagaaacccctcgtatcacgttgtgcctgaggacaataataaagtagtttactaggcatcagacattcctcagcagtgctgtgggtcacgggcgtgaagcggagctcgaggcaggattgcttgtgttgctgcatgtcctgtctgctgttttagcccgtgtcagtagatggggccattgtactgtttgttctgcacacttggcggagcagcagaggctctcagcacgccttttccctttgtagtattttctgagctaaggaaagtcaggcagaagtagttcataagaaggcatcactgcctgtgatcggggctgcatttagccctgacctgataatggtaggagagttcatttagcctttctgctgcgaagattgtaaatagattaaagaaaacagctgtggccttctcccgtcatacatcattagactgtgtaaactaacattttagaacctctaatattggacttaaaaccaatttctgtcgtgcttaattgaaaatcacaact

SEQ ID NO: 45141 - DNA, 1017 bp, Homo sapiens
tataggagattctgcaggcaatgagaatatttaatttaccaagtttactatgcatgaagctctttttgtttttgtttttgagacagagtcttgctctgttgcccagcctggagcgcaatgtcacaatcttggctcattgcaacctccaccttccgggttcaagcaattctcctgcctcagcttcccgagtagctgggattacaggcacctgccaccacatctggctaatttttttttttttttttttttttttttttttttagtagagacagggtttcaccatgctggccaggctggtctcgaactcctgacctcaggtgatccgcccgcctcagcctcccaaagtgctgggattacaggcgtgagctaccatgcctggccacatcaagctgtttttaaagtagattaacttgtaaatctccacaacatacctatgcaaggaaaaatttgagattttggaatgggcaaaacattactggctatcctttcaatgtaatgcttgatccctgtgtgctgtgtgcccatgtctttaaattttacaactctgtagaggtacaagttgatttatagaaaacttataatgatgtgaatatttcttgtcttgctatgcagatgatgcctgcccatggcaatataagtgaattttgtcctgttgagaataagtcaagcccccatttgattggatgtttttgttttgttataatttggtgggacatagtctcgccctgttgcccaggctggagtgcagtggcaatctcggctcactgcaacctttgcctcccgggttctagtgattctcctgtctcagcctccccaatagctgggactacaggcatgtgccaccacacctggctaatttttgtatttttagtggagacgggggttcgccatgttagccaggctggtctcgaattcctggcctgaagtgatccatctgccttggctcccaaagtgctgggattacaggcatgagccatggcatctggtgagctttgataccagactcctttgctgaag

SEQ ID NO: 45142 - DNA, 1051 bp, Homo sapiens
ttggtacttagtatgtctataagcatatggtgttttttttttttacatttaagaaaaccaaggggaaattgacaacataaagttaataattttagagtgaacagttcagtagcgtttactatattcacattgttttctgtccaattcacaacattttcatcagtccaaaggaaaccccacactcattaagcattcactccccattcctccctccgccagccctggcaaccacagtctgcattctgcctctgaatttacctattctgcatatttcatgtgaatggaatcataccaaatatgcccttttgtgtctggcttctttcactcagcataacattttcaaggttcatcagcatcgtagcacgtgtcactacttctcttctgcttgtttgtgggtgaggggctgaattatattttactgtatgtctctaccataatttggtcatcctttcatccattgatggacaaggatgggctgtttctaccttctctggctattttgaatagtgctgctgtggacctgcgtgtacgtgcatttgtttgagtacctgtttttttaagaatataatcttagagcattgcttaaggatggacttggggttatctgtatctgggtccttgctactcagagagcgatctggagagcagctgcatgagcatcgccaagcagctggttagaaatgaccattgcagacccaccccagacctattgagttagactctgcacaggtgaatcagatgcatattaaaatttgaggagtagtgatctagtcagtctttggactggctgttttttaatgtatttattttaattaggaaatgtaattttcatatattttagtccaagaaaatctcgagcagcacacaggatccctgcggatggtataacttacacctgggcccttttaccaccatgaaaaacatctatcaggatagaattagtagaaaagctgataaacttaggacacagtgagtggtgtctggtgtctagtgtctagctttcatttacatttgtaagcaagtggttaattcatggacctatggaagttgt

SEQ ID NO: 45143 - DNA, 1061 bp, Homo sapiens
gttcccagtgttttgctataggtgacttaactcttggtcccagttgtcaaggaaggggctgctctggggagaggtggtttgagtttccttctagactatgtgcttcttggctacggtcttaggtgactgggactgaggctttcacagaatagagatggaggtgttcactgattgaaaacaggtctcattcttgctcttgtatcttgcttccttcccctcccagtgggctaccttgagaatggagcgaggagccaaggagaagaaccaccagctttacaagccctacaccaacggtaagatgggggtgtgatccttgtcctgagaggtccatttgaacagtgttccccagtgcttctggtgccacacacgctcttccctgcattagtgcaggatgtgtgctctgagtatgtctcacgtgctctcccccagcgtgctgcttgacagggacacattcttttgcaggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggtgaggcagggcctgcgggagtggggctcgctgctgccaccccacgtggtgcacagcccacctgcctgctctgctgtgtattcccgttttagaaaggaggagggaatgactgtcgttagccaggccacgtgactctttggagggatacactggtgattctcctttagaggcccttggattctctgcatatcagacagaaatagttggatttcttaaagacagcttgcttctctagatgacagcaaacacagggacagggaacattgtgtgctttctgccactccttcctggacatggc

SEQ ID NO: 45144 - DNA, 1023 bp, Homo sapiens
ctgtgcttccttgaccttggggaacctggatcagggatgcctggactgaggcagttgattctgtgtacctttctggggtttgaaccagtcttccaggacacctggacagtgcccatctctgggtgggcatgacctgctactgatctgaaaacttcaagaaggaaggaggactttcccaggtcccagtgtatctggcaaaattgaaccattcttagaaaggtaaaggttgtgtttggtgtattcagcttgttacctaatagagcaggattgacatactttttctgtagtcagtaaatattttaggatttgcaggccatatggtgtctgttgcagctactgatgatctctgccattgtagtgtgaaaacagacagtctataaaccaatgagcatggctgtgttccaataaaactttatttacaaaaacaggtatcagctggatgtggcccgtgggctgcatttgaccagcccttatactagagtatgaggtagttttatcccaaacagtaggagactgacaggggtcaatgctggttcagagaaagttttccactctgtggggcatttaggtttaagagccaagggtcaactggggagagcatttgacttagatgggcattatctatgagaaaagaaagggtagaaattcacattgtaaacccaactgtagagtctcagggaatagattggctctcagatgatggccttttaaaaaatgctagtgtggattgtgcactcactgtgtgccagtcactgagctgctggggccctgtgtgatcgtctctttcgccctcacagtagccgcagcgctgtaaacagtgttcccattttgcagatgagaaactgagactcaaatcacttttttccaaagtcataacattagcactggagctagattttgaacccacatctcacagacttttagagcttgaaggtttaacttctgccccatgttcccatctctgaagtttaacaaagacagagtggctgcttttaaaatctatgcctttgctatggattttaa

SEQ ID NO: 45145 - DNA, 1068 bp, Homo sapiens
tcgctgcttttgtttttagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggttcgtgaatgtgggaaagttcatatatgtaaaccgtaaagtgtctttgtagtcctgtttccattgtgtaaagcctccattaagaaacttaaaaaaaaaaatcaaaactctggtattactcacttcctctcccatctgataagattctggtttctatttattgaattggctgcatgcaaaatgacaaatggaatacttttgaacctcttgcgtgggaaagtcatcctatttgcgatgactatatatagcctttctagctctgattctactttttgctcacaaattagagtttagattgtttttgcctggtggtcttgatcctaaccattgttatctgcattgctttgagttgcatcagaaagtgattgtataaagttttagaaaagaaaaagtagaaaaagctaaggaatgcttaatttaactctcccagtcaggggtaactcatgaacctgtactagttctcaggtttgaggtggttctttatagtgagagagtggtactgatgagctctgcttgcaaagatgagattgggaaatctcatgtgcctgtaagaatttaagtgagccattttatgaggcagttttcattttaagctttttcttcaggaatagatgttaagaacttagggggtgatgtccaagggaggtcagtgataccaggacacgacaccatttgcagcacaggagttcagacagcaccggccc

SEQ ID NO: 45146 - DNA, 1030 bp, Homo sapiens
atgggctgtaaatgaacattgaagccttgggaagtaggtaaaataacccaggagagtgtgtaaagtgaaagaaaatagaagttcagaactgaaaaagcatttaagggatgtgcaaagaaagagaacctgccgaagacactgaggaagaggagctgggaaaataggacaccaggagaggttaggagggagggatgtttgagaaggcagaagtgattgacagtgacacatgccacatagaggatgtatagaataagagactgggagtgaccactcactttagcagcagagctcattggtgaccttagggagaacagtttctgataggaaactttctgaaccattggctaaaataatgatgctctgtttaattctgatattagactgacaactcctttaggctaataactacttcattaatctttttatcaccgttacctcaccatagtgtctcatgcttgatgtgcagttgataagtgttcagaatgatggatagatggattgtataaatgaattggatggctaggcagaaggaaagaaagggagagagaggaaggggagggagagagaggaaggtgagggagagaggaagagaaggagggaggagataagtttgttgagaaggacagagaagtattcagtaatctgtgttctttttgtcttattcctgtctcaggctccacaattactgctgagatccagggggtgattgatgcctgtgtcaagctgactggcatgccagaccttacactttccttcatggtaaaatcctgggccagagattaagttcttgggatgagaaattaaatgctgctggaaagacagagtagtgggaatggaatagaacaagaagaaataattaggacagccacgaagcttgtctcaggcttgaattttctagaagtcactacatgatttctgtgtgtgtgtgtgtggtgtgttttaattaaaaacagcatttaaattgctttcctgaaagcactgcgggtgtttaatgcccacttcttgcttctcctctcctgatgactgtaga

SEQ ID NO: 45147 - DNA, 2031 bp, Homo sapiens
ctggtgtggtggtgcatgcctgtaacttcagctactcaggaggctgaggcaggagaatcgcttgaacccaggaggcagaggttgcagtgagccgagatagtgtcactgcattccagcctgggtgacagaatgagaccctgtctcaaaaaatatatatatatatatatatttaaaatatttgctaattatgatgtcttcccagtattgcttgcgatactgcacggcaaaaaataagcagatccacatgaaagtgagaattcatttagaatgatgatgaaaatccatatttcaaataattaacatttttttaaattttgtagagatggggtcttgctatgttgcccaggcttgtctcaaactctcatcctcaagcagtcttcccgtctttgcctcccaaaatgtttggattacaggcctgagccatgggacctggcctcagctgaggttttttttttattttttgtagtgatggtggtctcacaatgttgtccaggctcgtctagaactcttggcctcaagtgatcttcctgccttggcctctcaaagtgctgggattacagccatgagtcattgaacctggcctgtttttatttttaattgacacataataattgtacatatttatggggtacagtgtgatattttgatacataatgtgtaatgatcaaatcggggtaattggcgtgttcatcacttgaaacacgtatcctttttgttggaaacagtcaaaattctttcttctggctattttgaaatatacaatatttttttttttccggagacagagtctcgcactgttgcccaggctggagtgcagtggtgtgatcttggctcactgcaacctccgcctcttgagttcaagtgattctcctgcctcagcctcctgagtacctggaattacaggtgtgcaccaccatgccagctaatttttgtatttttagtagaaatggggtttcaccatgtaggccatgccggtctcaaactcctgacctcaggtgatctgcccacctcagccacccaaagtgcttggattacaagcgtgagccactacgtccggcctgaaatatacaataaagttttattcactgtagtcaccctgttgttctttagaatactgtaacttattccacctaaccgtaattttgtacccattaaccagtctctccctatttccctccacaactccccccacccccaccaccctttcctgcctctggtgaccactattctactttctacttctgcgagattagtttgttgttgttgttgttgttgttttgagacggagttttgctcttgtcgcccaggctggagtgcagtggcgcgatcttggctcactgcaacctctgcctcccaggttcaagtgattctcctgccccagcctcccgagttgctgagattacaggtgcctgccaccacacctggctaatttttgtatttttaatagagacggggtttcaccatgttggccaggctggtctcgaactcctgaacttaggtgatccccgccggcgcgcccccccccccccccgccatcccagcctcccaaagtgctgggattacaggtgggaactaccgagcctggacgagatcagtttttttttgtttgtttgttttgttttttgagatggattcttgctctgttgcccaagctggagtgcagtggcacaatcttggctcgctgcaactggtgtctcccaggttcaagcgattctccagcctcagcctcccaagtagctgggattatagccgtgcaccaccacgcctggctaatttttgtatttttagtagagacagggttttaccatgttggccagtctggtctcaaactcctgacttcaggcgatctgcctgcctcggcctcccaaagtactgggattacaggcatgagccactgtgcctggcatttttttttttttaatttttaatttctttggagatagggtctcaatctgtcatccaggctgagtgcagtggtgccatcatggctcactgtagccttgacctcctgggctcaaatgatccttctgc

SEQ ID NO: 45148 - DNA, 1077 bp, Homo sapiens
ggcaacatagtgagactccgtctctacaaaaataaaataaaaataaaaaaaattagctggacacaatgacacatgcttgtaatcccagctacttgaagctgaggtgggaggatcgcttgagcccaggagttttaggcagcagtgagctatgatcactccactgcactgcagcctgggcaacagagtgagaccctgtctctaaaaagaaaaaatagcaacaggttttacaattgttgagagaggtcagctcttgttcagagagcgcctcagaatctaggccaaagatcagggttctactagacaaagagaatgagaaggatacttagggcagaacctggatgcccatgcctactgccgcagactggactgagggggtctcccatagtcacagacgtaagcctgtggctgcaccatgggtgagccttggaaacagtgctcagggaaagaagcctgtcacaaaaggccacatgatatatgattccatttatatgaaatgtccaggacaggctaatccgtagagacagaaagaggtgggtggttgcctaggactagaggggctcggggagtagggagtggctgctgatgggtgtggagttttgttgtgggatggcagacatgttctaaagtgtgccgtggttttggtctcacaactcttgagtatgccagaaactattgaactgtgtaatttaattggatgaattgtatggtgcatgaattattctcaatagagctgttaaaaaaaagtaggcatgcaaggtcaccatctgatggaaagcttagccaaagtggtattgggctttgatgaaagcagcttctgagagtattttagaagtgttgacagtacctcctttctggcatggagtctgctgttccatttccacctttttttctgaagcttttggttcttggtgtcggtgttaaggattggtttattggtcagtgactcagtggtcttattagacagcttctggtgtatgtggaggtttccatttttccttttcttgctgtgaaggtccttgttcctgcagggatcctggccagtttggtaactgtgagactgaggtggcttgagtgcca

SEQ ID NO: 45149 - DNA, 1443 bp, Homo sapiens
aatggaatttggatcccagagatgctccaagactgttccttgtggtccctgcaggatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcagtgagtgtgcactttgcaatgagtttaaagacaccatttttttttctttttctctttctaaggtttcttttgtcctattataattgagttgcttatttctgtttcagttttgtggtgtttttattttgttttgttttgtttttccttctcaattttttttcagcatcagataaactgctgctggcctggagggaaatggagcaggctgtggagctctgtgggcgggtaggagactcattttgggtttcggaacttaccaagggggtgagattttgtgctcccacttttcactttctcatcaaacactgggtcgatctctgtcaaaaatcaggtgttcctcaccatgctttgagcttaactggaccagctgaaaagaggccaagagagtagccagtgaagggagcccctctgtggccagatgcaagagctgcatgaatggacagagatggtccaggtttaaataagaagcaagggttaggttcccttggggaaaagccaagaccatttcctgttaggaagggcattggattgatgatcaacactccctcttgtcgaaggtttttgactaattttgttgggatgctaaatccataggaaataaaaggtctaggcagaaagtctcagggcagcgtaaatcagatgtcaccaaaaaaagttaattatgaaggcaaaggaaatacatgtgacttaatgaacctcacacaaactgaaggttgaagtcaggctccggggctttttcctggacttatcctctgttttcccctgtgtacttgggcaaggatcttcacctgtgtcttagtatcgatttttatgaatcagtactgatggagtatatgtgtgtttaatggtgaatattaaccatagaagggctgagtgctcctccccatcttgggactcataatctgtgaaataaaacagtctgggcctccctgcccgggtagcatcaggatagacagatgaagagaagagaaagtaatgtgtcttgggcatcttctgtatgccaggcaccatgccagaggctttaagtacttcatcttacttgactcctcagatggccctgttagaagcctattttatgcaaaaggaaactgtagctgggggtaagtaacttgccaaggggtcacacagctagaaagcggtggaccctagatgcaggcgcagccattcagaccccacagtccacattcctttgagccagtccattgagggtcctcagggaatgtggcgggtcccctgg

SEQ ID NO: 45150 - DNA, 1045 bp, Homo sapiens
atgaatacacttcaattcgtatggtaaattcttattttaagaactgaatttcagaggagaaaaatgttaaccctgaggattttgattgcatcttttaacagtttctttaaaaatttccattgttgtcttatacaggtctttggtttcataagagcctgagagagatttttctaaggtaaattttgcatatatttttaaaagaagtccagtttaacatagcatctttttcatcctgtaagaacttacttttctttgaaatgcaatcagaaagatgacctctgaatctcacgggaaaactgttttattctcagtattctggaaaggtctgttttttaaggagcagactgctgtctcatacctttgattgcattaaagcattaatgatacacaggaagagaaaactgtataccccttctcacaggattaaacagcagaagaactgtgggtgaataaatactaaatggttatttttattcctttgccctgtttttctttataagatatgtgtaacacaccaacgtactgtgacctaggaaaggctgctaaggatgtcttcaacaaaggatatggtaagtatgctattgtaactttccagtttggggtaaaggttagtgttgaatgcctactgtgtgtaaatactgtgttagtaaaataagggtaagtcagcattattccacttcacaagatttaaggggataactattaacaggctattagacctcattctttagaggcagaaccccttacaagcattaaaagcaattatatacatatacagatgcatatacatgtccatatttaatgttatctggaatgtagaataatatatataacatttatgtctctttgtctggccctgaggacaattaaattagggggtagaacttttcctccctccaaacagtggcattgtttttatgaaagtgacaacataacttttgacttctttggagtaatgtatattctgatcctaaataaatattttttaggttttaaaatttaacttaaatttatgtgctgtacatatttgattttttcttattaa

SEQ ID NO: 45151 - DNA, 1068 bp, Homo sapiens
agatggtaagaaaaaaaagcttattcgtatgcttgtttttatggctgcttttggtttctggtattgatttaggataaatttcaatcattgttccaaatttcttagattgtgtcttgatatttttctcatatgctatctacttaacagtaacatttttgtttgttttgttgcttactaagcatttaatgtagagctatatgcatgttatatgcatgttataaatgtgttttgcacttgtttgaccaaattatgaaattagacacaaactgaactgtgaatcgtgagcctggaactcaacttagaacaattctagcctttttttctgagatttgtacctgtggcattttagattcgtgacagaccttcaaactaagaattgatgctgacaagggagaaatgtagactacccctctaccttaattttgtgcataaggtttttctagcaccaaaattaagatttgcatttgttatacttgtcaagtttgtgaaaagtaaatgtaaaaaataaaacactagatagttggatctactaaaagaaaaatgattgtcacgttaaaataattatgtgaacagttaaacatgattaacatgttatcattttttttttactaaggccttcccctaaatgtgcagcatgatactctctttgaaaccattctgtgtggtttgataaacagaacataacttcccagttgtctcatctgcctgtagaactagagttaggggacagggcatttgttaaggagaggattcatgttgcaggcagtgaaaaagactggtcagggttggcagcatctcattactgttggcaggatttcagaaatgctccctaaaacaggaccaatcagaatgttttttcttgacagttcatagattgtcagtgacaggtgctgtctgctttccccagaaggaggtccatttctaattgcttattgtcatatgacttaaagggcactgaactagggcaaaggatgtattttattttattttatttttttgagacagagtctcattcatagtaactgtttgatagaaagcactcttaaaggtagacaggatagaaagggg

SEQ ID NO: 45152 - DNA, 1077 bp, Homo sapiens
acccagctacaatccacaccattgattccatctgttgtttctagaaagttcagatctaattgtaatacttgtttcaagtgattgtggtgttttcttcttcctaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataactgctcatgtgacttgctggtgatggttttcttaccttgatgtgatttgttttaagaagcactttcacaggcgagatttgtgtctaaagtatcagggctgccgtctgtccctttcacttcactgacccctgctcttctcttgctctcacagggcaggctgaggaaggaagcagtgaacatggttgtgctggggagtggcacatctgttgtgcttgtggtgtgacagggttgcttcaccccgggagttgtgtgcagctgctgagaaagtgtggatgtgagcgggtgaaaagacagttgagggacgagtgcatttggggaagcatggggaggagagacggtgggaggaggccagagctgggtggacacttctgggactcctcctgggcttcagaaacatgatttttgattactagtatagaaaaatgataaccaaggaatgaagtacc

SEQ ID NO: 45153 - DNA, 1042 bp, Homo sapiens
cacctcatcattatttcatagtaggcaaaaattgaatataacccaaggtctaacaatagaaaattatgaaacatgttgtaggacaaatgccattcagccatgaaaatacatatttataaatactctttaataatataaaagtgtgagattgtatatgccatatgataccagttttacatgaatatacataaatgtgtttataaaaatgtgtatgtaggtccacaatttcagatcccaatcctttaggccagattcattttggaattcagagtttttcagatttttggaaaggtaacatgatgcatacactacgtattgtgtaaataacccagtggggcctggggttacaccattattccattatattaacatttctgcagcaaaacataagattattcactctaggataaacaagaagaataaattcatggttctgtcattgcctttcaccctccttctgggaattcctttgtctttctcctatcttattttgtttgctgaattcggtgtatttctcttttttggtttactttcatgttttggtagagcccattttctagtggcatcttcagaaaaatacatgagagatacttattttaagccccacaaatctgaaaataatcttagttctctttacactgtggtttagttgaatatggaattccaggttggaagtcattcctctgtattttgaaatcattgctccatgccctgtggcttccagtgctgctgctgacatctctcatgtggactcccactccctgttggtaacttgttcactttctgggaccttttaggtcctttttatctccatgttcatgctgctgtgctttggtatgagaaggagtttttttgttgttcttttcttttgttttattgcgcttggcacttagcacacccttaaaatctgaatgcctactagctttagttttaggaaattttcatcttattattatttattttatctcatttatttatttatttattttattactttacttttctttactttatcctctttctgaactatttagctattgaa

SEQ ID NO: 45154 - DNA, 1113 bp, Homo sapiens
tgaaaataggtagtagtgatggttacacaacattgtgaatatactgaatgccattctgttgcacacttaaaaatgcttaaaatggtaaaataataatacttaataatattttaagaccactgtgacgtggtcctttacttgaaaatgatttttgctgttaaaattaatgctcaaagtagggtttcatatcgaaagttgtgtaactgtgttttccattagccttatatttatgtttgtatatttacagggttaatgcctcttggaagtcaggagtcttcagacagtctagctgcagagattgttacacctgaaatcaggtaaggagattgtggtgttcacacttacactgcacagtattcttggagaaaacgtacttctctacaatatgaagaagataatttccttattctttctcaccgacactttcaacatgaactcagtgttaaatttttatgttttcaacatgttaaaagctttcttccactggcctacggaaaattgatttgctcacttcaataagacaatctttcacacatataaagccaattgttatgtccaaagcttgagtatcctcagcagacattaagcaatgaatacatttggcctgtagacaatagttatgcttagctataagcatgcaaaattattagttattaagatttatctgctaaccagctgggcttggtggctcacgcctgcaatcccagcactttgtgaggctgaggcgggtggatcacaaggtcaggagatcgagaccatcctagctaacacggtgaaaccctgtctctacaaaaaatacaaaaaattagccatgtgtggtggcgggtgcctgtagtcccagctactcgggaggctgaggcgggagaatggtgtgaactcaggaggcgtagcttgcagtgagctgaagttgcgccactgcactccagcctgggggacagagtgagactctgtctcaaaaaaaaaaaaaaaaaggtttatctgctaaccacacggaaaggtctgggaaagataataatgctatagacaggaggaaatgactccccatcttaactattcttccctcaatcataccttatatttttaatcatagcattttaaaaattccatttattt

SEQ ID NO: 45155 - DNA, 1797 bp, Homo sapiens
actgctaccaatcatactcttttccttggaaaaaaatcactttctacatttaatttgaaaggaagtatgattgagtatgggtaaagtctgtctctatcatctgctgtattgtttattgtaaaatcagacaattaagcctgaatttttccaaaagaaaatttgtgcctaattatgggaactaaaatgcctctatgagattttaatctatagtgagtagtattaacattcctaattgtgctttatgatacactgtaacaaattctgcatgatgaaattttcttttgtgaagtatgttccactattttttcattgattcctttttttgttttaatgttgcagggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgtgcctgtgtgttaccatgctaagaatgtctttgtttaaagggaattaatctttttatgatgtattaatctgtgttttcaattgttttccaagtacagttcaaataacttgcatatttactatacaaaatggttgacaagtgttctttttgcaaagacttgaatacattggcagaggtgctaatcacatcttccctaaggcacctggaagaattatttgaggaaaaaatgagttttcacattgttttataggaaattaaatttgtccaaagatttggagactatttttaaaacataaatacataaaatttcattatttcctgctatcttgtttgctggcagaagtgaatgtttggtgaggttattttgggataaattacaaaagaaaaaaaattagacactgcattaatttcttgttcttttggaatatcttagtaactgaggatcattttctaacaatgtggttgacataccttcagttgctttccacatctaaaagagttatctttcatatatgtacaagttattggtagtcttatttttgggctgtttgttgacttatgccccatttgttttacttgttctttaatataaacccttccattttttaacaattcctaacacttgatatcttaatatcagtcactaacattagtaacttcttgtatgttatattatggcagatctctttacgttttttctcacatctatctgctagtccaggaatttgttactaaatagattttcttggatatttggttgcctcaaagtgcttacatttgttaacagattgtaaaccacatttatttacattgatgaatgggctgttgaataatcattgtaaagcactttgtatatataaggtgctatataagtgtgaaatatcattcatttataaatgaaatgccttctaactttccatattgacttatgtatttggtcccaaattatatttaa

SEQ ID NO: 45156 - DNA, 1029 bp, Homo sapiens
agtgtcatttttgttttctttgtaccaataggtaatttgtcgtccagatgctctgctatatgtgaagtatcatttttctattgaacacaggtcatccttcagtttcatttttctcttcaccaattggatgctgcatacctggttttcagctcattcatgtgttagatcccctgtgtcctagatcgtatacctttctctttcttgatttactttctcattttatagagcacatcattgagtagaaagatggaaaataatttttgggatttatacaattaaaaatcattagtctcccttcaactttagtaataaaattgtagattggaaattattttccctcagaattttaaaactctttttctgtttctcttagcttcttttcaggttgagaagatttccattcctttgtttaaaacttttctttttctctttatgttctggggatttttctgggttcttctgataatttcttctctttcctctgttttctttttctggaatgccttttagttctatgttgtatctcctcaatttttcttattttcatttgtttatctttttattttcttttgagataatttcatcaattttattttctaactctcgtatggatttttaaagatttctgcattcatttttaatttgggggagctgtttttttgttctgtgaatatgcttttttttttttgagacagagtctcgctcagttgcccaggctggagtgcagtggctcgatctctgctcactgcaagctctgcctcctgggttcacgccattctcctgcctcagcctcccgagtagctgggactacggacgcctgccaccactcccagctaatttttttgtatttttttagtagagatggggtttcaccgtgttagccaggatggtcttgatctcctgacctcgtgatccgcccgcctcggcctcccaaagtgctgggattacaggcgtgagccaccttgcctggcctgaatattcttttttaaatagcatcgttcgtgtgtgtgtgtgtgtgtgtgtgtgttt

SEQ ID NO: 45157 - DNA, 1030 bp, Homo sapiens
ccagcctccacctgctaccctaagcagcctccttctgctgtcctttgtccaccctctgtccctgtcccaccagttgactaatacattttgctttcattttactgaatattcatgagcatctatttaatgcatgctactgtgagtcggacagagtcagacacaaacacctcccacctaacctaatctagaggaacccgcattttagtttgtaataaaaagtaatgattatggaaacagctaacattgggcatttgggataagcctggtgttcgatacctgctttaatccccacggtaacgctgcagcttacaggacccttgagtagaagaggcatcagaacacatttttggaaatgaaaggaagtgaaagctgactgtcatgacttcttgtttcattgtgtattttaggaaattgcagaggccgtcaacatggaaaagcagccccagaacagcaggagaggcctcgccccccgagaggtgccgccagctgttgggctgctgctgatcatggccctgatgaatactctgctctacctctgcctcgaccacttcttcatcgctcctcgacaatccactgtggaccccacacactgtccctatggtcacttcaggataggacagatgaaaaactgctcaccttggctgtcctgcgaggagctgagaacagaagtgagacagctgaagcgtgttggggaaggagctgtaaagagagtgagtccgggttcatttgcgattgctgtcatcctgttatttcgcttaacacagtgtcctccagctccatccatgctggcacggattacggaatttcatcctttgttactgccaaagtgtactccattgcatatgtgcaccacatttgctttggttgattctgtatcttggcaattgtgaatagtgctgcagtaggcataggtttcagcccttagggaagcagtgtggcatccagtgttaggagccctgctagctctacgtttttattgttgagctcaataatcttacatctggcactttatctttttttttttgagagt

SEQ ID NO: 45158 - DNA, 1016 bp, Homo sapiens
gctgcggccttgcagtttgatctcagactgctgtgctagcaatcagtgagactccgtgggcgtaggaccctccgagccacgtgcgggatataatctcctggtgtgccgttttttaagcccgtgggaaaagtgcagtattagggtgggagtgccctgattttccaggtgccgtctgtcacccctttctttgactaggaaagggaatgccctgaccccttgcgcttcctgagtgaggcactgcctcgccgtgcttcggctcgtgcacggtgcgctgcacccactgtcctgcacccactgtctggcactccctagtgaggtgaacctggtacctcagatggaaatgcagaaatcacctgtcttctgcgtcgctcacgctgggagctgtagaccagagctgttcctattcggccatcttgccccttcgatgctttgagatttttaaacccaagattacattaaaagaaccagttgtgcactctcccagtcatctcaaggacacagtacacctgtgtcaggggagctgctcaaagtctggaatgtagatttggggcaacaggtatattaagaagaaagattatagcagagctgggagtcaaatttttttttctcatcgttataatgaaatgacttattgaagggcctgttgtatagtacattaaaaatccatacagtatagcttggatcctgtcagaagagtggatttgattctttctcttaaattattttgtagctctcattttgtgtaacctttgggaggatcccttgtgatgtcttaatgtttgaggctatatttaatgcttaccttctggaaagatgttacatgaacagtctgtttaaagcatggaggaatagtgtccacttcttggcctcttgccagctctgcctcctcatcccttccatcccttctaatcctggacctctcgtcttctgtgcttgtaccccgcatgacgtcatccagccttctggcttcatctgtgcagagactgcttccctgaagttttctatacagctgccta

SEQ ID NO: 45159 - DNA, 1022 bp, Homo sapiens
gtgtggtggtccattggaactggcagtctacttgccactcctccctgccatgcagttatatggagtcttccctcctgagctagcactcccctgccctacattgaatctgcaggtccccctcgttctatgagaccagcttcccaaagccttccagcaccctctgcagcagctctcagtgtcctgcccagaggcaatcgcttcctgccctgaggttccacccactaatgtggcacttgccttgctgaatgctgtgtttgctcatcggtctctcttcataactagacggagagcaactctacgatggggtctgcaccttgttaatttctgtatcttctgcagaacacctgccacttaaaagatatttgttgttctttggtcactaaattaggtgagagttcaggcctgatgctctctatggctttgttgcaggtctttctgtctgagtggaaggagcacaaagttgcactctcacagctcaccagcctggagatgaaagatgatttcctccatggactgcagatgctgaaatctctccaaggcacacatgttgtcacgctgcttggctattgtgaggatgacaacactatgcttactgaatatcaccctctaggttccttgagtaacctggaagaaacactaaacctttcaaagtaccaaaatgtgaacacgtggcagcacaggctggagctggccatggactatgtcagcatcattaattacctgcaccacagccctgtgggcacacgggtcatgtgcgactccaacgacctgccgaagacactgtcccagtatctgctaacaagcaacttcagcattttggcaaatgacttggacgccttacccctggtgaaccacagctccgggatgctggtgaagtgcggccacagggagctgcatggggatttcgtggctccagagcaactgtggccctatggagaggacgtgcctttccacgatgatctcatgccctcatatgatgagaagattgacatttggaagatcccagacatctccagtttcct

SEQ ID NO: 45160 - DNA, 1006 bp, Homo sapiens
ggctaatttttgtatttttagtggaggtggggtttcaccatgttggccaggctggtcccgaactcctgacttcctcggcctcccaaagtgttgggattacaggcatgggccactatgcctggccagttgttagatttccatggatttgtagtttccaaagtttctcgttattgatttctacttttcttccattgtggtctgagaaggtacttgatatgatttagatttttaaaaatttattgagacttgttttgtggtctaacatatggtctatgctgcagaatggtccatgtgctgatgagaagaatgtatattctgcagctgttggaagaaagggtctgtaaatgtctgttaggtccatttggtctataatgcagattaagtctgatgtttctttctagatgatctgcccaatactgaaagtgaggcattaaaatcccctgcttttttttgtattaggatctgcctctctctttagctctaatagtgtttgtttatacatgtgagtactttggtattgggtgcatatatatttaaaattgttacatccttttgctgaattgatccctttttcattatgtaatgatcttctttgtccctttttatgttttctgacttagtctattatgaataagtatagctactcctgcacatttttggtttaaatttgcacggaatatttttttccatctgttcactttcagtctatatgtgtttttacatgtgaagtgagtttgttataggtaacatatagttgaatcttgtttttttaaaatccattcagccagtctatgtattttaattggagaatttaaattatttacattcagggtttttattgataggtgaggacttagtcctgtgcatttgttttctgattgtcttgtatatattttttcctatcttttttatttatttttattttttattttgagacagagtgttgctgtgtctcccaggctggagtgcagtggcaggatctcggctcactgcaacctctgcctcc

SEQ ID NO: 45161 - DNA, 1027 bp, Homo sapiens
atatatattatcccattctctcctgacctgtaagtttttttttttttttttaaacaggaaattctcttataagtgacttgatgctttccttttgctgtttttagaattctctctgtgtttgacttttgacaatttgattgtaatgtgccttgcagaagacctttttggtttgaatcttttttgggattactgaacatcctgtatctggatgtctgtatctcttgcaagacttaagaaatgtttgactgttattttgctaaataggttttctgtgcctcttcccttctctttcctgaaacaccgagaatttatttggtctgactgggttatttcaaaagacctgtcttcaagttcagaaaatcttagttttgctttatctagcgtacttttgaagctctcagttgcatttttaaattttattcattgaatttttcagttccaggatttgtttggttatttttctatatctatctctactgactgtcttattcagatcatgaattgttttcctactttgtattatctgtgttctcttgcaacttgctgagtttccctaagatcattattttgaattccttttctggcatttttatagatttccttttcttttgaatctgttactggagaattattgtgtctctttggaggtatcaaatttccttgctttttcatgtttcttgtgtccttacattgatatctattcagctagtggaagagttgcttcttccaattttatggattggctttcataaggaaagacttttttgtaggcatatctgtagttttggttgtgattaggatgttttggctttgattctggtgagcacaggagtgtaggctcaatgatttcttcagctgtaaccaatgtaactggtgtcatgtaaccatgtcactgtgagtcctcagtggcttaagttgccattgttagctgaggctgttgtgaggcttttctggggaaagggatgccagaggggccagtccctgggccttttggtggcatgggcaggctttagctgtggtggcgatg

SEQ ID NO: 45162 - DNA, 1052 bp, Homo sapiens
gttctttgacttttcttttcccagaaatgggattcccctcctgcttctgagccagtccaagacatgctggctgctttatttactgctccctttgtgcctcagaagttccctgttgaatagtgttctgtctttggtgctctacctgacatgtggttaactacttgcttttttggtcctttgttgtgcaggagttgagtgccaggctcacggttttttgattaccatagttttgtagtttttgaaattcagaagtgtgagacctccaactttttctttttcaagattattttggctgttgagtcaattatgattccatatgcattttagatggatttttctatttctggaattgtgccattaggagtctgatagatactgcattgaatctgtagagtgctttgggtagtattgacatcttcccactattaagtcttccagtacatgaacacatgcattttcctgatgactaatgatgttgtaccttttcatatgcttattggctatttgtagatcttcctgggagaaatgtctatgcagactttttgccaattttttaatttgtccatttaaaaatcagggttttttttgttgttgagttgtaggagttctttttgtattccttatactagtcccttatcagatatatgctttgcagatattttctcccaggtgggttgtcttcacttccttggtagtgtcttttaatacacaaagttttaaatttttatgaagtcaaatgtatctacatttttctttggttgctcatgcttttggtgttgcatctaagaatccactgccaaatccaaggtcatgaagatttactcctatgttttcttctaagaattttatagtttttgctattacataaggtctttgagccattaagatctttgacttaacttttgtatatgatgtaaagtcactgtcaaacatcattcttttgcatttggctgtccaggtatcccagcattatttgttgaaatgcctacacttctttatattcccttgactcctctaaccaaggcagttggacctttgctactaccactgcc

SEQ ID NO: 45163 - DNA, 1048 bp, Homo sapiens
caccaggagctatttctttctttcttttttttttttttgagacagagtctcgctctgtcgcccaggctggagtgcagtggtgcgaactcagctcactgcaagctccgcctcctgggttcacaccattctcctgactcagcctcccgagtagctgggactataggcacccaccatcacgcctggctaattttttttttttttgtattttttagtagagatggggtttcaccgtgttagccaggatggtctcaatcccctgacctcatgatccaccctccttagcctcccaaactgctgggattacaggtgtgagccaccgtgcctggcccaccaggagctatttcatagggctcttggggcctggtggttctttggtaagtgtggttctttgtattacctgggagatctcaaccatcacagttgtcattagaaatcagcacaactgaattggagagaaattttgtaatgcatatcagaagctattcaaaagcctgtttttggttaaagattttactcttgggcccggtgtggtggctcacgcctgtagtcctagcacttttgggaggtcgaggtgggcagatcacttgaccccaggaagttgagaccagcctaggtaacatggtgaaaccctgtgtctacaaaaaaagacaaaaaaaaattagctggatgtgctggcatgcccctgtagtcccagctacttgggaggctgaggtgggaggattgcttgaactcaggaggttgaggctgcagtgggccgagatcttgccactgcactccagcctgggagacagagcgagactctgtctcaaaaaaaaaaaaaaaaaaattttaactggatgttcccgatcctgaagaggctctgttggtctctgcattggttggatgtggcctggatcactgtaatgtctatgtgttgagcacttgtttctgtgccagccactttgtagatggtcaagtttagatttcccaacggtttcatgaggcacatactcttatgacccttaatttattggtgaggaaactgaggcaagttgggcttcagattcaa

SEQ ID NO: 45164 - DNA, 1032 bp, Homo sapiens
cagaggaagctttcccattacaaaatagagaccgagttcttaccttcctcattgtgttattaagtagttccccatttttttcttttgggtaaatttactcagaggataaattaacttctcttttatataatatcatataaatggcccagttggttgacatgaaccactctgctttgacttttagacaagagcagttcactttatttttcctaccaaattggcacacgtgattttagaatgtgcgtcatctttctgtcatcctcagcacatcatctagtgaactggtgagctgtgtgagtttctggattggggcatgctcccaatccaggattcactgctcccaatccaggagcagtgagtttctctgcccttcagactgaggcttgtcttaaaactgtctgcttacccctctccgatctgccatggaaattaggatattccaaactccaaaacaaagtgatagaaagcagcacttctcaaactttcaagacacgtgcaccccgcccctgggcctcgctaacctgtctgactcaagcaggttctgcatttctaacaagctgcctggctacaatcgcagctcagtaacgtggtaggggagaaagcttgaactttagagtaatacaaattgggttcatatcaattatttcattgaaaaaccgtggtcacaggcagttatctaattcttgagaggcttaatttattcatctgtaaagtggggaaaatacctagctcataagattgtcattattatagggaaactactaaattcagtacatgtcacatcttagcactcgatgaatataagttccttacacgatcctttgatgcactagatttgagtggtgttgactgaatcctcttgtagtagagacatctgtgcaaaaggagacctgtgtgtgtgcacatgcatgcatgtgtgtgtgtgcacatgcatgcatgcacgcacatatatctgcgcatacacaaagtaatgtgtgagagaccccagaaatcccagagtgtaagcttttgagaagcactactggaagcaac

SEQ ID NO: 45165 - DNA, 1068 bp, Homo sapiens
aagggaagagattccaccttgccccatgtggaactgaaactactctttgcacatgatgctgcccttccagcctgcgggcagaatgctcttcttgacaaagcaggagtcccttattccttgccccctcgctttccaacatacccagggaggttcagatgactgtgagccaaaaaacaaccagaaaaagtcgagagaataaagagcccctctctttttcacttaggcaacaagcatgaacaagaaaattaagtatttttgttttatttttagaaatcttaacttctccttttcaccctttttttttttttttaattttttgaggtggagtctcactctgccacgcaggctggagtgcagtggtgcgatctctgctcgctgcaacctctgcctctgggttttaagaaattctctgcctcagcctcccaaatagctgggattacaggcacgtgacaccatgcccagctaatttttagtagagatgaggtttcagcatcttggccaagctggtcttgaactcctgacctcgtgatccacctgcctctgcctctcaaagtgctgggattacaggcgtgagccaccatgcctggccacccttctttagatgtgtctattttaacattttacatgtgatggtgatgttatccatgttgaataaactagaaatcagagttgagttgtgagggaaaaagagaaattgcaaatgtatgccttgggcatatggatcatatttggatactgaattgaaccactgaactataaaaacatgttatgaaacagggaaactgcactggctatgtgacggtattaaggaattactgctaacatttaaaaatgtgataagggtattgtggttatgtttagaaataaaaatagtccatatccattagagatacatactaaattgtttttgcatgaaatgatatgatgtctaggattttctataaaacaatccgaggcaggaatgagggacagtgggtgagaggacatatgaagtaagattggccatgtgtcgacacttgttgaagctggatgatggaggtccattattcaggcaaaccctgtgttatt

SEQ ID NO: 45166 - DNA, 1075 bp, Homo sapiens
gccgtatagctgccatacatagacagtgatttctccaatgaatctgggcaaagtccattgaaaaccttctggaaaggattcaccattgtagatgccattaagaaatttgtgattcatgagaggaagtaaaattatcaacattaacaggagtttggaggaagttgattccagccctcatggatgactcgggggtttaaggcttcagtggaggaaataactgcagatgtggtggaaataaaactagaattagaagtgaagcctgaagatgtgactgaattgctgcaatctcatgacaatacttgatcagacaaggagttgcttcttatagatgagcaaaggaagtggtttctcaaggtggaatctactcctggtaaccatgttgtgaacattgctgagatgacaacaaaggatttagaatatcacataaatgtagttggtagagcagaggcagagtttgagacgattgactctaattttgaaagaaggtctaactgtgggtaaaatgctatcaaacagcatcacgtgctgcagagaaatcttgtgaaaggaaaagtctgtggcaaactgtattgtcttgatttcggaaattgccacagccacctcaacctacggcagccaccaccctgaccactcagcagccatcaacatggaggccagatcctccaccagcaaaaagattagaacttgctgaaggctcaaataatcattaactttttattagcaatacatttttaaattaaggtatgtaaactgtctttttgtgcataatggtattgcacacttaatagactatagtatagtgtaatatataacttttatatacactgggtcacagaaaatttgtgagagtcactgtattgtgatattggccttattgtggtggtctgggaccaagcctgcagtgtcttgagctatgcctgtactggtttctctgcttctgtgtaactgttcatgaccaaaaaataaaaggggaaaaaatcctatgcactggataatttgtttatgccagggtagggtatacttttcaaaagatttcttcccaggtagaaatctcattttaaagaaaaaccagtta

SEQ ID NO: 45167 - DNA, 1055 bp, Homo sapiens
tgctttgaatgagtatcagagtcgggagggcactagtcactgtcctcaagggccttgcaactgtcgttagcagaagaggacacaaacatctagacaatggccaaatggagccctcaggcaatatgtactttaataggcactagcaagaggtggaggtcacttctagatggtgtttcatatgaatgtggacttggtggatctccaaaaagggagccactgcttccagtaggattcattttagggtttgttgtcaggtctgttcttccggtcatacggttgggtagcagatagggcagggagggtcagtcagtggcgttcttggggtgatacagctgggtagtgggtagggcagggagagtggcttgtgttgggcctgcaaggtcctagcagacgtgcgggttgattgcaaattcctaataggaaagagccagggtcaggcacaggcctggctttatccccacacctgagtaagacgctttggttcttatcccagtctctcatctggccagcttcctgttttgagtttgagccatgtccctgactgaccctccctctattaagagggattggcctgtttttggaagctgggctgagcccatgtctcttgaccgtatatatttccatgtccaagagcttaaaaaagacttacttagatgcaatataggtatgtcttcccctttaggaaacaaataatgttgtcctgggatgagaggagaagtcctggctaacacttgacctaacttgtgtcttttgcagtgtcttgggacaaggtgcgcattcctggtgtgctgcagcgattgggagtgacatactttgtggttgctgtgttggagctcctctttgctaaacctgtgcctgaacattgtgcctcggtgagaaaccatgttttaattaagaaaaactttttttaaattaaaaaaaatgtattgtgtggtgatacggtctcactatgttgtccagactggtccctcactcctggcttcaagtgatcctcctgccttggccacccaaagcgccgggattacaggtgtgagccaccatgcctggccagaaac

SEQ ID NO: 45168 - DNA, 1213 bp, Homo sapiens
taaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacg

SEQ ID NO: 45169 - DNA, 1032 bp, Homo sapiens
ttcctgcccgtttttatacaactgcttatatatatttaaaaatttgtacattattttttttaaatttaatgtcattagttttacatgggtgtgttgtttgaaaaataggtaagaataatattttccattctgataaaatcaaaagcagattatgtattcttatgtgtaaataagatttccattggcgttgcatatattttttagtttccattcttaaaatgagtggaacctctgtgtaaagaaaatattttattattttaaataaaagcagaatacaacactgtctattttacagttataactggaagataatgtctaatcagaagactctaatagggtaggaaaacattaaaatagttatgtcacgttggtagctgggtaccccatacgtaattttgtatttagtaaatatttttggaatgtggatgaatagaccatgatgacttttttctatttatttttttaaattttctgtgcgtgtgttttttgtttttgtttttgttttttgttggtttgtttgagactggaacttatttctgttgccccagctggagtgcagtggtgcgatcacagctcactgcagcctgggtctcctgtgctcaagcaatcctcttgcctcagacccctgagtagctgggactacaggaacacgccaccaggcctggctaatttttgtatttcttttttagacagatggagttttgccatgttccccaggctggtctcaaactccggggctcaagtgatctgcctgcgttggcctcccaaagtgctggggttacaggcatgagccaccatgccttgcctgttataatgttaagagaataaataaggtgtaatttctgtaaatatttagacacacatgaataatttatttgaaagttacctgtccagtttgtatagctctagatatattctgtacttgttaaatgctatgaccaaagaaaagcagtatacaatatcgcttgtccaagtgctagtttatttatggaaaaaagcgaaacctactttgtgcctgagttttgtatgtac

SEQ ID NO: 45170 - DNA, 1028 bp, Homo sapiens
agttagagcaattaacacctatattactaataatatttccagtagtatggatgctttggttatggttaaatggttctgaaatctacacctgagatgcttcccttaaaggggctctttggccagttcaccaattacttggaagaggaagaggaagtctaggttgattatattgctttgagttagaatatctgagaaagtggtacttatattagtttgctagtgctgcgatgataaagtactacatactggatggcttcaataacagaactttattttctcacagtcctagaggctggaagatcgtctgggacaagtccaggtgctggcagggttgatttctcctgaggcctctctctgtggcttgcaaggtggctgtgtcttgacatggcctcttctctgtgtgtccctcccccttcttataaggatgtcagtcagattggattagggcccaccctaacggcagcattttaacattcacttatttaaagaccttatctctaagaacattacattctgaggacctgagactttcagtgtataaatttgggaggacacaatttagcctataatagtgctataaagagaagttcaaaaatgaagatggagattttattttttaagcaaaaaaataagtttgcttttagagtgttaaattgggaatgtacactagatagttgatgttgtcactttggatttggaagagaacacaaggttggttgcttgatttggaaagcatttgcttagaggtagtatattaaaattagagcaacataaggaaattgatttttctccacatttctgggacaagaggaaaaagtagtataagtaatcgtaaaaaattcttagaaagtatgaagaaaggagcccacaagagaaatttgaaggataagatttgtttctcatggacttatttcagttggtcagtctattttcctttttttaaatgccagaaaatttaaaacatcaattgtaatgaaaatgtttttcagattagaaatattttggaaggaatttacttaaaacaagtt

SEQ ID NO: 45171 - DNA, 1076 bp, Homo sapiens
gcatttggtggtgtcagtgttaggaattttagccattctagtaagtatgtcatgatatctcagtgttgtttaaatttgcatttctctggtaatatatgatgtggagcatcttttcttgtacttatttgccatctgtatctgtatcttctttggagagatatctgttaaggcttttggccaattattagtttctaaggtaaagcttagattattgattttgatcatttttcttttttaaagcagtcagatgtcatttagtgatcagaatacatcctgaagaaatgtgtcattattaggtgattttgtccttgtgcgaacatcatagagtgttcttactcaaacctaggtggtttagtctactacacacctacactatatggttaagcctatatctaggctgcaaacctttatagcattttactgtactggatactgtagacaattggaacacaaaggtagttatttatgtatctaagcatagaaaaggtacattataatatggcataaaagataaacagtggtatacatgtatagggcacttaccatgaatggagcttgtagaactgaaaggtgctctgggtgagtcagtgagtgagtgttgagtgaatgtgaaggcctaggacattaccatacactactatcaactttataaacatagtacacttagactacactaaacttatttttaaaaattttctttcttcaataataaattaatcttagcttactgtaacgtttttacttcttcttcatttttttcactttttgactctttagtaataccactttgtaatagctcttttgtaataacacttagcttaaaacataaacatattgttcagctgtacagaagtatttttttttgagagagagtctctgttgtccaggctggagtgcagtggcgtgatctcagcttatatattctgtcagcttttttctatttaaaaaatttttttaaactttttttttttttttttttttttattatactctaagttttagggtacatgtgcacattgtgcaggttagttacatatgtatacatgtgccatgctggtgcgctgcacccactaatg

SEQ ID NO: 45172 - DNA, 1026 bp, Homo sapiens
aattctttattgatgccaagtttttgttttttccttgtaaattgtggtaggtagaattctaaatgacctccagtagacccactaccagtatatattgcataatccatgggactgtgtgactagggtggcttatactcctgtgattatgtttaatatatggcacagttgacttcgagaagggaatttattgtcagtgggcttgacccatttgccagagccctttaaacctgtatttagaggtcagaagctgaggaggtaagagattcgaagcaggagaggggtttatgtgctgttgctggcttggagatggagaggactacctggcaaggaatgcagcagtatccaggagcccagagcaaaccccagttgatagccaacaaggaaacagggacctcagtcctatcactgcaggagctgaattctgctagtacaaagaatgagcttggaattggatttttctccagagctcccagaggagaactaagctccaccaccaccttgatttcatctttgtgacactctgagcaggggacccagttaaaacatggccagacttctgacttctggagctgggagctaataaatgagtgttgctttaagccactaagtttgcggtaatttgttacacagcaataggaaactaacaaagtttttgaacaacagttgaaagttacaggtagtatagaccattatataaactcacaaatttaagacagtgggaatatgggactagaaagaagttaaatggttggtaagaaattctaccacttagcccacattgccacccttcccatggccagcccactccactcctttcatagcacttagtggagtgtgtccataacccgcccaagtcttgctcagtgttgtagcagcagcattgtagcagatacttggttttcagcctgaatgtattcagtgaacgaacgtaggaaggaattgtgaaatgctagttggagaaaataagcagctggaggaaagaaggcaagctggagattataggaacagtgattcaaagccaaatta

SEQ ID NO: 45173 - DNA, 1034 bp, Homo sapiens
agcaacactgaatctaggtaaattaaacctttttgttgtaagagccagttacaggaactgagcaggaattgaagagcaaaaagattatttatttctggctagctttaaacatggatgagatcacgtgccaagtaatgtgagcagccttttgaagttgagagcagcctcaattgcttgcaaggaaacagggaccccagtgtggaaggaactgaatcacaccccaagcaggtgtgattggaagaggatcctgagctccagatgacaagggaccccagccaggaccttgcttttggccttgggaagccctgtatatagaacccggtcatgtcatgcccagccttctgtttacccagataaagtttgaacagagctgtgagctgataaatgggtcgtgttttaagttgctaagtttgtggtgatttgttgtgaagcattagaaaacccatacagggcaacattaaccagtctggaatatcccagtgccagtggcaggatcccatacatcaatgtctcttcagaacatttgatgttgtactaaggtcatagtaggttccaataaatagtaagttgaattttcaaaatcactatacttgtagtgtaggtcatctgaattttagagttttgtagcatatcaaggtacattgagtgatgaggaaaaacatcttgagattttccttaaaaaaaaaaattttttttaacctagtaaagaaattgagaaacatcatttttattgaagtgcatttgttctggattggggttggcaaactatagcttacaggccaaatctggcctatcacctgtctccataaataaagttttattggagtacaaccacactcactagttcatgtgttatctctggctgccgtcgcattacagtggcaaggttgggtatttgtgacagacactgcatggcccacaaaacctaaaatatttaccatatagtcctttatagaaaagcttgctgacccctgttctggatggtgatttgctttctagccacagccacattcatttaaccctaaatggcttcc

SEQ ID NO: 45174 - DNA, 1052 bp, Homo sapiens
caagagtggggtttccagcactacctttgacatttctagtttttcttagggactgagagtacctggcactttttcccatagttcatgttcttgcatgaatatcaaagagtaattattttcagagatgacttatgtctataatattgttttagctcattgtggccaataaaattcccaacagtatattaaagactatcttttcactattgaaataatgatgaaacaagcattatgaaacatgacacctttcaaattccttaatactaaagtccttgggaaatcacacttgttgaatgtcatggttatggaaaaatacataggacaaatttgttctttaaagagaattcattttgcctttctttgtaattgcagctatcaaagttaaatgttatctacatacatatagattttactctcttattcttctggcttccattattttctagacagagcctggtacattgtgtataagatactgtgtggatagtggtggttcctgagatttttctgttaacttgtgtgactgtgaacaactgcatataattcatttaatcttgtgtcagtttacctcatttgtcttctttcaccccaaagtaatctcatgaggattattttgctcaagtttgattatttcaaagaaggatcattatgtacacctaagatggcaagatggcaaggtggcacttgccaaaagtccagccggtgcctttggagctaaccttggatcttgaagggggccctgggactctgaaataattgctagtagatttgctttacagttgagtgttttgagctctcagtggctcagcttaattgtgaacaagtagccagatgtaaatctctaaagagcagaacctatattttattcatctttatagtcctcctagtgtccacattgagtcttgctgttatctggcccctaaacccaaggcaaactggaaggggctcgtggctttggcatcagccagaaaaggctgttagggcagtatccggcaccctaggagtggggccagcgagcagagcagcctacatgtagccagagggaaggaagc

SEQ ID NO: 45175 - DNA, 1087 bp, Homo sapiens
caaaggattataaatcatgctgctataaagacacatgcgcatgtacgtttactgtggcactattcacaatagcaaagacttggaaccaacccaaatgtccatcaataatatactggattaagaaaatgtggcacatacacaccatggaataccatgcagccataaaataggatgagttcatgtcctttgtagggatatgaatgaagctggaagccatcattctcagcaaactatcacagggacaaaaaaccaaacaccgcatgttctcactcttaggtgggaagtggaaaatgagaacacttggacacaggaagggaaacatcacacaccagggcctgtggtggggtgcgggggtggggaagcggggaagggataggattaggagatatacctaatgtaaacagtgagttaatgggttcagcacaccaacatggcacatgtgtacatatgtaacaaacctgcacatggtatacatgtaccctagaacttaaagtataataaaaataaaaataaaagacctgaaagaaactgtcaaccaagattgtatatctgaaaacaatatctttaagaataaaggagatgaagctgggcatggtggcttgcatctatagcctcaatgacttgggagactgagggaggaagattgctggaacccaggaacttgaggctacagtgtgctatgagcatgtgtgtgaacagccactgcattccctccagcccagacaacacatcaaactgctgtctcaaaaaaaaataataataataaataagaataaaggagaaattaacacatttccaaatattataaaaccctaagtagttcattactgatagacaaaaaatgctacagcaagtccttcaggctgaaaggaagaaatactaaacagcaatttgaagccaaaagaaaaaaataaagagtattggtcaaggtagttgcataggtaaatgtaaaagccaatgttactgtgcttttggtattgtttgttatttctctttttcctatataattttatgggcaagtgcatttaataatacttacaaatctatattaggatgcatataacgtataaagatatagtctgtgaca

SEQ ID NO: 45176 - DNA, 1081 bp, Homo sapiens
caaatagccaaggcagtcctgagcaaaaagaacaaagctggaggtgttatgctacctgacttcaatctatacaacagggctgcagtaacaaagacagtatagtactggtacaaaaacagacacatagaccaatggaacagaataaacaacccaaaaataaggccgcacacctacagtcatctgatccttgacagtgctgacaaaaacaagcaataggaaaaggactccattcaataaatggtgttgggatagctggctagccacatgcagaagattgagccttggaccctttgcttatataaaaataactcaagatggatcaaaaatgtaaaacttaaaactaaaaatgctgcaagacaacccaggcagtaccgctctggacataaaatttaggcaaagatttcattatgaagacaccagcagcaattgcaacaaaaggaaaaattgacatatgggatctaattaaatcaaagagcctctgcacggcaaaagaaactatcaacagagacaactatcgacagcctacagaaagggagaaaaattttgcagactacacatctgacaaaggtctaatatccagcatttataaggaacttaaacatatttacaaggaaaaaacaaaaagcctctttaaaaagtaagcaaatgacatgaacagacacttttcaaaagaagacattcatatggccaacaagcacatgaaaaaaagctgaacatcacttatcattagagaaatgcaaatcagaaccacaatgagataccatctcacaccaattagaatggctattattaaaaagtcaaaaaaataacagctgctggcaaggttgtggagaaaaaggaatgtttgtacactgttggtgggagtataaattccttcaaccattgtggaaaacagtattgccattcctgtggaaaacagcattgccattcctcaaagagctcaaatcagaactctcatttgactcagaaatcccattactgggtatatatacccaaaggaatataaatcattctaccataaagacgcaggcaagcatatgtttgttgcagcattgttgacaatagcaaaaaaatggaatca

SEQ ID NO: 45177 - DNA, 1062 bp, Homo sapiens
tgtacaatctgggatcaagtgttctcgctgctctcagggatcggcgcacagcctgtgtgctcccatgtggcctgacttggatttcagagtttatatgaggcacagctgagagtctggaaaaggcacagcatcttctccttcctgtccagatgagccaagtgagcaggaagggtctcagcatctattcctgaggccctatgagaggtttcttcattcctttataatgattaagccctacattgggaatgggtttgatttgtcattgtacaaacttcagaggctttaatggtaattttattaaccttgctggaccttatggaatgttgataaaagcaaccactctttgttatgaaagcaaaaagagacattgaaaagttagttcaagataattggcaaagccagctgccatgatgagattgttgaatagtgatggtggtaatggcagaaaaggtgaaggctctttcttgaaagacagcacaggaatcaccgctctaatgctatctttgtgatgttactgttgaatatatgtgaggtgctgctgtcttctgactgacttcttggtcactatcacagtgttatgactgctataaggtgtaatggtcttttctcgtcattacattctgtttaggttttgtattgtatgagagagatctggggaaagagatatataattggacatttgtatatataatgttaagtgaaaaactgagagttgtaatgcagctctaagttccaagattgatggttggccagatgcgttggctcatgcctgtaattccagcacattgggaggccgaggtgggcagatcacttgaggccaggagttcgagaccagcctggccaacatggagaaactccgtctctactaaaaaaagatagaaaaattagcaaggcagggtggcacatgcctgtaatcccagctactctggagtctgaggcaggagaatcgcctgaacctgggaggctccatcagggcactgcctgttttgcttaccactgtatttctggccacttcagtgtttgtgttcaatgtgtatttaatgactatggacagaatgaata

SEQ ID NO: 45178 - DNA, 1104 bp, Homo sapiens
aaagctggacagagaatgacgactttgacgagttgagagatgaaggcttcagatgatcaaacttctctgagctaaaggaagaagtttgaacccatcgcaaagcagctaaaaaccttgaaaaaagattagacgaatggctaactagaataaccagtgtagagaagtccttaaatgacctgattgagctgaaaaccacggcacaagaactatgtgacaaatgcacaagcttcagaagcctatttgatcaactgaaagaaaaggtatcagagactggagatcaaatgaatgaaatgaagcaacaaaagaagtttagagaaaaaagagcaaaaagaagcaaacaaagcctccaagaaatatgggactatgtgaaaagaccaaatctacgtctgattggtgtacctgaaagtgacggggagaatggaaccaacctggaaaacactctgcggatattatccaggagaacttccccaacctagtgaggcagaccaacattcaaattcaggaaatagagaacgccacaaagatactcctcgagaagagcaactccaagacacataattgtcacattcaccaaggttgaaatggaggaaaaaatgttaagagcacccagagagaaaggtcgggttacccacaaagggaagcccatcagactaacagcggatctctcggcagacactccgcaagccagaagagagtgggggccgatattcaacattcttaaagaaaagaattttcaacccagaatttcatatccagccaaactacgcttcataagtgaaggagaaataaaatcctttacagacaagcaaatgctgagagattttgtcaccaccaggcctgccctaaaagagctcctgaaggaagcactaaacgcggaaaggaacaactggtagcagccactgcaaaaacatgccaaattgtaaagaccatcaatgctaggaagaaactgcattaactaacgagcaaaataaccagctaacatcataatgacaggatcaaattcacatataacaatattaaccttaaatgtaaatgggctaaatgctccaattaaaagacacagactggcaaattggataaacagtgaagatccatcagtgtgct

SEQ ID NO: 45179 - DNA, 1024 bp, Homo sapiens
tattccccccttgcctcatttccctgactggaacctctagtacaatgtcgaatagaagtgtcagagcagacatctttgtccttttgtggatcttagggggaaagtgttcagggaaagcattcaccattaagtctgatgttagttgtagggcttttgtggatgctgtttgtcagtttgaggaagttgtcttgtatttctgaagttcttgagtgttttcatcatgaacatgtattaaatttagtaaaatgctttttctgtgtctatttagatgattatgtcactttttttctttagtgagatgattctgttacattaattgagtttcaagtggtaaagcaacctatgattcgtggtataaatctcatttagttgtggtatataatccgttttatgtgttgctggatttggtttgctcacattttgtgagagtttttgcatatatactcataagagatatgggtctggaattttcttgtgatgtcttttattttggtgtgagagtaatactattgacctcatagaatgaattccctactcttttttttttttttttttgagtttgtaaaagattgttatgaatttctctttaaacatttggtagaattcaccactgaaactatctgggcctatgtttgtttgtttgtttgtttgtttgtttgtttgtcagaagttttaagttactgacttaatttctttatttgtaatagatttattcagatttttaatttctacctgtcagttttgggagtttgtgcctttctagaagtttgtccattttacttccattttctcatttgttggcttacggttgctcagtttatttccttttagtgtgctatagaatccctttgctttctgtaagcttggtagtgcttcctctctttcgattctgattttcacaatttgagccttctctcattttttcttggtcaccctagctaatagtttgttgattttgttggtcttttcaaacaaccatcttttggtttcattggtttcctttattgttttctattctctattt

SEQ ID NO: 45180 - DNA, 1105 bp, Homo sapiens
catcaatacaaacataatgtcaagaattaactgtaactttcaatgttgaaacaaagaaaaagaccgatgtgtgttttcttataagactggaggacagatgatgcctctctctctctgtctctctttctctcccttgttttggcagtgataggccaaagggaagcacattgttggccagttgatctaaaagttcctttgcatcattctggtaatgagcaacaaaggcacttattggcaaacgttccatcttgaataactgaggtcagcagtttctttatcaaagcaacccaggttaaatatgctcttttatgatctaacacactgtaataatcaaatcaccatttttaaaagcaacccagaacattattgaaaaatagcttttttgttttaaaataaagcagtaatacaaaacaatgcttaagttatgagttacaatgaatgctttcagtgtttatgaccttcccagatagtctctaggaagattgtctgtattctgactataaaaataggaccaggatgaagtttttttgactgttactgctggtatatcctagatactctgtgctattttctgggcttttcctttgctgcctaagggagagaatatcacatctatcaggtcaagacttgtacatttgccacaccaacttagacctaacatgtttgcatttatgttcaaccagtccatagtgtatgatatactccattgtctttgctataaaagaaaggcataatgttaagaatatcttttatatctatattgagtaattgccgtgcccttacttagctggttcattttgatcccaaattcagtgtttcttcatttagctttttgatgacgtactgaataaacagtgtcgcaatatgtacctattttgctcatttaagaaaatatttgtaatcactaccacgagggtttttcattaccatctagaagcaaagacctctgttttccttcagttaactttcagtatcagaaattctaactgtttagcaaaagaaaccataaaaaccatttatgtggatcagtgagcctttactgctgtctgcccaggaggaactcaataaatgcctcttgactgatggaaaattgctttggtaatac

SEQ ID NO: 45181 - DNA, 1044 bp, Homo sapiens
tgttctatgtctaggaaccctgctaggttctcactgtgaagatcagggaacaacccattgtgcttgtatcgggggaagggaaaggtagccatttaacagtataccggagcattcagccctcaagagaaactgttttaccagagtctgaccaattggagttttattggagcccagttaacttggggggaaggaaaaacgccaacaccaactccagatttcctccagccttcctgtttctctggggagaaaaaagcttagaagcacctgtcaagatctcagcccagaggcacaggcttactaaagacctagacctcatcataggactatagaacacctcccataccctgacaccataccaccacatcagcaaggctcctgtgtagtaacagaggaataaaatggaaagaactgagcatctcagaccttatttaagaaggctgtagagaaactcaaagataacaggggagacaaaaacatggacaccagagaaaattttagcttcggaaaacactctagcaaacaataaagacggcccatcattaaagtcgccaggtcaaccagatgtagcctctgtaggtgttggccttggcgaccagcttgggatcagtatggttcgccagatggcccccactggcaccagtcttggttgggttcaccagatgttgcctgtgggctactgttttattttatttttctatttccatctttggacagagagctactattcttttaatggacgtgaaatggtgaaggcacacaagcatattgctgtcattgttttcttgctttcctaaattacttttaccagtggtatatctttttttaaaagctatctacttggagatggtgtgtcttgattgacatctcatggagaagtggatggggaaaatactggttctgtggaaagactctctccgttagtggcttgctcatccagctctgatctttctgttccaggactctccctgtttcaacaacagcaacaacatgataataacaaacctcacatatgttgttccactggataattgtaattttttaaaa

SEQ ID NO: 45182 - DNA, 1159 bp, Homo sapiens
attcctgaacctaggatgtgattatagcaaggctgcagaatatgttaatatgtaatagtcagttacttatatactagcaatgaacaattagagaataaaaacaatgccatttacatttgcatcaaaaaaatcaaacaggtataatctaaaaatatatatatatataagatctacatgaagaaatgtacaaaattctgatgaagaaatcaaagaagagctaaacaggtattccacgttcatagataagaagactcaatgttattaagatgtcagttcttcccaacttgatttgtagattcagtgtaattccaatcaaaatgcctataagttatttcatggttatcaacaaactgattctaaagtttctgttgaaatgcaaaatacctacaatagccgactcaatactgaaagagaacaaagagaagtgacattatccaacttcaagaattatggtaagtaatcaaggcagtgatacaggaaaaagaatagccaaataggtcaatggaacaaaatatagaacaagaaattgacataaatatagtcaactgatctttgacaaagaagcaaaggatatttaatggaaaaataatcttttcaagaaattgtgctggaacacctgaacatctacataaaaaagaatgaatctagacacagatcttacaccaaaaagtaactcaaaatagatcatagacctaaatgtaaaatgtgaaactataaaactagaatataagatagaagagaatctagatgactttaagtttggcagtgaccaaaggcactatctgtgagagaaaaagtttacaagatgaactttgttaaaatttttaaattctgctctgtgaaagacactgttaagacaatgaagacaagccatggacatatcttgtaaagaacttgtactcagaatatactaagaacttttaaaactcagtaagaaaacagacaacccaattaaaaaattaataaaagctctgaacagacaactcattaaggagatgtacagatggcagataatcacattaaaagatgcttgacatcatgtgtcatcaggaattgcaaattgaaacagcaatgagataccactagacatctattagaatggctaacagtcaaaacacacaacaccaaatgtagggaaggatatggaagaacagaacta

SEQ ID NO: 45183 - DNA, 1047 bp, Homo sapiens
attcttaccatatgatccagcaattgcactttttgatatttatccaaataattgttgaaagcatgcctatacaaacatgagcataaatgcttatagcagctttattcataattaccaaaaacttggaagtaaccgagatgtctccagtaggtgaatggataaacatactggtgcatattcatccacacaatagaatattactcagtgacaaaatgaaatgagctgtcaagccatgaaaaaacatagaggaaccttaaatgcatattgctaagtgaaagaaaccaatctaaaaaggctgcatgctgtataattctaactgacattctggaaaaggcaaaactatggaaatagtaaaaagatccatggggtttagagggagggagagatgaataggtggtggacagggtatgtttagagcagtgaaacttctgtatgatactgtaatggtggacacgtgtcattatgcatttgccaaaacccatagacctgtacaacacgaagagtgaacccaatgtaaactatgaactttactcaataaggtgtcaatattggctcaccagctgtaataaatgtatcacattaatgcaagatgttaatagggaaactgagataggtgagagggtatatgggaactctcagtatttctgcttcatttcttcataaacctaaagctactctaaaaattagtatattaattttttaaagaatgaaaaaacagggccagacatggtggctcacacctgtaatcccaacagtttgggaggctgaggcgggcggatcatttgaggtcaggagttcgagaccagcctggaaaacggtgaaaccccatctctactaaaaatacaaaaattagtcaggcgtggtgactcgcgcatataatctcagctactcaggaggctgagacaggagaattgcttgaacctgggaggcagaagttgcagtgagccgggatcgtgccactgtattccagcctgggcaatagagctagactccgtctcaaaataaaaataaagaaaaaataggagttcccagaggttgctgagaaga

SEQ ID NO: 45184 - DNA, 1097 bp, Homo sapiens
agatactgtggaagtatgcctccatgaagtggagagaaggagaagatggaaaaaagggggtgacctttgggtagtcaatgcggcaggcgtatctgaataaattagaaaaatattcctgaaccctaggaacctacgtcttgatgctgtcttagagaaggcgcctgtccaggccagttgctgcacctctgttctgaactgataacaagaagggcagttgcagggagattatgagcgtcatatggcaaagtctttcatgctaatctgtgtacctttttggttatgtcctaaactgtttgcaagtcagaaactgattatataatatttggtgtatgtatttcttatttttaaaaaacatgctaagctatgtcattgttactgtattaaagtgtgaataacctggagggcaaaaacaggtgttggctgaacccttcctacacagcctgaagaccacactatggttggctatctcttaaatacttaaataatgttgttggccaacattatgtataagtagactcatctcatttctaagttcatgaacctttggtatatcactaaagacaattaagaccttttgagatacgcacaagacttttgtgctctttaatttatttaaggaagacagttttctactttaatgcttctgtgtagaaatgggctttactgttattcacaatagcagcgacctggaatcagcctgggtgccctatagcagtggactagattaaaaaaaatgtggtacatacacaccatggaatactttgcagccataaaaaatgaaatcgatggcctttgcaggaacatggatgcagctggaggccattattctaagtgaattaacgcagaaacacaaccaaacaccacatttaatcacttgttagtagaagctaactactgggtacacatgtacataaagataggaataatggacactggaaaccccaaaagaggggagggagggagcagggcaaggttgaaaaactacttacttggtactatgttcactgttgaggtgacagcatcagtagaagcccaaacatcagcatcatgcaatgtgctcatttaacaaacctgcatgtgtatcccttaaatctaaa

SEQ ID NO: 45185 - DNA, 1032 bp, Homo sapiens
gagtctccaagcagaactgatttaacatttaatcccaaacctgttcagtaccttgctcatttgcttcttcctctgaactgtgtccccttaagccaggcttcaggacgcctccctcaaccacttgaagaagctgccagcagcctctctacactgtgtccagatttcacatacttttctcagcccgctgcagttgatctttagctgctacttctctgctgagattggctgctcagcagtcagtctctgatcaactgacttttaaatccattggctttttccagcttgcatcctttttgcctcctctgtacctttgccatttctgacttgctagtctagctgcagtgcccacccctgcccctcctgggatcctcccccatctccctctggcagctttctcaccctcttccctgggtcccttgtaccatctctcccactagctgcccttcttatgcccatcctatacgtaagggttactatgggtcgacatatagccttgtataacatgtacggtaactgacacattatatctcgtacactgatacaaagaagtggttttgaaataatactgagaagtggaatactgaattttgtttgtaaagcatgactacaaaccacaaaatatgttcaaagaaagaggtgagggaattacacaagtgttcggctgtctgccttgtgattttttcctccttttccaatctttccaagtttttataatgttcacttcttttataaccagaaaaagatttgtttctcttgtctcttttatgcttcctttatatgtatcttagagtgatcacatccacttataataatttcacctagttaacagctatagccctaggcgtgattttcttctcctcttgccatttggcattatataatgtagatttccccattccttggatggtatttgtgaccatcttattgatgtcataacatttcattggtttaaaaaggtatctaattttaaatagtttttgttgattttaatattacctgtgtaacagttggtcagtggtggaggttgtgaat

SEQ ID NO: 45186 - DNA, 1067 bp, Homo sapiens
gtcccatctagtcaggaagctaaagcaggaagatcacctgatcccaggagtttgaggctggcctgggcaacatagtgagaccctatctctaaaacaaaaacaaacaaaaatcacactgtggagatcaatttaaaaaaaaaatcagttgggcatatttgtgtagtatatttctgggttcttctgtttcattgatctatgtgtctatcccttcaataacaccatataatattggttattatagttataaaataagtctttaaattagggaaagtgatctcctttacttcattctttttcaaaattgttttagctatgttagttcctttgcctttccttgcaacttttaaaattagcatatatatatatatatatatatatatatatatatatatatatatatatatatatatatatacacgtatgtatctgcaaacaaaatcatgctggaattgatgggaatttctttaagcctatagatccatttggggagctccttgattttggcatctttatgattttgagtttttcaatccataaatatgtcttccatttgttaagatctttgatttattttatcagtgttttgtagcttcagcatataagtcattacatgttttgtgagattcacactgacatgggttattttggtctttttttttttttagttttacaattttaaatggtatgtttttcccattttggtgtccatgaattcattgacaatatgtagaaatacacctaatttttgtgtgtgttggtttcttcaaccttgcttaatagttctaggagttattttgtagattccttgccatttcctgtgtaagcaatcatgccacctttaaataaggacatttttatttattctttttaatctgtatgcctttccccacctatcttgtcttattgcactagctagaacttctggtactatgttgaatcaaagttgtgagggaggaaatttttgccttgttttccatcttaggtggcaagcatctactctttcatcattaattttaatgctagttgtgggatttctgttgataattctttattaagctgtggaagtt

SEQ ID NO: 45187 - DNA, 1068 bp, Homo sapiens
accctgaacacttgcactacactaaattaaatttttttcttcagtaataagttaaccttaatttactgtaactttctagctttataaactttaaatttttcattaacttttttactcttttatagcaacacttagcttacaacacaaatacattgtacagctataaaaaatattttttctttatatccttttttctatttttatttttatttttttacttttaaaactttttttgttgtaaactaaaacacaaacatacacaatagcctagatcttcacagggtcagggccatcaatatcaccatcttccacctccacatcttgtcccactggaatgtgttgagggacagtaacatgcatgaagctgtcatctccttggataacaatgccttcttctggataccttctgaagtacctgtctaaggatgttttacagataacttgttttttaacaagtagaatactctaaaataacaataaaaagtatagtacagtaaatacataagccagtaacattgtttattattatcaaatattagatactgtacataacaggatgtgctagacttttatgcaactggcaacacactacctttttttttatactttaagttttagggtacatgtgcacaacgtgcaggtttgttacatatgtatacatgttccatgttggtgtgctgcacccattaactcgtcatttagcattaggtatatctcctaatgctatccctacccctttcccccactccacaacaggccccagtgtgtgatcttccccttcctgtgtccatgggcaacacactacttttgtttacaccagcattaccacaaacatgtgaatacatcactaggcaacaggaatttttcgtctccatcatagttttatgagaccacggtcaaacatgctgtccattgttgacagaagcatcattatacagtgcatgctggtatttgacaacgttcattttctctattcttgtaatgtctaagaatttttaaagccctcctttatttatttaaaaaatcatattttgcttttccacaatatgtattatcccttggaataaa

SEQ ID NO: 45188 - DNA, 1066 bp, Homo sapiens
aaatgctaccgatgtgagttgcattgtgaatgctttggagttgtactttggaatacatgtggtgacatatctaatgagaatatccttgtggtagactgaaagaaggccaggcatgaacttcaaaaacaagaaaacaacatccagttattcagagttaatgaatatgcattctgtgtgatgcattttctgtagcacatctgagattgcacaatatcgaggctagacaatattatttccactttgcagatgaggaaacacagcctcaaggaggatctcactgctgacacaggtagacacaaagaaaaatgaatgggatatagaatcccagatggcatggttgtagagtgttagagtttaaaagaaaagggagaggctaggcgcggtggctcatgcctgtaatcccagcactttgggaggccgaggcgggcggatctcgaggtcaggggatcgagaccatcctggccaacatggtgaaaccccgtctctactaaaaatacgaaaattagttgggcatggtggtgcgtgcctgcagtcccagctactctggagactgaggcagaagaatcgcttaaacagggaggcggaggttgcagtgagccaagatcgtgccactgcactccagcctggggacagatgagacttccgtctcaaaaagaaaagggagaaaattgagttagaaccaagccgtgtttagattaaggctgacccagggtcaagttgtccagggcagcagaagtgcaagtgttttgccctggggagacttggttggactgtgtacaaagatgaactttggaactaacggccgtagtgctagccttgagtttgaggacagggctgctgagatgtctttgggtacaagaagatctgatcattaatattttctagattattttgcagtgataatgatcaggctctctagtttacatatcaaattaatatagaagtaaaactgtactttattcactactaattctttgctaatatatttagaaagaaaaacttagagaatatatctgccttcgagacacatttagcagtatgcattctaaggcagttttttatacat

SEQ ID NO: 45189 - DNA, 1081 bp, Homo sapiens
gtctccctactcttcccaccgtacccccaccccattcctgcagctgcaatctggagcagcactgtgatcacactagatcacactttcctgtgagtcagactgcagctctggaatgtgctttgctgagatgacggcacagagaagagccatgggagacagagcacacagcctggcagagtcttcaggggtggccagatgcaagcacacagtgccacgtgcctctgtgggcatgaagcagagaaaggatgagatcaagcctgacccaacttgacttcctcctctagctgagccaccgcaccttgctgcccctctcctccccttttgcctctgtcaaatgacctactctgccctctctcccagctgctgctagacccagagcacttggtgcagccagctggcgggtttggtaggctcacccttgttgtgctgatttcttggctccacagttctcaatggcttgagccagctcagctctttctccacagggaactggagcaaaaatcctgtagagcaattcttgggttggacacccccttcccacgagagaggattatacatgaacagatgcccttgtttcttcctcacttgctgctctggcactggtattataaatggtctgaattttcacatttatttgcacagatacaaaagacagtgacagatgcttgattatatagtgagactaacaaccaggtattaaacattgcactgatacttgtcattgccttcaaaataagctctacgtgttttctttacttcagttgtctcatttaaccataaataagtcctcagaggtcaggggctgtgactcatctggttttggtactggaccatgaatgcagtagacacccagcaagtatgggttgatgggaaacagcaatggctgattgagcagctgagaaggtggggtgaggttgtggctccccttctcttctcaggatgaaccagtccatggagttgtgctacaaatgttgttgtttgtctaaggagattgatgagaatgccagtgagctagaaattgccaggaatactctgctttgggacagaggtgatgtctagtctgttccaatcagatagagga

SEQ ID NO: 45190 - DNA, 1049 bp, Homo sapiens
ctgccttggctgcctcgtctgtagattgtagatttgggttatgtgatctcttcatcctctcatctctgttctcgcttctgtcttattgtgcgcgcctctctcttgatgacctgagcgtctttgaaggaaggggctctgccctttcttgcctgtgtgtgcacatatccatttggcccaggcctctcagtgccgtctggcacagagctgtgtgaatacagggcccccataaatgtttattagagaaatcaaaggtgtgctcagttctaagttgagtgcctagactacagtcagattttcaaactttaaaagttcaagtatgggaggccaaggcaggcagatcacctgaggtcaggagttcaataccagtctggccaacatggtgaaaccctgtctctacaaaaattagccaggcatgatggtgggtgcctgtagtcccagctactcaggaggctgaggcgggagaattgcttgaacccgggaggcggaggttgcagtgactggagatcgtgccattgcactccagcctaggcgacagagtgagatggagggaagtcattgcaagataagactggaaaggtagattgagatcatgttgcagagggcttgagaattatcttatgggcaaactgctgaggcatttgatatgatccaagtagtgtcttagtggcaggcaggaagcagagttcagagcttgaatgtccagggcgaggtgctcagccctgtcagccctgcagggaggcccagcagaggaatggatgcaagagaagggcttcttgagtgatgaaaaaatctggattcagcaatggttaggatttgaggagtaaggaaaacaaaaaggtctaaagatggctttgaagttttcaaccttgataacttggaaaataataggcctggggagagggcaggagaaggtttagacttgaagtcagagacccaccgcttggagcagctgtacagcctgtgacgttccctaagcttctggcctcctggccacaggaggcatagtcctccaagggctgattagaggtaagactcggcctgagtcaggc

SEQ ID NO: 45191 - DNA, 1035 bp, Homo sapiens
tctttccctcttttgtgacctccctattccctgaaacacaacaatattgaaattagagaagtcagtaagcctccagtggcctcgaagtgttcagatgaaaggaagagttgcacatctctcactgtaaataaaaaactggaagtgattaagcttagtggggaaggcatggcaaaagccaagacagatcaaaagctagacctttgcattaaacagccaagttggccaggcgcggtggctcatgcctgtaatcccagcactttgggaggccgaggctggaggatcacttgagcccaggagttcgagaccagcctgggcaacatagtgagcccacatctctaagaaaaaaataattagccaggtgtagtgtagtgcctgtagtccctgctacttgggaagctgaggtggaaggatcacttgagcctgggagttcaaggctgcagcgagccatgatcgtaccactgcactccagcctaagcaacagagcaagaccctatctcaaaaaaaaaaaaaaaagagattgtctaaaattgcagctatttggaaacatttactagtgacagaacagtaagataatcatgcctgtcgtgagagtactgttccttctgagggtattgattaccaaatctcaaccaggagccttggcaggagggtgaggggtcctggaattgacagacattcaccattgtcttcgtagactcaaatagtatgtccaacacaaatatattctacttttggaaagcacatagatgtgattttttaattaactaaagtatgtactttattcgcatttccttagtgtttacctagtgttacctaattatgctccaggatcccattcaggacaccacattatactcagttgccatgtctcctcaggctcctcttggctgtcacaacttttgagacttctcttttatgactttaacagttttgaggagtgttaggtattttgtagaatgtccttaactgtgcccaatgcggtggcttacgcctgcaatcccagcactttgggaggccaaggtggatggatcactt

SEQ ID NO: 45192 - DNA, 1038 bp, Homo sapiens
gaacccacagccaacatcatactgaatggggaaaagctgaaagcattccccttgataactggaacaagacaaggatgcccactgtcacccttctattcaacatagtactgggagtgctagccagaacaatcaggctacagaattaaagggcacccagattggaaaagaggaagtcaaactgttactgtctgccactgatatgattgtatacctagaaaaccctaaagactcctccaaaagacatctagatttgataaacaaattcagcagagtcttagagtacaaaatcaatgtacaaaaatcagtagcactgctatacaccaacaatgaccaagcggggaatcaaatcaagaacccagtctttcttaacaatagctgcaaaaattagaataaaatacttaggaatatacttaaccaaggaggtgaaagataaagagaaccggaaaacactgctggaaatgatcatagatgacagaaacaaatgtaagcacgtctcgtctcatctcatggattggaagaatgaccatcatgaaaatggtcgtgctgcccaaagcaacctacagatttaatgcaattcctatcaaaataccaacatcatttttcacagaattagaaaaaacagtcctaaaattcataggcaccaaaaaagagcctgaatagccaaagcaatagtaagcaaaaagaataaatctggaggtgtcatgtttcctgacttcaaattatactataaggctatagttaccaaaacagcgtggtgctgatataaaagtagatacacagaccactggaaaagaatagcccaagaaataaggccaaatacttacagttaataggtcttcaacaaagcatataaaaacatagattaggggaaggacaccctatttaatcattggtgatgggaaaactgaaaagccacatggagaggaatgaaactggatcctcatctctcaccttatacaaaataaactcaagatggatcaaagacttaaatctaagacctgaaaccataaaaattctagaagataacccaggaaaaac

SEQ ID NO: 45193 - DNA, 1025 bp, Homo sapiens
ttaagtttgaaaatagacaagatggaaaaatccctagaaaaatatattaccaaaatatcttaagaaaaaaattaaaaagttcaaatagtccagttatcattagagatgttgagctggtagttcagaatcttctcaggaaagaaaacactaaagctaaatgattttattacctaattatttctaactgtcaaaacacagattatgtgagtcttatacttagaatttttatctaaaattttcaaaagaaaaggtaatcaacttgttctgtgaagctgatataaatgatcttgataccaaatgtagtatgaaaaataaaattaaagaccaatatcattaatagacctagagacaaaatttctaaataagacatagcaaataggatcttggctttacatcaaaagtgaaaaactactttaatactcagaaagaatttgaaattgtcatttgccacattaacgtgttaaagggggaagcaattatttaaattaatacagataaagcatttgataagctccaacatccattcatgatttaaaaaaaaaaaaaattccttgacaaactaggactccctaactgggtgaaggacatctacaaaaaaccaaaaatgaaaaactaccaacaataaaagcaaacattagtgactataaaacattcaagactttttctttaaagctggaacaaaataaggatgcccagtcactggcttctccagcattgccctgaaggtcctaaaaggcagccataaaagaaaataagaagcaaaattggaattatgaaatgattgcatgaaagtacactaaacggattacaaatagtaattgatggattacaaaagttcaatatacaaggccattgtatttctacacaccagcaacacacaacaacaaacaaaacaccatttaaaatagaacacaaaaccatagacagtctaggcgtagatctaacaaaacatgtacaagagctatatggagaaacttacaaaattttattataaaaattgacctaagtaccccaccaagaaaaga

SEQ ID NO: 45194 - DNA, 1344 bp, Homo sapiens
tacatgcttggttaaaaaaaaaatgattccaagctctctgagggtgagtccatcatgggccaggtgcttccttgttatcttcccgttttctgttgtccacagcaccattgtggcttaaatctcctagagcaaattccactctatccacacccaaaagaaagtggttcaggcagttttaaattgtcctgtgaagatttgagagttagttggatgagacagtatcagatggaaaaaataagccctgaaataactaagagaataggcaagcaagctggtaatatcagctaatgttccggtgtgcaaagaagactttccatgtttactttcttccagtggactggagagtggaaatcttggttgcccttactttgaatggttggttttccaaatgacatttgtcatctaccaatcaagataaataacaccagctataatgaggccagaggaggtagatcatttgctacaccaaaatatccataaaatgtgtgtaaaaatatgtaaatttagcattgtttcaatggcagtgaggtgggaaccctgcttccttcatctattgtatatttctgagactcctcttgggcgtggtgccactcccactctcttcttggtccgcagctgatttctattgccccaggacttgccccatcctcacttctgagctcatgagtgatgctggggctgcctttttaggaattcaggaaatggaggcacccagttaaagttatctgcaccttactcatttccatgcacctttcttgtcgcacgatgggaaacctcagctctagtttgtttactaaggagaaacatctgtcctttgacatcacttccgactcttgaactgaatttgtaatttttttctgaagatggtctcaagttggttctcttcctttgtgatttgttttctacttagattttgacagcttccaaaatatgttaccaacaacaaaattcagacaagaaaattggttttttttcattctaagaagttaactttgctccgtataaatatctccatttgtttattcctaaccctttataatgtttagagtatttttttctctctcaaggatctggtaattactaaaacagcaaatttggaaatgtttttaaaattaaagttaatggctctgtctttgtaaatttttctttacaaatagattggaaatgttcaggtgcaattctgctttgcaccagagagcactttgtaacacaaaaagtcttcagtcagccaagctcacctgtcagcctgcagaaggcacttatcacagatggctggttgtttctagcgccccatgctgccacactctcatagaaaggtgtctgcttcagcacccacacctagca

SEQ ID NO: 45195 - DNA, 1049 bp, Homo sapiens
tatcattttatctcagcagcaatagtgtcactgttcctaattccaagtggagaagaccaaggctaggcctggttatctgctgtctctgatacacacaaccaaaccctggtggagcctggtgtgggtttcctgactcttactcagcccagtgtcccctggtgcttcctggctccacggtccctcagttacctggtgccctgggggtggggcagggacgcaacacacccccacccccaaccacatgctgactgagcttgtgcaggtacttcaccgcgttgtctcatgtccttgtctgtcaaatgggtgtaacattctctcaccatattggattgttctaggatgaatttaggagttttgaaataccctttttcctttgttttctcttcatctgttccccttttcatcatttgacagctgatcagtgcctctcatgaagaaatggagaatgattggcatgagtccctcagtggtgctccctgtgagcaccccagtgtccggctcaggagataggaggatagggctcccagcaaggacgaggcagggcacgtgctatgtcccatactttccaagcctgaggagacctaagactgacttcacgctcctctgcctaccttgagaggggtcagtgtgtgtagggatgcccctggcatctggcacattcctgctcttctgggtcatgggccaggcggtggctctctgtgcaggtgcctttcacccatagggagaatgctgtcctcagagcagccacgtggcagttgcagctaacactcctgcccacggccctctggctgagaccgaggttgaaagtaaagaaagcaggtgtcaaaatgcttgcaccaaagccagttggaggggagctctggggcagagaaagaccaagagtgaagcaggtcatccaccttgccctgtgaaggggtcctccctcagggaggtagagaagataatgttaatcccctcctatccaagaaacaggctcccaccagtgccaagtgcagctttcagtgagcatggcttccagtgggcatgtgtgcctaggaatcagtagtcct

SEQ ID NO: 45196 - DNA, 1032 bp, Homo sapiens
tctggccagtctgattacggccagcattgccagcagctgggaatttgccttctccaagcagctacagctggcccaggcactgggctaacaaggggtgagtgccctaggagccaggctggagggaccaggggttcctactcctgggaaagccaagggagccagagtctcaatgctcctcacacccagggaagccagggcccccacatctcccacactgaaggaaaccagggaagccaaggcccccacatctcccacagtcaacccgcactcaaggaacccaatgctccttacatttacaggagccagggctcccatgcccccccacacccaggggagccagcattctctgtttgtgttgtacagttctgttggttttgacagatgtataataccatgtactaccgttaccattagtgtatcatacagaatagtttcaccaccctaaaaatcctgtgctctggctcttcatccctccctccccactgactactggcagccactcttctttgtactgtctctgtagtttggccttgtccagaatgtcatatagttggaatcatgcagtatgcaaccttttcagattagcttatttccgttagcaatatgcatttaaggttcctccacatcttttcatggcttgatagcgcatttctttttagcactgaatagtattccattgcatggatgtaccacagttttctggtttgcttccaagttttggcaattattaatgaggctgcaatagacgtttgtgaaggtttttgtgtgggcataagttttcaactcgtgggtaaataccaagaagtatgattgctggatcatatgtttagttttcgaagtaactgctaagccgtcttccaaagttggctgtatcattttgcattcccaccagcaatgaataagagctcctcttgatccacatcctcaccagcatttggtgttactagtgttttggatttttgccattctaatagatgtgtagtagtatctcactgctgcttcaatttgcaattccttaatgacatatgacat

SEQ ID NO: 45197 - DNA, 1122 bp, Homo sapiens
ctttttgatattaaccctgcaactttgctgtaatcacttagtagttccagtggtcttttgttgtttctttgagattttctccatagaatactaggtcatctgtgaacagttttctttcttccttctcaatctgtgtatcttttattttattttcttgtcttactgcattagctaggactatcagtaccatgtagaatagcagtagtgggaacatccttgccctgttcttaatcttaagggttaaccatgtattttctcaccattgattatgatgttagccagaggggttttgttcttccatttgctggagatagtatcactttggaagaaaataatattagctctccttcccttcttttattacactcttcttttccatctacctacctttgcatctgcactttatattgttaagattggtaacattctgttgtataactataattaagctttgcacacattttctacagattgattctcaaagatgaaaatcattctatacaagttgagtatcccatatccgaaatgcttggaaccagaaatgttttggattttttattggttttttcatcctttttttttttcttgagatggggtcttgctgtattgtccaggctgctctcaaactcctggccatattttggttttaatatttttaagacagcatcatccaggctggagtgcattggtgtgatcatagctaactgcaaccttgaactcttgagctaaagcaatactcccacgtcagcctcccgagtaactaggactactgggatggcacacaccaccatgcccagttaatttttgttgttgttattgttgttgttgttgttgttgttgttgacacagagtttcactgtgttgcccaggctgctctcaaactcctgacctcaagtgatcccccggccttggccttccaaagtgctgtgattacaagtgtgagccattgtggctagccatgtgtctttatataaacaacatatagttggttcttgttttttgttcactccgatagtctctgtcatttaatttgtgtattgagaccattctcatttaaagtgattattcatataactgagataatatcaactgtatttataactgttttctattcattgaccc

SEQ ID NO: 45198 - DNA, 1030 bp, Homo sapiens
agtcattcaagtatgcattgcatgaatgcactttaataaaccaagcctactcattctcatacttctgttttatcctctaaagataaattttctcccaatgctggttttagtgaggaatgaaattttttgtgccaagagtggaaaggaagacctttctatttttctagaaactcagattttactttttcttcaaacatctaatttcaccgcttttcaacaaggacatctgcgatttggtggtgtatctagatgatatctacaatgcttcacatccaagaaaatcagaccatcccaatccccagcaagcactgaccaactgtgctcacccggcctcagccctgccatggtgtgcagagttggctgaggccccgtgtggcccgccctggctgtcttgtggacccccctcactcccttcctcaggaagccatgaccctctgggatgcccagaggtgtctttgacacacgtctcaggtgtcttttccatttgtcaattcaccatttatttcatcttttttttggggagtggggacagggtcttgccctgtcacccaggctggagtgcagtggcataatcatagctcaaacactcattactgtgttaaggagtctatatactactactgtgctacagaaaaagcacagacctaaatatgcaatatggggaatgtttgagggactgagggccggctcagctgtggcgatgtaactacctatgcatctggaaaaatatcccaacaaaaatacttcagttaggtggtaatatgcaggcaagttttaaaacgtacttcttattgttataatttttctttgtacaataagtggaaattataaaaatcttaggaacatgtatataaactcccaagtaaggcaaaaatcacgaggcccctcatgttgtcctctgcacgtggaggagcagaggagtcagagagggcagagccgcctctgaggtgggctttccttctcttgggcctaggcactgtggttggcgtggacgagagcactgctttctcatggcctgtgtgtgacatgt

SEQ ID NO: 45199 - DNA, 1066 bp, Homo sapiens
ttgattcttcctatgcatgaacatggaatgtttttccatttgtgtcctgtcttatttccttgagcagtggtttgtagttctccttgaagaggtccttcacatcccttgtaagttgtattcctagggattttattctctttgtagcaattgtgaatgggagttcactcatgatttggatctctgtttgtttattgttggtgtataggaatgcttgtgatttttgcatattgattttgtgtcctgagactttgctgaagttgcaaaattatcagctttaggagattttgcgctgagacaatgggattttacaaatatacaattatgtcatctggaaacagagacaatttgaattcctctcttcctatttaaataccctttatttctttctcttgcctgattgccctggccagaacttccaatactatgttcaataggagtggtgagagaaggcatccttgtcttatgcccgttttcaatgagaatgcttccagcttttgcccattcagtatgatattggctgtgggtttgtcataaattgttcttattattttgagatacgttccatcaatacctagtttagtgagagtttttagcatgaagtggtgttgaattacatcaaaggccttttctgcatctatctagataatcatgtggcttttgtgtcattggttctgtttatgtgatggattacatttattaatttgtgtatgttgaaatagccttgcatcccagggatgaagcagatttgatcgtggtggataagctttttgatgtgctgccggattcggtttgccagtattttattgaggattttcacatagatgttcatcagggatattggcctgaaattttctttttttgttgtgtctctgccatgttttggtatcaggatgatgctggcctcataaaatgagttaggaaagagtctctctttttctgttgtttgaattagtttcagaaggaatggtaccagcttctctttgtacctctggtagaattcagctgtcaatccatctggtcctgcactttttttggctggtaggctattaattactgcctcaatttc

SEQ ID NO: 45200 - DNA, 1056 bp, Homo sapiens
acatgtactgatacatgttacaacatggatgagcctcagaaacatttgccaaatgaaaaaagccagaccctaacaggcacatggtgtatgattctgtttgtataaacatccagaagaggcaaatctgtacagacaatctgcttctatagaagcagattttggctgccaggacctgacggtggggagtgcctgcttaatggggaggggtttcctttggctgtattgaaaattagaactagatagaaatattgtatgcccaacactgtgaaagtactaaatgccactggattatacactttaaaattatttatttatttatttatttatttatttatttatttttttgagacagagtcttgctctgacgcccaagctggagtgcaatggcacaatctcggctcattgcaacctctgcttcccaggttcaagctattctcctgcctcagccttctgagtagctgggattacaggcacccaccaccacacttggctaatatatatatatttttttcagtagagacgggatttcaccatgttagccaggctggtcttgaactcctgacctcaagtgatccgcccacttgggctcccaaagtgctggaattacaggcatgagccactgcgcccagccactaaaatgatttaaatggagagtgatatgttgtgaattttatctcaataaaaggataaatataaataaatacgtaggagactttataattcaccaattaaggtaacgacagggaaaaaagtctttaggcaatacacaatctacttttaaaaagatatttggggcctggcgcggtggcttatgcctgtaatctcagcactttaggaagccgaggcgggcggatcacctgaggtcaagatcatcctggccaacatgatgaaactccgtctctactaaaaatacaaaattagccgggtgtggtggtgtacgcctgtgatcccagctacttgaggggctgaggcaggagaatcgcttgaccctgggaggcagaggttgcagtgagcctagatcttcccattgcactccagcctgggcaacaagagtgg

SEQ ID NO: 45201 - DNA, 1050 bp, Homo sapiens
agcagcagaagatatagtggcaagtgagcagtctctaggccaaaaacttgtgatctggggaacagatgtaaatgtggcagcatgcaaagaaaactttcaggtgagctacatgtattaaaattcttactttgggctctgaaaatgttgggagaccgtgtttataatctatatctaagtagccataatgactagaagggccacctgtggtggctcacacctataatcccagtactttgggaggccaaggtgggaggatcacttgaggccaggagtttgatagcagcctgaccaatatagtgagactccatctccaaattaaattttagaaaagaaaaaggaagaaaaatattatttatttctgtctcctgatagtgacatactcataactttgtgtgtttttagtagttgcctgttcccaaatgctatatgcctaatacagttttctctccacttaaagagatttcttcagcgttttattgaccctctggctaaagaagaagaaaatgttggcatagatattactgaacctctatacatgcaacgacttggggaggtaatcaaatactctttaaattcaagttacgtgttttaaaatagttaaattagcaaaatataacttgttcatttttattttctagattaatgttattggtgagccatttttaaatgtgaactgtgaacacatcaaatcatttgacaaaaatttgtacagacaactcatctcttacccacaggtaagaatttagctttgaccttgatgaattttagtaacagtctagaaagaatgtttccagataacagaaattcttcagtaatgaagatagtatgcgcaaacactttaagaaactgagtatcatctcctttggcccggtgtggtggctcacacctataatcccagcactttaggacgccgaggcaaatggatcacttgaggtcggaagtttgagaccagcctgggcaacaaagtgaaaccccatctgtactaaaaaatacaaaaattagccagacatggtggtgcatgcctgtagtcccagctactcgggagtctga

SEQ ID NO: 45202 - DNA, 1465 bp, Homo sapiens
gagggtcatttaagagacggtggagctcaccctttccagggccagcccgacgtggtgcctcgctctgaagtgcacctgttgcctacgctggttgctgagccactcggaggaagatatgggaaggtaaaagtgcatctcctggttgtgccctcaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaaggtaacagtggattttaaactaggggttgggatttacaattctttgggatcaaatagtataaacatccactccgccactcgagccatccgccataaaggacagagttgtggcctgttagagcaagtgctggcaacctgacttgccattggttgagaagaatcatagcattgtctatcctcatctctggtctaaacttaggtttctaaacagaagaggccacacagtgtcagaatagggacttgcatggccaccattctggtgtaatgataggtgctgatgaactggtcagtgataacttaaagcatatcaagcactttcacgagcctttttataccttcctgtgatttcttaattgtagttctttataagagagaaaagtacctctaaagtttaaactacatctcagttaactgtgcagaaaatgaatgtttagacatgtctctgattatttagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggtgagtcgccttctccaccgtgaacatggacgtgtttaaaatatgtggacccttgaaagacagggtctgtggaactgtgctgtgctaccttggttctaacttggggagattgataagtgctttccacatcatatttcagctaaatctcaacatgtcttctacagggtgtcacgttttgtctttattgctgtactagccttgaatttgtcctaaagctcttgcaaggtgcctg

SEQ ID NO: 45203 - DNA, 1034 bp, Homo sapiens
gctgggattacaggcgtgagccaccgcgcctagcaatatactattttttataactgtttattacttcctcccatattgcaaaattgatctttccaaatgttgcaaaagggggaaatagttcatttatgtaggtagtacacacactttatatgtttaagtacttacaagcatagtgaatttaagatcaaagacctggtttcaaatagaggcaacactacacagtaatttggaaactgaaaaagtcatccagtttctgtaagcttccttttgcttgtaaaaaacagaatgagctgtcttttaggttcacttttcagcatcctggtacatgagctgaagtgcatgatggcacatttaggttattcaagcattgtgatattaagaaggttcctggtgctttgatgagctttgcatcctaactgagctcctaaaaattctaagatgaaagttacagacattatgtaatttttttgtgtgtcatagtcttgggggttgttaatgaagaaataagactgtgtcatctgtatgtgaaattgatacaacttacctttgcagcattctcccagcaatccttatgagccccattgtgccccatgtgagcacttttcccagacaggcctgattctccctatgagtgctcacagccttctcctctccccacatgccacattccttccctctgccacgccatgcccgtctctgttcttcagagctacgttagatgccaccctctccaagaattcttcccaagcatctcccagttggaatatgttcacccaccactgcacgctgcacgttgatgtcttcacctgcgatttctgtggtctgtctgtgtagtctctaccacttgatgagctccggggcccaggaccatatctgagttccgtttacttaatggaagcctaagtgttcaaaattcacccacaaaactaaagttgtcaccaaggaggtttgcttttgcttttgtttttctacctacaataggcttatgtagacatgaggaagattggcagtagccggggaatggtttctgcata

SEQ ID NO: 45204 - DNA, 1520 bp, Homo sapiens
agaagaattagctgaagcattgaaaaagcttattttatctaagggcaaaacaccagctctaaaataccagcaactttttgaagatattcggggacaatctgacatagtaagtgtttatatgtattttttgtttgatagagctttctctttttccttaatattgcttttgggtttttttcctttatttattaaataataaatatagagaagaatgaagaaaaggaagatgaaccataagccatcatcaagaaataatcacaattaaaatttttggctgggtgcagtagctcacgcctgtaatctcatttgggacgctgaggtgggcagatcacttgcagccaggagtttgaaaccagcctgaccaatatggtgaaaccctgtctctattaaaaatacaaaaattagctggatgtggtgataagcacctgaaatcctagctactcaggaggcttaggcaggagaattgcttgaacctgggaggcggaggttgcagtaagctgagatcccaccattgctctccagcctgggcaccagagcggaactccatctcaaaaaaaaaaaaaaagaaaaaattgttatgcccctttcatagttgttataagtttgctttaggtatgaaatatttgggtgtccttttgtaaataagtaaggtagttgtttagtgaaaagaactatgcagtctttcagtgctggtccactttccatcgctgtgttgtgactgagagggcagagttgatagttacaacgtggactatacagatgccaagtctaccacatggaccatctggctactccactcctgatttagagcataaggcatgtgtacagccaccaaaaagagaaagattctgggtggtactttaacattataattattgtgtttctaacaggtaaaggagggacttgacgtgtacaatatttattttctttctcttccccacaggcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtct

SEQ ID NO: 45205 - DNA, 1031 bp, Homo sapiens
tagacattagaccatttcagaaatgttaaaaacgttaagctttagtttacatttaaaaatgttaacccgtgtgatctgcctttttcttttcttttctttttttttttttttttgagtcagaggctcaccctgttgcccagttggaatgcagtggtgtgatctcggctcactgcaacctccacctcccaggttcaagtgattctcctgcctcagcctcccaagtagctgggattacaggcgcgtgccaccaggcccggctaatttttgtatttttagtagagacggggttttgtcatgttggccagactggtctcgaactcctgacctcaggtgatccgcccacttcggcctcccagagtgctggaattacaggtgtgagccaccgcgctcggcctgatctgccttttcctagtcttcgttgaaacaagagtatagagcagtgtgatttaatagtttatgccatcattgcataataaaatgaattttcaaatctatatgtactgaaatggaaggctttgaatatatgttgtaattgttgctttagagtaatacctcaggatacattctgcatacattttaattaagtggtgtcttttacatctttattacatataggtgtcataggttttaagatctttagcagttctagtgttggggtagtatacatacttgggtcagctagctagtaaggcaaggattgttttaaaagtggaattttagtgttatgactttactgtgcttgctgaaatctaatctgtgctcgttaacggggccatatctttataacagttgtgcttaggacctcttatagatttttgaaaatttagtaataaaataatgcattttaatttaatacttttcattttccttttgtgggttgcattattaaacacaattttttcataacactatacatgagtgtatgttaatattttgaaaagaccaaaggttagatgatattaatggcaaatactttttgttaatcacttttagttgttttggaagttgaatataaattataaagattactg

SEQ ID NO: 45206 - DNA, 1094 bp, Homo sapiens
cctcccgagtagctgcgaacacaggcacgcattgccacacctggctaatttttaaattatttgtagagacagggtctccgtatgttatccagtgtagtctgaactcctggactcaagtgaccctcctgccctggcctgaggttaggattacaggtttgagccactgtgcctggccagacggagacttctaagcagaaacatttttggccatcccatctggtcttcttattttgcagatgagaaaactgaggctcaaacaagtaaaaggctatacataggtggttactagtacaggcaagactagaatccaggtcttttacccttagtctgatgcgctctccattatgaagaactctgaatttggaatatttctcagaacatgaatcttaattactccctttcacacttcccttcttagcacaatccttgtttcagactcttagatccttcttatggatgaaaggggaacgtagccctcaccagctaggttctccttttccaagagacagagttacccatgcaattcaagagtatttcacaggacagaggttaagaagctactctcgggaatagaaatttgatactgtttagtactcatgattcaaaattttattagattccagcattaataataacaattagtttagatagaaaagtatgtgcaggccgggtggggtggctcacacctgtaatcccagcactttgggaggccgaggtgggcggattacctgaggtcgggaggttgagaccagctggaccaacatggagaaaccatgtctctactaaaaatacaaaattatccgggcgtggtggcacatgcctgtaattccagctactcggaaggctgaggcaggagaatctcttgaacccgggaggcagaggttgtggtgagccgagagcacgccattgcattccagcctgggtaagaagagtgagactccatctcagaaaaaaaaagaaaaaaagcgtgtgcaatagttttaaaaaaatacaatagttttagttttacagaaaagttgtgaagatagtacagaaagtttccatgcacctcacattcagttttccctgtcaatttcctttttttttctttcggg

SEQ ID NO: 45207 - DNA, 1016 bp, Homo sapiens
gtctctaccaaaaatacaaaaaactagccgggcgtggtgacaggcacctgtagtcctggctactggggagactgaagcagtagaatggcatgaacccgggaggcggagcttgcagtgagctgagattgtgccactgcactccagcccgagtgacagagcgagactccatctccaaaaaaaaaaaaaaaaaaaaataaggcttgtcaagagtagcttgaggctgggtgcagtggcttccacctgtagtcccagcactttgggaggtcgaggtgggtggattactagagcctaggagttcaagaccagcctgggcaatacaagaaaatcccatctctacaaaaaatgcaaaaattagctgggtgtggtgatgtgcacctgcagtcccagctacttgggaggctgaggtagagtatgggttgagcctgggaggttgaggctgcagtgagctgtgatcgtgtcactgcactcctgcctgggcgacagagcaagacactgtgtcaaaaaaaaaattaatttgaacaatgcttgctaatgttttgaagtacattatctgtacattgtggaatggttaaatctagctaattaccaaatacattatctcacatagttatcatttttgtggtgagaatacttaatagctactgagtatttttcaagaatacagtatgttgttaactaatcaccatgctatacagtagtgctcttaaacttgttcctcctgactgtaattacgtatcctttgtctaacatcttcccaatccccacccccgtaaccccaaccatcctaacctctggtaaccaccatctcctgtctacttctgtgagatcaattttgactccatatatgagtgagataatatgtatttgtctttctgtgcctgtgttatttcagttaacataatgttctccaggttcatccatgttgttggaaatgagagaatttccttcttttttatgattggaacagtgtcccactgtatacgtataccacatgttctttatccatttgtctgtgt

SEQ ID NO: 45208 - DNA, 1046 bp, Homo sapiens
gtaccagctactcgggaggctgaggcaggagaatcgtgtgaacctgggagtcgggagattgcagtgagccttgattgcgccactgccctccagcctgggcaacagagcgagactgtctcaaaaaaacggcagggcatggtggctcatgcctgtaatcccagcactttgggaggctgaggctggcggatcatgaggttaggagtttgagaacagcctgaccaacatggtgaaaccccgtctctactaaaaatacaaaaattagccaggcgtggtggcacatgcctgtaatcccagctactcaggaggctgaggcaggagaatcacgtgaacctgggaggtggaggctgcagtgagccgagattgcgccactgcacttcagcctgggtgacagagctagactccgtttcaaaaaaaaaaattagccaggcatggtgccatatgcctataattccacttgggaggctgaggcaggataattgcttgaactcaggaggtggaggttacagtgagccaagatcctgcgactgtactccaacctgggcaacagagtgagtgagactctgtctaaaaagaaaaacaaaaataattttatctgatataagtgaagcaattcttgggctttctctctctctgtctctctttttttttttttttgagacaaggtctccctatctaggctagagtgcagtggcgtgaacatggctcactgcagccttgaactattgagatcagtgattttcctacctcagcctcctgtgtagctgaccacagatgcatgccactatgccttgctaattttttatattttttgtagagatggggtctcaacatgttgctcaggatgctttcaaactcctgggctcaaacaattttccctccttggcctttcagaatgctgggattatagggtcttgttctctcttgatttccatttgcatggcatatctttttccattccttcaccttcagtctacatgtgtccgtacaggtgaggtgagtcttttattggcagcatatagttgggtcttgttttttttaaccattca

SEQ ID NO: 45209 - DNA, 1384 bp, Homo sapiens
ttaaaagtcaattgtagtttgtctttggatccatactgatgtatacatgagagttttttttagaattatgatcaaaatatatgtgctgctattaggtctcccccaccccccctttttttttaacttatacacaattaatataattcatgtagtttaaaatgactttatataatattttaaattatgtgacatagtttgcctgaatgtataccaattggcttcttaagtttttgcactgccaaataaacatttttgttcagattgcttttccaacccccctcccttcatttatttattgctgtgtaacaaattacatcaaaactttgtggcttcaaacgatgattgatttttttcttataatatgggagttgactgggtggttcttctgctggtttcacttagagtcactcatgtggttgcatcagctggtgaagggataggcttgttgcccgggacgccttgctccccctccctgcagcctctccaggtggccagttaggacttcctcacatcccggtggtgtcagggtgttcagaattcttacatgatggttggcttccaaaagaacgaaagcagaagttagcattcctcttacaaggtgagtgccagaactggccttagcattgctgcttccctatttattctttttttttttttttttttttttttggaggtggagtctcactctgtcgccgaggctgtagtgcagtggcacaatctcagctcactgctacttctgcctcccgggttcaagcaattctcatgtctcagcctccagagtagctgggactacaggtgtgcaccaccatgcccagctaatttttttttggtatttttagtagagacggggtttcaccatattggacaggctggtcacaaactcctaacctcaggtgatatacccaccttggcctcccaaagtgctgggattacaggcatgagccaccgcgccctgccactgctcccctcttctactgataaaacaggtaggaaggtttgcgcagcttcaaggggaggaggggtgtgcctgggcctggagggtggaggatggctcacagcactctgcaggcattctgcgccctgtttttttgtcctgaggggaaatttcacaaagtagcatttaagtcaaatcacaatacatatttaaaaattattgtttttttttttttgtgtgtgtgtgtgtgtgtgtgtgtgtgtatatgtatgtatgctttttttttttttttttttttgagactgggcccgggttcaagtgattctcctgcctcagcctcgcaggagctggaattacaggtacatgccactatgccagagctactcaggaggctgaggcaggagaatcacttaaactcatgaggcggaggttgcagtgagctgagatcat

SEQ ID NO: 45210 - DNA, 1026 bp, Homo sapiens
tgggtgggggcgacagagtcttttgctcttttgcccaggctggagtgcagtggcaacctctgctcactgcaacctccacctcccggcttcaagcagttctgcctcagcctcccaagtagctaggatcacaggagcgcaccaccaccccctgctaatttttgtatttttagtagagatggggtttcccctgttggctaggctggcctcaaactccgatctcaagtgatccacccgcctcggcctcccaaagtgttgggattacaggcatgagccaccacgtctggctataattcacttcttgtgtgtgacttcctactaatttgtaatcatgaaagttgggcacatacccagtatgctcactatttctctgcagggcctgatacagtggctgctacaacactgatactctgcatttgttgaatgagtaatttaaattttaaattatcatctagaatcatttagagatttatttagactttgataaatttagataacccacacacagtttattcctagagttcttgatacattgttacagtaagtttggtcctggcaacagcaataacacttactgtaataacttaattcttcatacgaggttgcttcacttttattattaagcagaaaatacccaaagtaaaattgagctatttgggactcctttcagaatactgtgtaggctgaagcattgttgtatcagaagtgctctgttatttgaatgcataaggtattcaacaaacaaatgcttattaaattaaatggtattcagcatacagctactgtcaccgtgctaggagttcacatttttcatatgcgtggcagttagcactggtgcatgtttccttcagcctcagaaatggaggtgtctgcgtgttgcccagatctaccttgaaaactctagttgcttcctaacacctaggttgtatagtgggacttgattatgttttataaagccaagtctggtctgtgaggactgaaaggatttcctcatcttaactctaatttggcctgcaatgtctggggaaa

SEQ ID NO: 45211 - DNA, 1060 bp, Homo sapiens
cctcagggatctagaactagaaataccatttgacccagccatcccattattgggtatatacccaaaggactataaatcatgcaactctttatgcttcagattgcagttatgtaatgtaaaaagcatgagtattggaatgaaagagaactaggctcaaactttgactttgatcattagttttgtgagcctctgaatttgaatgtgtatagcagtgataagaatacttgctttaacgtaatacatgtacagcagagggttcaagagagtatcagtaagtggtacctcttgccaatattctcctaatatttatcattattttaagcccctgaccatgtataatttgattttaaacatttatattttgatatatttctatttggtacagtttctaaaattttcaccatttgaacaatgttcttttaaaaaaacttaatataaaagacctgtaccatgacttaatatccaggaaaaatattactaataagtttatgaattcatatttggcctaatctttgtcacttgtagacccccaaaaaatgacctcctgaaactgaagaatttagataaaatttagttgcagaaagaattgcattcagaatagtcactctcagtaaaatccacatttaactacttcgtgttatatcaagtagggcttataataagatattggcaataagaaaacaatattaaaaaatattaagaaaaggctaacagtattttctggaaagaatagctggttgacctttgcagaggaaagtctatgtggagactgtaattttaacattatctccatgaatgatttaaatataattaattttcatattagatttcctgttgccaagttgctcttttattttgactatggcatttgcttcttgaaaaaaaaatactatattaatatatagaaatagttagattctactctaaagctgagatgaaaatagtaaacctggaggcggagtagcaggactctcctgacctgggccaggaggacagcactgatgtgtgtgtccccaaggccttggacttatctcagtctcacctgtcatctcactcttat

SEQ ID NO: 45212 - DNA, 1028 bp, Homo sapiens
ctctgctactgtagcagaaagctgtgcggggagagggaaggaggtggatatgggacttatcgtagccatcgagacaagagatggggccgccagcctaggagaagtagcggggatgcagtgcaggcctggcgtgagtcctggagatgcagtgagcttgctaatgagtgatgcatgaggaatcaaggtgacttcttgatgtaggtggatggtggcaacatgtgtggccatggagaagacaggaggtgaaacagaggggctggaggaggagatgcaagattccatgttagaccctagagatgtccaggagagctccaactgtggtgccaggcagctggttggatctgtgtgtatggcacccagggaatggcctgggctagaggcagaaatgtggattcgttaggctctgatgatgtgcagcctgctgtactgtggtacgctaaatgatcatgaagttatggtgggaagccttgaaaataatcagtaggatcttactactttagaatctgcgcttccttttctcaattatccataaacagtctatgaagaatttctgtttatgacaggggtcagcaaacaaggcacagggccacctccagccctctgcctgcttttgtatgccctgaacactaataatagtttttctttttattccttttttttttttttgagacagggtcttgttctgttgcccaggctggagtgcagtggcgggatctcggctcactgcaacctctgcctcccaggttcaagcagttctcttgccttagcctcttgagtagctgggactacaggcacccggaaccatgcctggctaatttccttgtatttttagtagaaatagggtttcaccatgttggtcagagttgtttcaaactcctgacctcaaatgatctgcccgcctcggcctcccaaagtgctgggtttacaggcatgagccaccacgcccagccaagaatggtttttacattttttaattgttgggagaaaaagtgagaagaataaggccagacatgatggctcatgcctgt

SEQ ID NO: 45213 - DNA, 1028 bp, Homo sapiens
ataatttaggggcaatggtaggaagcatcagtagaaatgttattcattaaagacagttcaaataaaaatgaatgttacttttaaggaacttatcttttactaagcatactttataatatccatatagtaaccacaatacatttgtcatacccaacaaaattaacagtaagcaattcacatcatctaatgtgtaaccatagtacattctttcttattagcctctttactaatcttcctcatcatccatcttctttttcatacgccaacttgaagaaattggacctgctgccccgtcgattgtcccacattgaattcatttgctgctttctcaagttgctaacttgttcctgtattccctaaatttctgcaaactagaggttagactcaaaggctcaaataaattcctgttgcatcacatcagagggacacaatgtctgcaaaattggctcgcttttagttatggaaaggacattatttctaaaagcttggtaggtcagtccaaattatacagagcggctgataggtccaaggcatgtggggcacacactgcaaaggcaacaggtgctactcttactacagctgccttctgcttgctgaaagagcttgagtgtccactccgggccatactttgggagctctgttcctcagcagggctggaatgcctccttgatggctgtggggctggatcccacccgctcgccttgcaccaccaggagctgctgctctgcctccccctggctataattccctgcctgacttgaggagtggtggtgatgatgatgatgatgatgaggttgtgtttcccttctgcactgttaatttggagaatgttccaggtgaggaaaatgcatcaccttcagaggataccagatgttacccagaccactgtcctggtattgagggtactcagagtgtacctagaagtaggtgtggccattagggagcacagaaggagtgttaccctttttcttttgggaggctgtgttccttccaccacatcagaaccaaagaagaaactggcctcctcc

SEQ ID NO: 45214 - DNA, 1022 bp, Homo sapiens
ctgccttggatgcagcactgctgaagacagaggtggtattggtcaatgggagttcagaccagtttttcttctacagggatctcccggagttcagaccagtctttcttctacagggatctccccactcctgcctgacctcttcagctttggtcccagtcatacagctctggggttctcctccccagtccaacagttttgcacaggatctttcaagaagattcaagcttggccaccttccatgtctcccatggaaaaactcacccatgcatgcagctgggtcgcttccctttttcctagacctggctgttccaaccaggccctcccattgagtctcaggcagtccggagggaagctgcagtctctgtacttctcatgctttgccaggttctccccaggagtcttctgaatcatctgaggacaaggacagggctggtgcccgagtttctttcttttttaaaaatgtgtttagaattggagtctcgctatgttgtcgaggctggtcttgaactcctggcctcaatcaagcctctcaggcaggtgtggttataggcatgaaccaccccacctgacatatttactgacatattttaccatattttatcgaattctagattcactattgtttcttgtattccatacttccccttggggtctacttttcttggtaaaatatgctttaataattttctttgcaagagtctgtgagagatcagcaaatattcatccgaggacagggtctcactctgttgcccaagctaactgcggtggtatgaccacagctcactgcagtctccacctcctgggctcaagggatcctcccacctcaacctcctaaggagctgggactacaggcatgtaccacaaagtccggctaattttttatttttcgtagagacaaggtttcactgtgttgcccagggtggtcttgaactcctgacctccagtgatctgcctgcctcagcctcccaaagtgctgggattacaggcatgagccactgagcccagcctaagacccatttttg

SEQ ID NO: 45215 - DNA, 1022 bp, Homo sapiens
gggcggatcacttgaggtcaggagttcgagaccaacctagccaacatagtgaaaccctacctctactaaaaatacaaaaaattagccaggcgtggtggtgcgtgcctgtagtcccagctactcaggaggctgaggcaggagaattgcttgaacactccagcttggcgacagagcaagactgaatcaaaaaaaaaaaaaaaaaagacatacatgtggccaacaagcatatgaaaacatgctcaagatcattaatgattagagaaatgcaaatcaaaaccacaacaaaataccatctcacagcaggcagaatggctatcatcaaaaagtcaaaaaaggtcgttaagggttgggccatcaggaacttgcgcgtccatctcagggagacctggccttcagagatgacagcattcagccccaggaggagcctgcaattcatcctcggtcttcccaacttgtgccgcccagggagatacaggacagtaaggaactaaacagaacctgctgtctgaatgggggaacctgcatgctggggtccttctgtgcctgccccctctccttctatggacggaactgtgagcatgatgtgtgcaaagagaactgtgggtctgtgccccatgacacctggctgcccaagaagtgttccatttgtaaatgctggcacggccagctccgctgctttcctcagccatttatctacctggctgtgatggccttgtgatgtatggcatctcatagcttccaggactccagaactaccagcatctacactgccacttctatgccagctggcatctgcttttctatacaaagttactattaatcgacactgacctatttacagaagtataattttagatatcatgcaaatttcatgaccagtaaaggctgctgctacaatgtcctaacagaaagatgaccatttgttagttgccttaaaataatgaatacatttccaaaatagtctctaacatttccttatagtaccaactacttcctacctctttgccctgccctcccccaaa

SEQ ID NO: 45216 - DNA, 1046 bp, Homo sapiens
agatggggtcttgctatgttacccaggctggtcttaaactcttggcctcaagtgatcctcccatctcagcctcctagagtgcagggattgcaggcatgagccaccacgcccagtccatttattccttcttattgctgaatagaattccaatgtatggatgtaccaaaatttgctcaaccatgcaacaattgaagggcatttggattatttgtggcattttgctgttacaaataaagcaacagtgcaggtgcagtggctcacacctgtaatcccagcactttgggaagctgaggtaagaagattgcctgaagccagaggttgagactagcctgggtaacatagcaaggcagaaaataaaaaaataaaatgaaatttcaaaagtaaacaaagctgctgtgaacatttgtgtataaaagacataagatttctctgggattaaatgcccaagcattaaatataaaggaacatgggtagttgtgttagaacaactagagattttatcgtacatgacatgaagactaaactgagtaggtaaagcctgctaaagacagcttacaccagtaatctaaaccatgactgggttctttgatgtttctaagggttgagatttcaggtcctacttatctgtttcataagttgtgaaatttaagtagatacctacacattatgaaatcagcaagaaagggacacgaggaatgtctcaaaattgaattgaattcaaattagttcagaagtacatgttgactcttgtagtttctaaagattatcagtttttctcccttaggtgtttcaaggcaattatagttaatataatcaatagttcatataatcatttaaggctaagatcataaagtttagcatgtaaaaaggtttttaaattcctggcaggatgtattactatgcacatgtaattttattgaggaatccttgggtagattttgatagtatacacttgtagaaatctatttcttttcttgcctgagacttaactacttaactactcttctatttagagcacccaattctacttaaaagagaaggataaa

SEQ ID NO: 45217 - DNA, 1024 bp, Homo sapiens
cactatcccacttccataaacaccaattctcatgatgctggttatttttacctggggtagtaccaccttcacaagggcatttggaagatgctggttgttagaatgacatttggaattctggcatttagtactcagttacttaatgttaggtcatgtacaggatggtcttgcacaacaaagaattattccacccacaatgtcattataccccctgttgacaaataatcaccttactttgctattggtaacacttgtttggggatggggagatctgaccttactgaatcatgatgacactttttactatttacaatgatcagatgaacatattaggacatagccctatccttgaggaccatttgagtgtgtaatggagtcttattctttgttagccatcacctcttgtttttatacttaactgtgaaaaaagtctcatctttctatgttgttgcttctaatttgctgaagactgaaaccaaataaccaaactgataaaaattatttaaggaaaaaatcactctctgaatgaatgagatccttttccgtggaatggagctagtgacccttgtttcagtttctcagatgccatgtgacttcaatgtggctgacagctagagcctaatctagtccttgatagaaaggaaatgtttagatttctataattcaccacataaagcagtgtcttggctaacagaagtaataacttttatgtctatagcagtatttctacatatgtcctgtcactgctgtgaattaagttagtaaaacaccactcactaactcattcattcattctttattttttagacagagtcttgctctgttgcccaggctggagtgcaatggcgcattctcagctcactgcaacctccgcctcccaggttcaagcgattcttctgcctgagcctcccgagtagctgggattagaggcacctgccaccgtgcccagctaatttttgtatttttttttagtagagatggggtttcaccatgttggtcaggctgatcttgaactcctgacctc

SEQ ID NO: 45218 - DNA, 1065 bp, Homo sapiens
tacttctcatatgattcagagctgctttctagactgccagataaggttgagcctaacaattccataatttctgtttttctcatatatgaatattatgctctacatcgtctcatcagagacgatgtgatccttatattaaatgtagacagcctcatttgagtacttgaataacgagaggaaattcactgtttatcatgcaatttatgctgattaactttttctagttacattaacactttcacaaagagaaagttaactttttaatttgtgtttttggtttatttcaaaaactttccagaattggagttggtgattcatgtttttttgcctctagagggagtaatgacactagggaataatgaaaccaagaaagactgatgagatttcaagtgtattaattttttttgctatcaaattttgatcagattacagtgggaaatcaacttttttttaatgaagaaaatgtatccgtatgtaggacctttttaatgagaggagacagtactaaaaattgagagaaatcacagttgcaaagaaaattaacttttttttgttaaggaacttttagaatgttacaacaacctgaatttgcaaatggtttgggatcccaagtgtgtcactgtctgctgtttgaaactcaggctgcatttttctcatatgaaggacagttaatttcccatccagggagattgtactcttagataatatttatatcatcctaaacagcatggattcaatacaaatacaacttatctcaaatatttccatgtaagaggtgatgctaattgtttcctgtatctagtgaaatgttttcctaggtcccttattacctcaatcttctattccttttttctatttggagatgattccaagacatgcatttcttgctaagaactgagtaatttagaaaaatatctttttgtgagaggctctttggaggtaaggtatataccttactcttgaaattgctgttgaaacccaaggactaatttttatttatttatttatttatttatttattttatttatttatttatggagatagggtttctctctgtcacgcag

SEQ ID NO: 45219 - DNA, 1064 bp, Homo sapiens
tcactttcacaagtgttctcaaatttcttaagcattttatttcataccagaaagttacattcaccactctaatccataggacaaaggatgaatgcgtaatcagttcactgtgattaaacatttgactgttgatattaatatattacacaaaggcaatacatgaatttgagaattattttttcctgacaattactggctgtgtgatatttggcaagttacttctctgagctttacttcctcatctgcaacctaggaattaacaataccaattacaaatcattgtgtgagaagaaaatacaacaacatagagcaagtattgtggttggcacgtaatgagaaaaagcaagcatgtggtaactggaggatcatgagctctggggtcaaaaaggcattggtggctcacgcctgtaaacccagcactttagaaggccaaggtggcaggacagcttgagcccaggagcttgagaccagcctgagcaacatagcaagaccctgcctctacaaaaattagccatgcatggtggcacatgcatgtagtcctagctacttaggcacctgagcaggaggactgcttgagccaaggagttgaaggttgcagcaaaccagtcatcatgccactgcactccagcctgtacaacagggcaagatcctgtgtctctttcttttttttttttttttttttttttgagacagggtctcactctgtcacccaggctggagtgcagtggcatgatcacagctcactgcagcctcgccctcccaggctcaagtagttctcccacctcagcctcctgggtagctggactgcaggtgcacgccaatatgcctagctaattttttgtatttttagtagagacagggtttcaccatgttgccaaggctgggatcctgtcacttaaaaaaaaaaaaaaaatgctggcgtggtggctcacgcctctaatcccagcactttgggaggccgaggcaggtggatcacgaggtcaggagttcgagaccagcctgaccaatgtgctgaaaccctgtctctactaaaatacaaaaatgagcgaggcatggtggcacac

SEQ ID NO: 45220 - DNA, 1543 bp, Homo sapiens
atcatgagttaattttcttttatcacttggtaattgtctgaactaagtggctaactgctcaggacatagcagatgcaccatcaagctgggcacttcaagctgtcttctagaaatgaatttctgtgctttttagcactgctttttgcttgggggtgggaaagggtggtctccagtaactgctaagatgacacctatactggctgctgtccgagcagccctagtgactgtcttgggggcaatcagttgcttaatggttaatacagaagtacctgagtaatactttgcaaaaggactttccccgacctgtgctgggagtgtctccctgtaaactttgccaacctcctggttgttttatcagtgagagcatcatttaagtgaaaatataaattaaggagacagggctcataggacgcacattaaaacacctgatcattttgagcacctgctgtgtgcaaggcactgttctaggccaacagtatagatatacattgcctcccatcttttaaggctgataatgaagagaagaacatggaagaggaagttgttgggttttttttttccagtcagaaatactgaaagatttcttacagctgtctggtttcctgatacttaaattgtgaaactttaagttcactccattatcatttctaaaatttattttgaataagttccctttcgggggagatacccatgtgtagagaatggtatggaaatctgccaatggagggattagaaattttgtcagtttaaagacttggaccttttgagatttttgttgttgttgttttgtttgttcttcttttctgagatgaaggctcactctgtcgcccagcctggagtgcagtggtgcaatctcagctcacggcaatctccgcctcctgggttcaagcaatcctccctgcctcagccttctgagtagttgggattacttacaagcatgtgccaccacacccagctaatttttgtatttcctgtagaaatggggtttcatcatgttggccaggctggtcttgaactcctgaccccaagtgatctgcccgtctcgtcctcacaaaatgctgggattacaggtgtgagccactgcgcctggcctttctggggtatatttggcttaagttagttggaagggctctctttattttttattctgcctcccactgaagagacagagttcgctcttgtcacccaggctggagtgctttggcgtgatcccagttcactgcacctccatctcctggattcaagtgattctcctgcctcagcctccctagtagctgtgattacaggcgcccgccaccatgcctggctaatttttgtatttttagtagagatgggtttcaccatgttggccagggtggtcttgaactcctgaccttaggtgagcccgcctcggcctcccaaaatgctgggattacaggtgtgagccaccgtgcctggccctgtcttgtaatttagaagagcaagtttaaatacttgggatgatgtattaaaaagcctcatccatgctgacaagagcagggcctgtagtagcctttgttgttta

SEQ ID NO: 45221 - DNA, 1048 bp, Homo sapiens
acctaatttagtaagagaggcattccccccaagctcctcacgtttatttatttatttatttagagacagagcctcgctctgttaaccaggttggagtgcagtggcgtgatctcggctccccgcaacctctgccttccgggttcaagcaattctccctacctcagcctcctgagttgctgggactacaggtgcccgccatcacccccagctaatttttgtatttttagtagagacggggttttgccatgttggccaggttaatctcaaactcctgaccttaggtgatccgcctgccttggcctcccaaagtgctggaattacaggcatgagccactgcacccggcctaaacttcatttaaatgatgaggaaataactgcaatggaatgagctggttggagaacgatgttactcacccgaacgctggctttatgcagtttcaacatccacaggtatcttctgattgatcgcattacagtcttgacctaatttctcctgataaggagctgaaaatcaagcaacagtacattagaactttgattcatgtgacgcctatcatgccatataaatgaaaattcagagtttagattaagaacagtaaagctttctctgttgtaccttaaaaggtacttccctcctcctcataataataagctacatgcttctggaagttttaccaagacttgagatcaggagggagcattctgacgctgagcacacctctgactttgcacatggtggtttcgaggggttgacagcagaagatctccagagtctagtaacagttctgtcttactgttcaaatttgccttttctacctcaatttctcctccattttaacagaaaacctactactactacttcatatgtatctaaaatatttcaaaatctttagtaatgggatataagcactcttagccatcagaataacttttaaggtcaggtgcagttgctcacacctgtaatgctagcactttgggaggccgaggcaggaagatcacttgagcgcagaagtttgagaccatcctaggcaacatagtgagacctcat

SEQ ID NO: 45222 - DNA, 1033 bp, Homo sapiens
taaaaattacaaggttaaaatacaatgaaatactcaaggaattgcgtgaaccatctcttttgtacagactgagatgactctcctggtgaccctgaactcgtaggggcagcaggtggaaatgtacattcactacttggtggaaagaagtctgaattggggaagtatttatacatatgtgaaattccattgtactagggtgtcctgtattttatctggtaaccctgggggcagtcctatgagctgcggggcacctgccctggagactgaggcagggagtcaaagcgacatgagattggggataggttttgcatgtccgtggaaagggcttgctgatgaatttgatttgaagattgagaaacagaggaatcaagggcgacttcttggttttaaacttcagcacctggtgccctttactgagatggagaagatgggaggggagtgggtttcaagtgtgttgtgatatggacaggtcttattgatggggtgtggtgggcgtccaaatggagatgtggaagtttgattctgagtgagctcaatatcgtcgtggtgtgttctaccacgtcccttctagccctttccgcgctttctcccatctagtgtttccctgctcaaatggaaggagagaggaacaacttagagcacagtgtgactggggcaagctaccttagagataatcatttaaacaccagctagactgctgcaagaaaagaaatgatggtaaaaataaatgtactccaaaggaatttgactaaagaatatttcaccgtgtaacacatttctgtgtgccccttttgcaatgtatcattaaggatgcattgctaggcataatgaaacaaaatgtttttcgtaatgaagtggttattttgcaatgaaagccagtcaaggaaagaaatcaggcttgaatactcctagtcacaacctttataaaatctaacgttatggttagactataccatgcctgcgcttaagtagtttttgaaattttaacccaaataagaaattcttggctgggcatggtggcttatgcctgtaa

SEQ ID NO: 45223 - DNA, 1048 bp, Homo sapiens
tttcataattaaatctatattttgtattatcaatatttaaccactagaagaattgatgatgctacttattaaaaatgacaagtgatgtaatagagttagtgggatgtctgcctgttgaaaccattttactaggtaagtatttttattacaaaggggttggatataaactggcctcatatccaaaaacctttttgcaaaaatcaaaactggatatatcctgtgttcgcttccttttccctgggcccctctgttaaaatcttttagcaaaaagattttaccaaataattcacattgaaatataaatagttttaaagtttgctatgttgctttctttccaaaggtattcagattttagtaggggacaaaagtgtcccctaagtcaagtgagtataagaattacctatattgtttgctacaaatgcaaatatccacagcctccttgtaaagtctcattcaggggctgcctactgcagggcccaagaatctatatttttaacaaatactctggtcattcttgggactagcaaatctagaaaacaccaacttgaataaaacgattaaagttgtgcttgctgaatttcaactacattaaaggtaccagtgctggaggagatttttgaggggttgaggagaaataattacacataaattattttattaatgaaatgattcagcaaagtgtaaacgcccgtaatgggcttggcagtgtcctggggctgaaggtactgagtagaataggacgtgagacaagtgctctacttgaaataagcacagacgtggaagaagggatgtgtagttttgtctggggattcggcacagtttttatggaggatgtggtctgtgaaatggctgatttgaaacatgaaggaggctgcttatgggatgggttattctgggaagcaagcaagtgcgagggcaccagaaggtatgaagggccttggagtactgggctttcttatggctgcgagagaggatgagttggaatgagatgagcagcttatgaaaccaggaagacaggttattgtggaggagtgacttgctaagctct

SEQ ID NO: 45224 - DNA, 1034 bp, Homo sapiens
ggatacactaacagcattttgtccaacttgtggagtggagggagtagggaaggggaggatagtgctaatgaactgtgacaggggctagcaagaaagaaagaaaaagagttccctaagtaagctcctactgggtgtcctccactcacatggagacagggccctgccttttaggcacttactcttccagtgtctattgcataatatgttcaggaaggatcccagattcaaagatttatagaattagagttaaaagggatagatatcttgtttgaccctgaaaaaattaaggaatatgcttgagatattcaatggcagaggctggaatagattttcccaaatctcctgatgtgaagttctgtgtttgtcaaacatgactgtgtaaaaagattaatttaaacttaatgacatgttgtattcatagaagttctttgggtttctgtggaaacctcctcttgctagcttaagcagaaatgggggatttattggaaggaagctgagatattgcaccaaactgcacaaaattgaatgaagagctgactaagcaaggctgcactgagaaggaaccagggtggtctgggctgtggtagcggcagcagcagcttgcagatctcccagcgctgatgctggctcgactcagacaggtctccactctctgctgtctgtctctggctcagacaggacactttgtgtggctgtttccttccacaaggcctcagtgggagcaagccagcctcccacaggcctctgagacagaccaccccattcctccctctcctgttaacctgcctttatttccttaattgcacttatcaccatgcagaagcctatgtgtttgttcccctgtggagatgtaaaaacactgatgcccaggcctaactcccagagactctgattgaactggtctgggctatggagccgggacatttgcatttttcttacaagctctaatgtgcagccaggattaagaatcattgccttctgcatcaacaggacaaatacaaaatgtgcagcaaaatatatgtttaagtgaatca

SEQ ID NO: 45225 - DNA, 1021 bp, Homo sapiens
gcctataaaaataatctctttgtttggcattgttaataaatagatgaaacatgcatttcaaaatacccattgtatggcaaagtggtaagagcccaggctgtagacttagcttatgacttagacttgagagcgcactcctgtgtgagtgagtcttagcctcacccctcccagctatgctgtgcgcgagtcttttaacctttctgagcctcagttttctcctctgtaaagtcatctggccgtatggtttcttcaaggattaaatgagatgctcaatatattataaatgtgtaatagaagaatactaaggtggaaatcattgtaaagtgtagctcatatcacttggaacatgtaaccactctcagtttttgtcaggagtatattgtattttctacatttctggtactttcatacagcataaggaattgcaagacctgttctgagtttgggttgctcatccccatgtcacatggaggacctctgttgaggtttctggtgggagagtgtctgaatgggggaccccaaacactttgtgagcagagatcagctgtgcctgagcagtgaggccatgctaattctccacgtggctttaattttttcatttacagtgcatacattcgatgttaaattatccatgacaatggtggaaagaaattaagcataaataaatggccatctatcgatcttcctgtcttggatgtcaccaccccacccacatccacctgctttttgtttccgtccttccttttcccaagagaagagagagagagagagagagagagaacgctggagcgagcagcgagggcaggggaactgcaggaacgcagtgggggggggacaggggattccctgtgccctggttgtggcacagctcagtcagggctcggtccgtgctgggagggagctggatcgagcggcccggtgcgctgtgggttggccgcacccatgcagggctcctgccccggagctcgcggcgtgcgcagggtcctcgtgctgctattaacgtatttgcccatttgtaaag

SEQ ID NO: 45226 - DNA, 1018 bp, Homo sapiens
gactttgcaaactggctgccatcccgcccatttcaactcacagagcatttcctttaggaagctttccctgaccacctccttttcctcttgcctgagttacatgtcctttcttagatcctgtgggtcctctgtcatcgagtctttacacatctttgccacaagaatacgagcagagttagagctggattttgtctgggtgatggaaaattaatgctcaataaatatttgttgagtgaatcaatggacaggcaaacctatttgggaacagtattcactttgagtttattaatctatatatgataaagaataaaagtatattttttctactcttttttattggagacattttgatggcttgaagcagttctggaatggtaaaacaatgtcattacttttatgtttcaacaggaaatatgggatgtataaaatcaaaagggaaagacagcttgagtgacgatggagtagatttgaagactcaaccagtacgtaatactgaaagaactatttatgtgagagatccaacgtccaataaacagcaaaggccagtaagtagatagtctcaggggagaattcccacagcaagatcaaagcatggctacataatttaaacaccagtctgtaatatgtgcatgcaaaaaaattccattgattacttggtcctcaaataatttttgatatgctttgtaactttatcctttgaagaatgtataaatattttagggataactaggccactcattgtgcaattaaaagggcctttggtcacattcttttgtgtgaagaaagccatctttcatattactggtgcaaagaccccactatatatatatacacacacatatatatgtgtgtgtgtatatatgtgtatatatgtatatatatgtgtatatatatatgtgtatatatatgtgtatatatatgtgtatatatatgtgtatatatatatgtgtatatatgtgtatatatatgtgtgtatatatatatatgtgtgtgtgtgtatatatatatatatacacac

SEQ ID NO: 45227 - DNA, 1121 bp, Homo sapiens
ttattcagaaaagtcaaggagaatagtgtgcaaacccacacaccgctttttcctcttgttcaaaataaaggggattaaaaatcaagttagaaagcagaagtagtaaacacgcttgaagtctttcaattccctcctgtataccattttttgccccttctgtggtcacagatgccctccactcatgagccagttagcctggccttattccatggccataaccaacactctcagccctggccagatatgacaaaatgcacgctatggattgattaaaaggggaatttgatgagaaggtgaggtagggttgatgcaaattcaacaacattctagaaaaagccattttaaggaaaaatctagagcaatagtatatgtgtggcatacatgtgtttcggtcttataaaaagcatattaaaatgtttgtaagttaagggctttttgaaatttgaaaaatcagcttgctgcttttaaaatgatgtaattagtttctagtcttctagttatttcctctaaatcacataaaatagatcatatatccaaattatgcaaatctgaatgactaaaaaatcaacataaaacttcctgacataaacatttgaaggatagtatgcagccatgggtttttctggtactacaatgtagtaattttccctgtctcactgaaatggagattttatgggctttcatcagaaatttaaatttcagtacaaactgttttggtcccattctgtgaagccactttaatcaaagagagacagaaaagttacatgacttgtggtataggcctctgacagcatctatcttacaagaggcccagaggcctcacacagcctcatgtggcactgtgaagaaaagaatttgattttaaaggtaattgaggtggtcttctgtgccaccaaatccttcccaataactcacccccccactgaaataacaggggatgccatctgtccctgtgatggagtcagggtcagcccaagaaaacctggatgggatgggacttgctctcagcctccagggacagagccctgaccatgcaattttatacaattggggaagcctcagatgggcagtcccaggctgggacggcaactccacgaaatcaccagggtcccacctcttcc

SEQ ID NO: 45228 - DNA, 1043 bp, Homo sapiens
ctcagtatacaaatgttaacacagctggtggttagctctttctcagaatttgagaaatgttgccatgattttgtaaatggagcctagattatgctaatgatggagaaatcactgagccaagaaccagaaaacctgcttctgcatggggaaaatcactttgtgggcaccagtgtcctcgtctgtgagatgggaggcacaggttgggtttcccacagcctcagctctaatattgcatgactaaggacatctccttttatttagactatctatgtgaatcgtcaccaaaagttgcaactaatgattctgaggctatgcagatgacattgatataagattttagcattgctctaaataagggaacacaaatatatcactttaatgcagtacttacatgttgggcacttaaatgctctatttatcttttttgaataatgagtgttatgttttcagcttaaactttgaccatgaaaacttagaaaatggacaaatgaaactagttactgtcagaattgcaaaagtggatcatatgcagtttccttctgaaaaagccaaaggaataggaaactgtcatttaaaaatagtataaaacaggaactcttttttttttttggtaaggtgggggtggggctgttttgcatatttaagcaagaggaatcatgactggctgttaaaatagcaaataaggcagaatttatttttgctttaaatttgattgggaagctttgggttagtgtatggcagaggtggtggtgcttttggcctgcaggcaagatctgtctcttatcttaatgttattttgaccaggggtggcaatttctggtgagtgctaccgtaagtcacaaaatgctattctctttgggtactcatcatggaagcttgcagggctagaattcaactgaagtggtttaggagtgggcagagtttatcaccagctggtcacagttgaaaagtggagatgaaagcagtttgaaattagccaggcttggtggtgcgtgcctgtaatcccagctactccgaaggctgaggtaggagaatcacttgaa

SEQ ID NO: 45229 - DNA, 1099 bp, Homo sapiens
aatgtgcacaatgcccaggatttggaaatatttggggtgaaaaatcattttttgaaaaaagaactggctgggcacggcagctcacacgtgtaatcctagcactttgggaggctgaggcaggtggatcacctgaggtcaggagttcgagaccagcctggccaacatggcaaaaccccatctctactaaaaatataaaaattaggctgggtgcagtggctcacacctgtaatcccagcactttgggaggcccactttgtgggcggatcacaaggtcaggagatcaagaccatcctggctaatatggtgaaaccccatctctactaaaaataaaaacaattagccaggcgtggtggcaggcgcctgtagtcccagctactcgggaggctggggcaggagaatggcatgaacctgggaggcggagcttgcagtgagctgagatcgcgccactgcaatccagcctgggtgacagagcgagactccatcttaaaaaaataaaaaaaaaaagaataaaataaaataaaaataaaaagtagccaggtgtggtggtgcacgcctgtaatccggaggctgaggaaggagaatcgcttgaacccaggaggtagaggttgcagtgagccaagattgcaccactgcagtctagcctgagcgacaggaaggagactccatctcaaaaattaaattaaattaaattaaattaaattaaattaaattaaattaaaaaataaaaagagaaccagtagaaaaatggtgagaatcataaaaatatgtttctctctatatggaagaacacaccagaatccatcgactagtctgttccctgattggcttgtccctggaaggactggggatgtgagatatcttcaggagatcgggatcagtaaattttttagtcacgagagttgtatgttacgagagcctctagcattagggttataaacataatcaagcaatcctatttacttcacatgagaagacttgattcatagcacagaaatcggtaaacattgccaaaatatgccattttccacacggttataaaactgcatatgggagagaatccacgatgaatggaattatctgaaagtactttctttacgca

SEQ ID NO: 45230 - DNA, 1023 bp, Homo sapiens
gtgacattttatttatgtatgtatgtatttatttatttatttgagatggagtctccctctgtcgcccaggctagaatgcagtggcgtgatcttggctcactgcaacttccacctcctgggttcaagcgattctcctgcctcagcctcccaaatagctgggattacaggcacccgccaccacacccagctaatttttgtatttttagtagagacgaggtttcaccacgttggccaggctggtctcgaactcttgaccttgtgatccacctgcctcggcctcccaaagtgctgggattacaggtgtgagccactgagcccggccttatttttatttttctagagataggatctcactgtgtctggagtggactgaagtgcactggtgcaatcgtagctcactacagcctcaaactcctgggctcaagtgaccctcctgcctcggcctcctaaggcagggacttcagatgtgagctgggacttctgcgggagccatcatgacattgattctagtattcaaataagaactctgaagaaactcaactagggaattagattttggggttggcagctattatgagttgaattttgttccccaaaaatgacgttctgaagtcctaactgccagtaccttatgtgaccttacctgcaaatagggttaatatagatgtaactggttaagatgaggtcacactggagtaggctggcccctaatccagtatgactggtgtccttatgaaaagaaccatgggaagagtcagacgcacatagaaggaagactatgtgaagagcctgggagaagacggccatcgccaagccaagaagagaggctggaacagaccttccctcaagccctcagagaaaccaaccctgccgacaccttgatctcaggctccctgtccccagaactgtgagaggaggaatttctgctgtgcgggccacccactttttggcccccagggcccggggcaagggctccatgaggagtggctgctcgacactgcgtttacatgtgggttttattat

SEQ ID NO: 45231 - DNA, 1056 bp, Homo sapiens
tccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaattcttttgatttgtattgactgctataaaaatgatggattaaaataggaccagaaaagaatgaatgcctacctgtgtaagaagtatttttgtatttttaagcacacttgttaaagggcttggaattttaatgtcactcctttgaaggtacataccaatatcaacattcatcttgtaactagttgtcctgatgccactcttgttgagtctttattttcagtacctttgccttattgctgagcacttcaggtaaagacttggacacctgccttcccaccaggccctcgtgcccgctgggcctctgggttgaggttgatgtagttcaagaactgcagttggctgccgggcgcggtggcttacgcctgtaatcccagcactttgggaggccgaggcaggcggatcacgaggtcagaagatcaagaccatcctggctaacatggtgaaaccctgtctctactaaaaatacaaaaaaaaattagctgggcgtggtggtgggtgcctgtagtccaagctacttgggaggctgaggcaggagaatggcgtgaacctgggaggcggagcttgcagtgagccatgatggcgccactgtactccagcctggacgacagagcgagactccatcatagaaagaaaaaaaaagaactgcagttggcttaccagtggcactctgtagggagctatagttctggagattgcggaagaaactttttttttgagatgagtgtcgctctgttgcctaggctggagtgcagcggtattatcttggcttactggaacctctgcctgcca

SEQ ID NO: 45232 - DNA, 1050 bp, Homo sapiens
tactgtagtgtcttcaaaaaatgtaatgcacatctcccttatttctttgcatttggtttgactatgtgaatacacatttccccttttatgggagatgtttgaaccaatgaatatgaatactatttttctgggcttagatatgttttggggggcttgaataaagcacctcatctgtgctacttgtgaattactttctagagcagcatgagttcacacctagataacatgtgttctcagaggcactgcatatactcatacaagtgaataatgtgcaatcctaggggtgccacttacatagactaccgtggtcatgatgacccctgagattgttcagtgtgcagcctgtgcaactgtctgtgcagcccttcaaaagctgcctgacagccttatttagataactttcaggaacatacagaaaacaaatatatctctggtaatagttcatgctttataggcttacctcagtgcatcgaagctacctttcagttaaaaatgtatgaatgaaaaaataaaaatatgttatgtaggaaatgtctgtatattaaaatatccatataaaagcagcagctaccaggtaaataaagaagctgttagggtggcagctgaacaatcaaactaagtacctgcactcatttctaatttagatggaccttagtagccagactatggatgttacacttaacaaaatcatcagctttgtaactttgcaaattagacactgacacaatagaatcagaaaataaaaaccaaatggaaatatttcagctgtcatttagcttgaaacaagcaaaactcactcacacatcagacttcagggcatcatggatgctctttaatgaagagcattgtggttaaaaatcaggcaacacttggaaatttttatgagacaggggcagaatactttatggatgaagtgaaacagagccctcaaactgtttttatcaattaaggatattcaatattacatgagttatgtagcatttatactacttagttttaggaaataatgagttaactggctaaaataaaaagctctctttttaaggagct

SEQ ID NO: 45233 - DNA, 1074 bp, Homo sapiens
tggttttgatataactttctatttgggggattttagaagttagtgcataaaatagtgctccctttgcatggatggatgaaattttgtggtgttcaaactgttgtattagagatgtgaatgcctaatcataacagattaaaaactgtcaactatctttcatatttaagcaagttacaatggatacaaatatttcttgaaaagctagtcttttttttttttaaatgtagttgcttacactccttaggtgcacagcaaatgccagaactgccctaattaggtcagatgtttctcattagcttgtaacagtcttggatgtatggatggatggatgcacagcagatggattgacggaggatagacactttaattgacccctcgccactgtcacactacacatatataactccctggctacactgaatcttaaagaccacacataccactaatattgtactgattgaaattgctcgtttcaattcctaacagactgtctgtgtctttcttaatagcctgtgaatatctgcagaacaagggctgaatcagatgcagaatatttgtatattttatttcagaatatttatattttagtaagttaatgctcactcttaagtaaagcaatgggaaaaacatcctctaatatttactttttcttgtaataatctactgatggcatatttttattagcattccttggaattattcagtaagcatttacaaaggatcctgtatacagtagataattagtattttgatgaataaaagatgaacacttttcctaatatacctcatagaaatgtaaataaattatattgttgatattcctgtcattgatgtgacattaataaaatatcatggaagggctggtttcaattttaccattgctgagaaaaatggcaaatgcatggtggtctttaaaatagtcattgtcattaaggatttgtatattctgcttgttcccagatgtcatggtcttgtgaggaggatagaatattcttcagcaacctcttatacttttctttttttttttaacatgttcacatctgtgagtttaggtgatagtgctgtgagatactt

SEQ ID NO: 45234 - DNA, 1920 bp, Homo sapiens
atgaataaataagccttgccctcccaactcttctgtacagggagctgcgagcacatgggctagggttgaaatcctagaggagattgtagatggctttgcagcatcagcgctattctatggactgattcacttcctgaagaggaatgaagtgatttacccacccaggaagcctttgtgaaaataaaaattttcatcaacaacacagaatggaaagctattgtcagttcttaactgcctatagtagagtgacgtcttaatgggcatgtagagacaaaccatctaggggaaaataactgcatctcctctagaaggcaaagcagccccactgacagcagaagaaggaggaactcagtctaaactgtgaagaaccagttcagattctccctcccatgttggcttcttatcctttaatcaccatttattcatcatttacattctatgtcctcagagttccttatgactgtgagcacatagtcatgtacattctttagtctatgaggacattaaaggcacttgtgaaaatctgatttaagttacagtaaaatttttctgtctctctctaatagactataagcaagttgggggtaagaattatgttttaactctgaatctgtagaatcgagcacagaatatagcaaactacagaggataaagaaatgtttgtggggctgggcacagtggctcatacctgtaatcccagtgctttgggaggctgaggtgggaggatcatttgagcccaggaagtcgagatcagcgtgggcaacacatctcctcattggtagatgtgagacccccatctccatttttgtttttttttgttttttttttttttaaatgagcatggttgcacacacctgtggtcccagctacttgggagcctgaggcgaaaggatcacttgagcctaggagtttgtggcttcagtgagctatgatcatgccactgtgctccagcctgagtgacacagagcaagaccctgattcttaaaaaaaaaaaaaaaaattaaggagatgtttgtggaatttaatagactgaagttttttgtacatatgaaggaaagtcactgtacgttgctcatctatctttttgctcactgcctctcacaagctctgacagcaacatcttcagatataagacacaacagcacagggcttagcagggctggaagcgctatttcactgaaagaggggagacacagtctattgctggagaaagaaaggcaaaaatgaagtcagaaacaaaagaggagaagaaacagaagaaactgggttatttatgtttagttgtagttgaacattatggtgcagaatggtaagaacttgggtgaaactttaaactagtcaaagtaaggaataatcaaggcgtaattagctttattcaaaggctgcttgaatttggtctcctcaactgcgtttaaaatagggttttgtttctagaattcagattacatagtttatttattcattttttaaattttgctcaaattgattgttccctgtggactcacagattcaatattcagagattcaattatttgtgattgtctccacgttcactacttgtgttaattccgctatttcggggaagtggcacctttaaaagcccacactccagggccaatgaagaatacagaatgcaggccactcccaccatccacgcctcccctgggcttcgtgttctgtatgttaattctctcatcatttgctgttccattaaaaattacgtatccagtgtctagtttgcctgggggtgaaatggggattaagaacctttcccaccttgagacactgacattcttgtaaagggataaacactctatatttgaaaaatcatcctaagaagaacagtaactagtagtgctggagttggaagtgaagaaaatgtgaggagatccaagaaaatgatgaattttaggcagaact

SEQ ID NO: 45235 - DNA, 1034 bp, Homo sapiens
aagtaaattggtcttacaaaactaatttgtaactttcaaaaatgttatctgttgggtgaatccaagaggcttccccagaagtaaaactctctaggacctcaactcaatacctgatacctggttcccacttgactggcttataagaggggcccagtaaatgttgctaaaatgtaattaaaagaaaaaaatttattttgatagtagttttaagtaacacacagactatcaaaatgtatttattttacacctgttgtagtatgctaggattataaatattctacaattaattttaaaggacaatcacaattttagtttctccattgaactttattttgcttcattcatatatatattcagtgagtcttccctcttacccaagtctctccataaatgtcttcattattttactgacttgatgaattcccagttccaaatgacgcttcaagtcatatatctagtttaaaactcctgcagtaaaataacatttctagacagaattctgaattcaacgaaatgtgtttctttctctataatacattgtctgtgttatcttcattcttggaagagatttgagtagaaggattgtatatgcttctttttatgggatgctatgaatatgaatacttatttaacaaaccaaattatatttctctcattccccaaactttagaaagttctatgatttcagttgatggcacacactagaatttgtgtagaagttacaaggaaatggagccgcacttgagagttgcaccttcatcttgggttcagcagtgtccttagagtgaaaagagggtggaggagttctaactgcattccaagaccaagtgatattctgtccaaaaactatcaaggacagacttctctgcttttaatactagctttttgatcagagggctcatggggtgcaacatgtacaccaacttgctgccttgtaaacttgatcctttgtaaatctgtgacatttttccttgttacaagagttttatattctcatgtatataaatactgcctttgacaggataagagactag

SEQ ID NO: 45236 - DNA, 1001 bp, Homo sapiens
ggagatattttaactctttattcagcaccttatcttttgcttctctgcatacccatatttcatgctttgatttttctgcaactctagtctttaaagatttacctgtcaacttaagaaacacattgattggataagatgtttcctggcagtgtaatatggaatcatgtggttgaaagggacactatagttccacctgttcttctccaagaattgcaacaaagcattttcaacctcatctgcagccaattttaaggaaatctaataaagaggtttgcagagcacctgagagcagctaagatcccaagacaaagtagaaaattacctattgaaactacaaataaaaatgaaatttaaatatatcgttttatatatgggccatttgcttgctcaatctctttgtacctgggagtggagggaaaggctgggagtaaaatgggactggattaaaatatagtgattgtagatttttatgacatatgaaataaattgtaaatattaaaaagttgacctgtagtaacatgcttgcagccatctatgttattaagacagtacttaacgagttttgaaacaagtactcctggcaatattactactattcttaacctatatgtgatagacattttcaaaaagtcatcatatctgattgccttctatgctgttctttaaatgtttgaaatcgtgtttttatatatgaatacaaccaatcagaatacaggtacattgcttcaagtactatttcaaaaagtttctccaatgacatgactcagcgatttcttaaaggatagaaaaacactttgttaatggagaaaaccagaagtccaccttctcttggaaataaatgttgaattttaactgagtaactttgcatcagccacatcgtattactgacatgtattaggtggtagatttctgtagtagcagttctttaaaggaaaaaaaaaaaaaaaggatttcttttccattgccttcttttttttttttttaacaaaatgagatattcc

SEQ ID NO: 45237 - DNA, 1149 bp, Homo sapiens
gtacttttagtgaaatatttttgcaacattaaagttttttgttgttgttgttgtccttttcattttaaaagaaggcccaccgggattctccatcagcaaacagccaacccactgcattatacatagcaagttttagtgacagttctagtctcttgggcatgagaaatacagtcttgtttgctcgtttaagtcaacaagctgtgggatttattgtgtgttttgtagtatgcatgcagaatgttttgatttttaaaagtctaaaataattgaaactgtcttgtgtcattcaaccctgtaataagtacctatagtttaaaacctcaaaattggttggttttgaaagatgtttgtataatgcataataataagcgcctctggattatttttaatgcatcagatcctgtgctatggtctgtgtaagagaaaggaaccctgattacagttttggagagtgttcctggtgcccccagcatgcccatggtggataccacatcattatgctgtgctctgaggggcctcattctgacagcatgcttggttacataccgtaatgaaaagccttgtttggggaacatttgtgcttttaaatattggtttcatcatgtccagggaatgaagctgatttaaacatagctcacagtaaatctgagagtggaaagtttgattttacccactagtctttctaattttttactaatgtaacgtcccaatccattgtgtagcagagaagctagttgaatttgttcttccaggggaagagggcccttcttatacatgagtttatatgaagtttttcatgtaatgtattttatccttcatgttcatcagctttacagagaaaaacttaaagagttcttactccaaaacattttgtctgagcctggggtgaagattactataaggaatgattgagcaacaagatgccagtgatggtcaaggaaaaagtcaaaaatgttgattttgaagatcctttactaattcacaaattctggttgtttttattttcatctatgaacaagggcaatttcaagaataggaagaaggaggaacatagagcctcagccagcattgacgtgggtgacaccttcagaacggttgtaggagcacaaagagtcagcctggtgtcacttgctggcaggccttcacttc

SEQ ID NO: 45238 - DNA, 1054 bp, Homo sapiens
cagggcttactttttggtcttcaagaaaaggcacagtagctgtttttattagcggcacagaaaaatgattttgtttcctatgatactgatcctgcacaagtttttttctttttttcttttggttactggctaggggtatatggaaattctggggaggaaggcttgttgatgttcctgtggcttatacacctgcccaaagctgtgctccactgacacaactgaagaaggacagacaggaaaacgaggccaggaatcctggacaggccaaagtgcctgggatacccacgggggatccaaagggccaccaggcatccccagtgacatcggaaacacgaaaggctgtagggtggccagagccatcagcctcccaaaattgtccacccttagactaaacaacatcctgctgccttcccatcattaacctgcccttttatgcaactgattttttatgggagaaaacagtttattgcgggttattcagtttacttattcagaagctgtagagtggctcagcgacagggacaaatgaaaattcggaacatcatactctccatgtttactgtgatgattcttctcttccatcactgtctataaacaacactgtgaggacagaattctctgaaaagctaagatatgggacaccacaaaggcctgaagcttccatccaaaagaagtaatctgagttggacctagtggggattaagcatgctattgatttagtattcattttttatatttggactgtttaaaattacttatccaagaaatcctccaaggcgcatgattatattatcatactcatttgttggggagggtgggggattgtagttattagtgtaatttgccccagaccagaaagtactactaaatgctatgattagaaaaaggagaaggaaatctgtatttatatggaaaagaatttacttaggatgttattctgcattttaaattgtacagaagagaaaggaaagaaaccgattaagatgcttaaaatttaaatttcttctttggagaatcaatgactaaaatgtctcagaaggtatgtattaggatc

SEQ ID NO: 45239 - DNA, 1034 bp, Homo sapiens
agtagcttaaactacagacatttatttcccacagttctggaggctgggaagtccaagaccaagatgccaacagatttcgtgtctagtgaagccccacttctgggctcacagatggacatcttttcactgcgtcctgaagtcgtggaagggaagaactcttttctcttcagccccttacaagggcaccattcccattcatgggggggggctctgccctcatgatttaatcacctcccaaagatcttgccttttttttttcattttaccagtttaaaatgaaaattctacatatgattactttatgtctgcatcttttcaattgtttcttccttgtgtttgccctttctcttgcctgcttgatgagatttggctttctgtccaaggatctttctttggtctctgttcactttcagcctagaagtaacagctggagtgaatgcccatgtggacagttgtgccattagccttttcccactgcacctgctcagtgtagatgacacatttcttcctgtaaaccttgactgttttgccagtttgctgacatttatagtgtcctcacacagcctgaacttcatcatcctttcagatgagcatggatcaaacactgtacttctgtgtcagctctttggaaagagaggaagacgtaatcttcctgcgaatgtggaaaggtgccttgaaatgccattttgtggttcttgcttcagtcaaaagtcacaaagggattaaacttcgttttggccactaccagttcagtgatagccacaaaagggaagacattcttcctcttaatactatcacattgaggattaggtttcaacatacaaatttggggggcacattcagaccacagcgatagagaaataaatctccgactggaaatgattcattaataaagaagtgtttgctgggcacagatttttaatgtcacttcataggttttcatttctgtaattgctttagattcatgtcttagctgaaacttcataaagcaaggaaagaagataaatggcaaagcagagtataagtgacttctt

SEQ ID NO: 45240 - DNA, 1055 bp, Homo sapiens
tgctctaactccagtgctttctttcctacttaaaatttaaagactaattaggcattaactatccttttctttttcattaccagaagcactctttaaagaggaagtaacaaaacagcagcccaaatgtggccaacagtgtttttaatattgaatttttaaatcgggagagtttgtgcagagctctggatttgctgttgcgtcaacaatgagccacattccccatggcagcccgtagcggggggctcctttccgaaggccacacactctcccattatctgcctggcctcagaggctttgaggcacaaattgcccggattacaggaactttggctttagcatttttttcaaataaactgtgtatgaggttcattctctatatctaaccacctccaggattgcaaatgttcttgaggtctccccaaggttatagttcagctgagggtcctgttcacctgactgcacctgttcacctgactgcacctgtgaggagctggcagatgggaagttagaaaggttcaggccactttggttttaaaaacttggaattctctgagattgctatttctgtgcctaaaaagctcagacttttgctcattcagagacaagtaactttggcctgtttcctctgtgctggaggcatttgggttctaatgggatgctggctagcacagaaatgggcttcccccctttcctgttgctactcaaaggcaacaaacagcatcacctgggatctggtgagaaatgcgtaatctgggtctcacccgaaatctaccaaatcagactgtgctttaaggagatccttgaggggtctgcaggcccattaaagtttgagaagcaccactagagtgagtagtgggagataacattgctcttccttgtccttgggtcctttgtcccccagctggctctatgtgccacctgttctccctgcacaaaccaggactcccccacagatgatgtgctcccccaccccgacccctgccaccatcacccccaggccagattgcttttgagttcacatttgagttcatatctgctctgattcagcgaaccat

SEQ ID NO: 45241 - DNA, 1071 bp, Homo sapiens
ctgtggggagagaccagataggcttagtggggtggcttcccatcagttatgtcctgtcccttcataggctccccacacatgtgtgctgtggttctccctctttaccttctccatctcacctctcttccctgagttgctgtgatgaaccaagcatctctaggcccaagggatacagcaatgagcccccacagaatagatgctcacagccataaggagcccggcttcttgacagagagtagatccaatagctaaataggtcagacttataaaatgttagatgatggcatgcacttagggaaagaaaaataaaacagggaggagagagagcgagtggcctgctcaaggaatcatttgagaaagactaaaggaagtgagggaggtgctctgcagataccttggagaagcaatctgggctagagacagatcaaataaactgcagggaggccagcaggactggtaagggatgggctggtcaggtaggacctgttggctatttagcaataagtgtcaatggggggaaaaaaaagaatgtgctataatcaaatttagaggaaacttcaggttaaatggatgtaagcatgttctgcgggattttcatcggagcctttaatctccgagaaacaattttagtgaaaagtgtttcctaggtatttgagtcaggaggcacttttgcaggaactcaagaactcaattctctgaagatcccagaagtaagctgaggggctagggaggggatagcagcagaggcagactctggggcccaccctcttcactgactgtgtcccaaatacatcctacctgagcttacaacacaaaaatatccaggaaagagaaaagtcaaataagctgctgtgtcagatgacagaaacgttatacacatattatgctttcctgagatacattatttgtttagctaatccaactattaattactaccaattgctaccattcagtagtcttatttttgtttaattagtaacatttatgtaacaaaagtaaataatatggaatcgtatatgacttcaaataagcacatagttttcatatcttaaggtgattaacatgtctatc

SEQ ID NO: 45242 - DNA, 1041 bp, Homo sapiens
aggtttgatgcattctcagaagtcccctgaaccacaggcaagagactcccttggacttggtgcaacccaagactcccacacactttcatccacagcagcttctgttgtgctcctactggaagcacaggctgtggaaaaagagcaagagacaaatggtctgagagaaaaccatcaacaaaataaatggtggttccccctgggctgtgggtatctgggaggttctcatggaggataagcagatcatgccggcttatcagcatgcttcccttggcaagagtttttactcagacatatgatgaggttaaatccacaaaatccacacagagctcttcaaaggaaggactgtgaacaggtgctggtctacaaattgactgttaccagttcataaagagataagtatggagataatgagtaaacatttagaaacttttatggctatttgacatgactacaacattcaagcacaggattagtggatttgtcttgctgaacatggtagagatgaaaaatactggtctgcaacagcttggaaatgaaaacaatgacaaacaaaacagcaaactgatccttcaaccacagctagttgcaatagcagtactgtaagacagcatgaggtagaattggattttgatggtttattctcagcatgctttgagtgccagccattttcctgcagctggggaaggagggctgagtatcattcctaaggagttcacagttcacctgggaagacagacaggccaaccaattcatgtaacccagtcagatagaggctaggatagagcttactctaggtgctccccacaacatccaaagcaaggctgctcttccttgtccatttgggatgcctggtgataatgatgatagcatccatttatcaagcatttacatcatatcagactctgaattaaccaatttacatgcactatctgtttaatccctcataagatctctctggctaagtaccttattgtcactttcaatttatatgtgtataaattagggctccgagaggataaaagaacttgtccaagatcatag

SEQ ID NO: 45243 - DNA, 1025 bp, Homo sapiens
gtcttattgccttgagaagtggtttgtagttctccttgaagaggtccttcacattcctcgtaagttggattcctgggtattttattctctttgaagcagttgtgaatgggaattcactcgtgatttggctctctgtttatctgttactggtgtataagaatgcttgtgatttttgcacattgattttgtatcctgagactttgctgaagttgcttatcagcttaaggagattttgggctgagacgatggggttttctaaatatagaccaagcaaaaaagagagaagactcaaattataaaaattgtaaatgaaagatggaatatcactaccgaccttacagaaaccaaaaggatagcctaagggaatactataaacaattgtatgccaacgaattagataccctacataaaaacagaaatacctagaaagatacaaactaaacatttggtagagttcaccagtgaagctatctagtctttggctttttttgtaggaagttttaaatgatcagttcaatctctacttgttataagtctatttatattttttatgatttaaataaacttctgtaaagaggaattaacatcaattcttcacaaactcttcctaaaaatagaaaaggaggaaactttttccatcttatttatcctgatagcaaaaggagacaaatacagcaccagaaaagaaaactgcaggccaatatccctaatgaacataaacacaaaaatcctcaaaaaacagcaaaaagaaaaaaaaaacctaacaaactgaacaactttgtataaaaataataatacaacatgaccaattgagatttacccaggaagataagtaaagttgagtcacttaatcagtataacacatcatattgtcagaataaagaacgatacccacacaatcaacccaatagataagaaaaacacatttaacaaaatccaacatccttcatgagaaaaatattcagctagaattgcagggaacttcttcaacttgataaggggcatcagtgaaaaacgcacagcta

SEQ ID NO: 45244 - DNA, 1087 bp, Homo sapiens
atctgtgtctgcccaggaagctgtttttataataactagagcctcgggtaatttggctctgatgattagccagattgagaaacattgctctggaagactgcttaggatatattaaattgtgtttctagacctcatgtatgagccatctggaatgcttactatctgggtccaatggacactttattttttcattttttagttttttttttttttagagatggaatcttgctcaggctggtcttgaactcctgggctgaagcagtcctcctgtctcagcctctgaaagtgctaggattacaggcatgagccatacggttcctggcctgataattttattttttacatttttcattcattttatgaatagtttgcagaagtgaaattaaagacataatgaaacacaactttactagaaattttaataactgcttcaacaaattatcactccaaattttcctggttttgaagatatcagtagttgaaataggcaacatcttcgaattcaactaattgcttatcaactgtcatataattttttaaaaaaatcaatgattctgccgtcctaaatttttattatcccaagatgtttttaatacagcggttcccgacatttttggcaccagggactggtttcatggaagacagtttttccacggacgggataggtggatggcttcaggatgaaactatatcacgaggagcgtttaacctagatcccttgcatgcacaattcacaatagggttcctgctcctgtgagaatctaatgctgccactgatctgacaggagctggagctcaggtggtaatgctggctcacctgccactcacctgctgtgggtggcctggttcccaatgggccaccgactggtactggtccatggcccgggggttgggaactcctgttttaatagcttagattaaaagaagcaaataaacattatttcaccttaaacagtcacatgtcatttttaagggaggccagttgtagttggtggtttgagaaggggtgaggttaataactcagaaaatgatgagtattgccattctaggtgatattatttggaaaactttgccagtgtttcctact

SEQ ID NO: 45245 - DNA, 1055 bp, Homo sapiens
tttgtattgatggtagtactgtaacattccactgctggtaagccatgggccttttttgcttatttttctaaaattgattcttctttttctgctgccaagttttctgctttgggggattttatttaatccctaaggtgtagccagactgaatttgtatggaattctccatcacattagcttttggcattgtggtctgtatagcagattctcatgagtaatcctccacactttttatagttcctacaccatatcaaaagcttattatctgttaattcttcaacagatacatgagattactgttttacagatggagaaactgagttgtgtcatttggggcaaattatcttagtagatggttgatctggtttggctctgtgtcccactcgaatctcatctcaaattttaatttctgtagtccccacgtgttgagggagggatcccatggaaggtgattggatcatggggtcagtttcccccatgctgatctggtgatagtgagtgctcatgagatctgatggttttataagtgtttgacagttcctcattcatactctgtttttctcctgccgccacgtaatatgtgcctgcttccccttctgccatgattataagttttctgaggcctccccagccatgcagaactgtgagtcaattaagcctctttataaattacccagtctcgggtagtatctttatagcagtgtgaaaacgaacgaatacagtggtagaacaaagatctaggggtgtctgactccacgggccattctcttgattacagggtggtctggctccattcccctttgctctttctttccccatatcttctgagtttttacttttcatagccataatgtagctttaggtttctcccagttctcactttaaaatattctcattttcaggtatagctgagagtcactgtgtttttagccaaatctaagggagaaaatgaatattgatagcagcatgctgtagccagctccttaaaggaaggatggtgcctggtacagagttagagttagtgcttcagtaaataatgaatgtgtgctaggtag

SEQ ID NO: 45246 - DNA, 1046 bp, Homo sapiens
tgtcatgggcttttgggtttagacgggcacatgtcttggcacaggaaacaatgtggtagattttccaagcatgtataggtcacctattccttgcaggccagtagagagattactgaagagaagatacctgccactaacttactagtgcacatgaacaattaatttaaattctgaaattttctgtttctaaaacaggtatagtacctgcctagtgcaccctatagggttattcaccaagactcagggttttgttttgtttttttcccctagctttacagctgtctttaaaatttaagtgtcagtcatgtgtttccttcatttatttacagttgatatatcagtgtcagtggtgtattcatgcttgctctgctgccccagcattattaaaattgatggatgacccttttgcatttgtccttctttagaaatagctactatgtagtcctcgctggttattttagcttagacaccactcttgaaaattttccgagagcctggtatttgtaattagcatatctcgattaatgtggtgtctgtactgtttacttgtgacctcagtaaagttcatacctcttcagttttagttttctcatctggaaaaaccaatagcaatgcctggattatctatacctcacaggatttttgtgagcttaaagtaaataatatgtgaaggtaaggtgccttgtaagctgcaaagtgctttattaatagtaataccttagagataatgtttcctatctgttgagcatcctaaaatttagtggggttggtcttgcctatagaaaaaagctgttcactgtgctgatcatgtgttaaccacaaaatggctctccttgattctattgtcctccatgactcaataaaagaaagttcttttccatctcagatgtcttcatagtccacttgagattgagaagaatatcaaggaggtactgtttttcactagtcttcagggaagagaagggaaggccagtagtcatcttctaccttgatttttttttttttttttttttaacacggattttcgctcttgttgcccaggctat

SEQ ID NO: 45247 - DNA, 1049 bp, Homo sapiens
agcacagccggctatttttgtattttttgtagagacaaggtttcactttgttgcctaggctggtctcaaattcccgggctcaagcaatctgtccatcttggcctccccaagtgctgggattacatacatgagccactgcactcagccagctacatgaattttcaaccggtttaagaactgtatccataaaggactgccatgtaggcaagcgggaaggagcatgctgctatgtgcagtcctggatttttgacttctgatattagcaacaacttggacacagtccaatttggttgaaagagctaatatgtaatttggattttaactgacagaatccaaaatgaccttggtaggcagaatgattggccaaattttagcaaaattgtattacataaaaatgaagttaaaacccagtatttgcttgtaaaataaccgtacaaatactaaatggaggtcagctggttcaatatccacacatgtctaaaaacttagttttacattacttgattcatatgagtcagataagtaataaagcgaacaaaagaataaatgtgatgctagattagtgaaagtatagtgtatggataaggcaggttctaccctgtcagacctcaactgcaattcagttctgaaactcttgttttaaaggaatatctacaaacaggagcccgtgctcaggagaccagtaatgctgatatgaaggctataacattcatgacattttaggaatggttgagtatctgaaccattttaacctaaaaaagaagacttaaaggagaatataataatgactttcagatacttaggtgactgacatatgaaagagggactcataccaggaccgtgagtagaagacatacagttggactcttcataaaatggaaagagcttgttcactggtaagttaatttgtgctggagtaggaatttgattgacacatatgaaggcttggaagatggagtttatgcaaaggatagagatttgcagttgattttttttcttcctaaagaaatataagatactattgtgggccaggcatggtggcttacatc

SEQ ID NO: 45248 - DNA, 1033 bp, Homo sapiens
acaatgtcctaaatattcttctgtaactataaatttgcattctatttggtatgtggtcatgtatatcattttctttttttaaattttattttagatatgggggtacatgtgcatgtttgttacatgagtatattgtgtactggtggacattgggcttctagcatacccgttaacccaaatagtgaacgtggttctcaataggtaacttttcatcccttacccccttcccaaactccacttttttggagttcccagtatctgttatttccatctttatgtctgtctgtacccattgtttagctcctactttataagcaagaacacgcagtatttgattttttgagttagttcactgaggataatggccttcagctccatccctgctgctgcaaaagacacgatttcattcttttttatggctgctatgtctttctttaatccctatatagcttgtggcctcacaccattaattaaataagccattcattcttgtcctaatacctttgtaatatgttagacccctgtatgtaagcaagcaagcctgtttgagggtgccaaaatatgttttgttcatctttctttttttctttttttttttttttgagacagagtctcattcagttgccaggctggagtgcagtggtgcagtctcttctcactgcaacctccacctcttgggttcaagtaattcttgcgcctcagcctcccgagtagctggaattagaggcacgtaccaccagacccaactaatttttgtaattttagtagagacagggttttaccatgttgaccaggatggtctcgatctcctgaccttgtgatccacctgccttggcctctcacatctttttttctatttcatgaggcaatatcatactgtggtagttattgcaactttgtagtgtacttcataccaattggtgttctttctttcctaagttttcttgatcatccttgtgcatttgttcttccagatggaactttgccaagttgcaagatttttagtgaggcttttaaatttgaaaatagtttt

SEQ ID NO: 45249 - DNA, 1026 bp, Homo sapiens
agatatactactttcagagttgtcttcacaactgtttgcccttctaaaattatctcctatttttctactcctattttgatgattgaatgagtgctttccaaagatgataaatacaagttaaaagccaaagtagtaaacttgtaagtgtgaagtctgtgttccctttgtcctgtaatcctatttcttataatttgcctaaaattatagtaagttgaaaaatgtatgcagaaagttcatttcagcattcactatttagtgaaaataggagaacaacctaaatctgtagcaataaagtaccaaattagcaaattatctgtacacaaaagaatattatgcagacatcaaaaataatgccatagttttatgtttattgatttgccaggatgtttgtgatacagaataatgtctgtgatgtattattaaataaaaagcaaattgcagagcagcatttatatgttcccatttgtgcaggattgtatacttatttctgcatgtgtattcatggagcactgtctgggaagtatgttaaaacattgattatagctagtggcagatttggagatttctttccttgctaattattcatgcttggaaccaatactatgatattgaaatatatctatcccttttagtgttttttataccatattaatgtaatttttaagaaattttaatatttaacatttgtgtttaataattatggctcttggatctctttttttaatttttatgttactgagcctgcaaaacatgaagaccacagttggtttctaatattgactctgccacatttcagtatcttagtattttaattatgtccttagcttatgtcttattagcacctcttccttagcttatgtattttctaagtataggaactgcatttgttaaagttgatctgtatattacctagcatagcatgtcttggaagtaaacattctgtttttaatccttgaaagtgagatatattcccactaattttgtaacaaatcatttcctactctatttaggtgtagagttcggtgc

SEQ ID NO: 45250 - DNA, 1033 bp, Homo sapiens
tatgatggaaatagttattctgtcattcaaggtatgaaataataagaggagaatacttggaaaataaagagaatttttatccttttattttaccaattttttccttgtggctgaaacatgatgagtgacagcttactggtggcttaaatttggtcaccgaccactaggagctgatagttcaaatgtgagaagaaataaacaaagcatagtatgtaaacgagatgtttctgatgatcgtaggtgggtgacctttaaaatcaggagtataacgaacaagaaagaacagagagaaataaatgagatgattatttttagatgaattgaactgtggatagacatcaaaacagggaataagcaatttttgaattagacgcattaagcagtagggagccagtgaagggcagtgacctagtcagagcaacagatgacacaaatttttcttactatggcattttattaataaattggttatataagaaataggaagcagagatttaaaaaatgaaagttttttaatagtgtaagggttgtaatgcaaaccctaaacaaaaaggggccataaattaaaagaaagatacttaagtaacctaagcaacttaagtgggattcagagggagtgaactaagacaacaatatgatgtaatgcctggaaaactgaggtatttttaaaactttgcactaagtatatcgtcaagtactatggcttttgagttttttgatttgacctatagtaagaaatgtattttacatcatgacctagtaaataaattgtgtatacacctacacatataacaaaatattcgtaaattatacctttatacgtaagttccatgaaacagtagatggaacttatgtatataggtgatagactctgatattttatattgtttcttttttttttcccttcccaagatggagtctcactctgtcgcccaggctggagtgcagtggcgcgatctctgctcactgcaacctccgcctcccaggttcaagcaattctcccgcctcagtctcctgagtagctgggattaca

SEQ ID NO: 45251 - DNA, 1090 bp, Homo sapiens
actgtcaatatattaccacatcaccacttctgcttaaagtattctattattgctgtgtaacattttacaaagcatgagaattctgtttcatctattgatgaaatttgtattatttcagttatttccattgatgaacctgaactattggaacttttctgaacacagtgtattcttttatgctctatgtgtttgtgtttggaggtagtatgtatatacatattataaatagatgattacgtagttgatcctttctaaggtaaatgtattactatactgttattttataaaaagaggtaatgaagctaagaaaagtagtagtttatccaaagtaatacttagttcccgatttctagataagaacagcttataagagcaactacagaaagtagttctaaaaaacaaatgagttaagaatcactgccgtaaggataacagaggtcagggtcctgggcaacagctagcatgtgccttcaatgtagtaagcagtcagtaaatatttattaagaatgatacttggagctcttctgattaacccttgaacctaaaaattgactacagtaattctacagcattggtattttcaccgaagaattctttcttaggtaaaatattatacagtcatgtgttgcttgacaaaggagatacattctgagaaatatgtcaccaggtgatttcatcgtcacgtgaccatcatagagtgtacttacataagcctagatggcatagcctactactgcacctactacacacttcccttagtagaccttggtgccagaggaatgacacagtgatgatttcccttggttttctttttgccacatacccgagactgggtgctagagaaacaggcaacctagaaaggtcaacaggcacagaaaaagaaagtcttctagccagagaaccaggaaataggcaggtcagaacagtgttcgcaagccagaacactcttagaaagtaaccattctactgtagccaaacatcacagaaaaaattgtggctctgcttccacaatccccaggcagtaatgaagtagcaccctaccaccaccatttcccttgttggagtggagtgagaggaagccaactaaaca

SEQ ID NO: 45252 - DNA, 1069 bp, Homo sapiens
tcaaaaaagaaagaaaaacacccaatgagctgtcactacatacctgtcagaatgtcagaaaggctaagatgaaaaatactgagaacaccaaatgctgaagagaatgtggagaaaccagatcactcttacgttgcatgtgggaatgtaaaataacacagccactctggaaaaatggcagtttctttaaacactaaacatgcagctaccatacatcctagctgttgcacccctggacatttatcccagataaatgaagagttaggttgactcaaaaacctatacacagatgttcatagtagttttattcagaatggccaaaaactggaaacaggctagagacattgggttgaaggacactttagtggctgcatggttacagtgtggtccatctataccatggaatactactcaacaataagaagggggaaactacagatactatacagcaatctggataaatctggagagaactatgcttagtgaatcaagccattctcaaaaggttgatcctgtattatcccatctgtgtaactttcttgaaatgataaaaatttttgtaacaatgtactaataatgtagttttgtatgaagtcactactggggggaaactacataaatgttacacgggattcttctgtattatttcttacacctgcatgtgaatctgtaattatcttaaaacaaaaagtttaatcaaaaaataactgtgtacatccaacttaaactgattgagtcctttaacaccatgatgacagttttaaaaatgagaattcatcaggaagaagcctcctaaccacaataaaatactaatgttagaatatggaatatggctatagaagcttgttggtattttatgaattcttgaagaatacagattttcaaattactagatttttgctctgtatgttgcgtttctgcacagggcaaacttttatacaaatagttccctccatatatgtttagcatatgcctagcaaataataattaatgttgagatttttattatgcatagactttattttctttctttttttttttgagatggagtgtcgctctcacccagttggga

SEQ ID NO: 45253 - DNA, 1048 bp, Homo sapiens
ctggctattagtaataagaatctcacagatttattttatccagtgtattcattttctattgctgctgttataaattataagtgtgacttaaaacaacacaaatgtattctattacagtcctagaggtcagaattctcactaaaatcaaggtggtggcagggctgtattactttctggagattctagggtataatccattttcttgcctttcccagcttttgaaggtggtccacactctgtggcttgcagcttcttcctccatctttaaactatagaatggccacttgagttctttttacatcacatgaagtcactctgaccagtctcttcaccctccctccttccccacccagataatctaggataatctcatctcagtgttggctgataagcaagcataattctttctacaaccttatttatttatccagctaacagtcttactagagtttctacaactttacttctcccttgccaagtaaaatatttacaatttcctgaacacggacatctttgggagccattaatgcatgtttaaagctcacaatgaagctgggtgtggtggctcatgcatgtaatcccagcactttgagaggcggaggtgggaggattgcttgagcctaggagtttgagaacagcctgggcaacacagggagaccccatctctgcaaacaaaaaattagcccgtgtggtggtgtgcacttgtggtcccagctactcaggaggctgagatgggaggattgcttgagcctgggaggttgaggctgcagtgagccgtgatcacagcattgcactccagccttggtgacagaacaagacaccatctcaataatttaaaaacatgtttatatattttttaaatatatataattttttaaaagctcacagtgaaagagttataatccatgggttggcaaaatgtgaaagtctgacatcaaatgtttggatgttggcaaggttgtaaagcaaaagaaatgctcatatatactactggaaggagagcaaatgggtgcaaccactttggaaaacagcctgcaatcccttctct

SEQ ID NO: 45254 - DNA, 1052 bp, Homo sapiens
gcgggtcacgaacgctcagcctgcggggccgcgcggcgcgcgcccgcctcaggaccgccccacctcctgcgcgtgcccagggggcggggcgctgctgatcagccaatcagcgccagactccagggaccgcccctgaagtcttcttagggggcggctctggagggggaacttcgtcgggggggagcggcggctggctgtgggtgtggaaaagcgggcgcgccagaggggctgggaaggtgggagcagaggggctgggaaggtgggagcggaggcgctggccccgactcctaagctgtgcggaagtgaaaggggcgggagcggcggggaagggcgctggccgcgcgtgagaaccggcgcgggcgagccgggggcggggaggcgccgggagcaggtggtgcagcccgaggtgtgcgggaggggctggcatgtcctggagatgggaaaagcggggatggatgtgctgagctaataagcgtactgccagagctgtcaaggtttatttatgcaggacagagaacttagagaagttattcactgactggtggacacacgttctaagattttcctccgttcggtttaagagaaaagtgcttacatgtttctgatgcctggtgatatttattaaaattgaaagttggtcacttgatattttatcatagggttgggagaaagaggaacaaaaggcatttataaagcaaaagccatttctgcaatgcactctattaaaaatttgagaacgaatgtgtttcaacaatcggatgcattgaattaatttgtaggagggtagagtgaggcttgtattggctgggagattcactgccaggtggtcatgcataagcccctaccccaagctctcattttccctacctgcagaattagaccaatgaataccccacctgtctcaccgcatgttttgagattccgcgtgtgtgagggagggagggctggagcgcaggccggtgccgtctgggccgccctctctcccgggcgtgctctggaccgtctcgtcccctccgggcgcgtcatcctgctttcggaacccccgtgtcctg

SEQ ID NO: 45255 - DNA, 1028 bp, Homo sapiens
tgtttgttgggtacctgctacctgaaagatgcaatgctatgaattgtcaatatagtgatgacatgagaagacatggtaaactcacacaaaaactagagctactgtaaggtcataggtgtgatgcagtcggtgccaggaggagtgagagcttaggacttggggattccgtcagttgggtggggtattaccccttaggaagtggctttagcattaccatctgaatgatggtagaagaaggggtgagggcacttcaggcagtgcccctcacctgcagggaggctgtgtgtttgaggcattcaactgcaagatgagactcgaggcaggcagtatccaacttggtcagggctttcaggatatcaaatttgggatttttgaaaaaagcagtaggaaccactgatgagtgttaagcagcctttgacacgagcagagtagtgttttgaagaagattgaattggtgggtgcagagaggacaataggttgtagacaatatcctgcctgcttttgttgtggtctgtgggatggggaaatcacaatgatttggactagattggtggtggccatggggatggagagaaatggacagatttgagagatatttaacagtttcaacgaataggacttggggatagatgcgctctcaagagggagatctcagggcatataggtttctagcatgttccctgcttggctggttggctactgatcctattcacagaggcaagaatcagatctgctgaagatttgagaaggaagctcatgagttcttgtagcatatgactgaggtagctgataatggaccatgatgacattgttttatcctttgcattgctagtggcattccagaactttaaaaaaagtaatctgctagctttaaccaaaagatattggacgtggggagttcatcaaggaatgtgaatgggttcagtgaaatgggagaggggagggaagccttacttgctgaatacatagcactttgcttgttacttgcctgatacatagcactttgtaggagtttgctcattccaggt

SEQ ID NO: 45256 - DNA, 1047 bp, Homo sapiens
ttttcaccttcacaaaatgttagaagcttaccatcttagagtaattataactgctgatgattgttctggagtaggtgtatgttacttaacaggttgtggagcttgccagttgatgctatgttgagagtgtgctgacctcacaagaactaagatttcatatatatctcagtccaaactagaagataaagacaatattaagccccaaggcatcagcaccacggaagattactacatttggcctaacacaatgagacgatgccatgatgttaggtgactgaatagttggtagcaactattacgttgctcattttaggcagcaacctaaaagtcctgcctggttgggtgccggctggtgcccatttagccagtcacatggtctgtcaacatgcagctttctaatgccaggtctgctgttggcagccattggaggcagtataacctaacagttaagagtgggtcctgcagttagaacctggttctaatttagactcctcactgtaccatagtattttgggaaagcgacttaagttctgaagagggcccagtgccggacacacacactgtaagtgcaatgaggacgatgatggcagtgagacgtcaggggtacagctttggcaggttgtcactgcctcagagcacggtgcttctcacaagtggcacgctgctcacagagcacaggctgctcatttgaattctgtctcaggttttgagctgagtgaggttgtgataacgttatgtttgagttggaaagtgaatacaagatacatgctgacttatacttgatgcaattcagaatctgttatgtgaaagtaacaggtagcaacaatctgaccaactcagcagactgtaggtacaatttttaaaaaaagattcacaactgatacatcttcgtgagcagcagcaacagtttagtcactgtttccaagagagagctgtgtgtaaaatgttcacaggttatgtagtactgagtgtgcagtaaatggtcatcatggtagaagagatcccggctcagatcaccagtcttttcagtcacatggattcattcat

SEQ ID NO: 45257 - DNA, 1040 bp, Homo sapiens
gagggttcctggaggaattagcttttgtgcaggatttaaagaatctactataaccagagagagcggtgataaaggtcgaagggtggtgcgtaaagcagccaagttttgtatttaggaaccaggaagaatttggtctaggagaaatagagaagacatgaagatgcccaaggagggctttttgaatgaatctgggattatttttacactgggaatggtgacagctgagctgtgctttaagtatgaggtattcgaaatcacacctggctttctccccaaccattctgcaagtcacccaggaatacaatcgccatttcatctctgactttctctcctgttgcaatcctctgtatccagaatgttggcaaagtctgtagattttatctcccctcattgcctctcacatcctgcctgcatttcagtgtctactgccttctcttctggactcctgcagagacttctcagtctctctggtgcctgcatcttatcggctcacacttctggacaaccagctttgcatttaacccttgaaaacagattgcttcccttcacctgggatgcaggcctcccctactgcctgcctacatttctaactgtaggatctgctcttctttaaatatagtccacaacaggcctacctggattattcgtgatccctaaacactcagtcgtttccctcttccatgcctcttgcttttgcttcgccctatttcaagtacgattttgtccactcaaactcagctttgcctgtcgaaattctgcttgttttcaggttctgtttcaaatactacctcttctgtaaagccatttctgactcttttcaaccgaatgcaacttccttaccttatattgtcctttcattctagttatatgggggcacatgtccctatgtacataggctgtgcagccagtaaacacacaagtgaggtgcagaggtaaataaggcagcatcttacgatgccctagtggctcgcctgtctctgtggagacgttgctggcccttcctttcctggggtgactcattgctctgtttctcctctctc

SEQ ID NO: 45258 - DNA, 1052 bp, Homo sapiens
gtataaccgtagtttttcagttgtttttttctcccctaggtaaaactggtggtctttgaaaaaagcctgcacctcagttatacctcagttatgcaatctgcttctcctctacctcgaatggaatggttactgacatttaaccactatctagaaggaatgtaggaatgatggcatagagaacacatctctgtatagacgggctactcagagccatttgggggaagcaagtactctgctggttaaatgcaaaaaacctaatatagttgacaatatgccagaaattatgtaaatgaatgttgtttccttcaacatagtgaccttggagacaggacaccacattcagtgataacgcgaatggttagaacgtttttagaatgccaccttatttggagttgcttcaagttatgactttaagtttactccatagattgtgtttggatgtactgttttaaagttgtaaggcctcaaatgcttgttaagttttcccaattatatctaaatatagttgactagtctgcgaagaccctgttgcatagtggagaaattgtggacacattttttagcaatttaggatatttatcacacaggacccagcaccatgcagagcaagcataattctcagagtcagacctgggtcctcacctccgctctgccactgactggctgggtggccttgaacaaagcatttgccttttcactatttctctgtgaggttaagtagttggcttaggtctcaagtcttttagccctcatgttcaatgattcagagattctagaggcatgacagcaggattcccttcattatctggggaggtagttcgtcgggggtttgctccacagccttcctgtccctttcagccagcctgtttctggcctaggaagacagcagacttcgtgtggttgtgattttttaaaggcagtgtttaattcttattacagcacaagagttcagaacttgggtaacagcatttgagtattgtagatcatcagctcctacagagataccctgtatgtttgaggttaaactgggagcaaggaaagttgggtgacta

SEQ ID NO: 45259 - DNA, 1020 bp, Homo sapiens
atgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttca

SEQ ID NO: 45260 - DNA, 1031 bp, Homo sapiens
ttccagagagctctgtccagtggaattttctgggatgatagaagtcttctttttggtgtccagtatggtagcctgtaggcccttgtggttaggaagcacttgaaatggggctagtatgacagaggaactgaattttaaattttaattttaaccaacttaaacagccatatttggctactgactactattggacagtgcaattctagaatcataattggtagagaagtagtcttcaaacttttttgtctcctaagagaattttaaaaaaaattctctttttcagtttgaatacatgcattaaaatgtgtttgtcttcatgacaattatctcactaaacaggcatttgtcacctggatgaaatgaaggactgccctcttgatatttattaactctctgctttgctgccaagtgactcttcctaaagaggttggtgtcccagaggtttttatactccagggcaacacactgtaataatatttgggatgagtgaaagccattttggtaaagagaagtgattgtaaaaaggaaggtggaaagggggacttttagaaaatagataccaaagatgacagtgttagttctgatagaatgtattttgagccactctgatttgatacttagataccagaactattctagttaataaaatgaggcatgattagtataagaaagaacacttaaccttcctgctactaaggcaggtgggggcattcatccagattatttaatatgtgagacaaatatgttcaggtaactgcttgtctgtttataattgttttatttaaagtaatagttctcaaatgttttagttttgaaatcctgatgctcttaaatattgagaaccccaaagagcttttgtttattctggttttatctgttgttatttaccatatcagaaatgaaaactaggaaatttaaaaaatacatttattcatttaaaaataataataacccccttattggttcattgaattatgccaatcttctgatttttgtatacatttttttttgaggtggtcttactctgtcac

SEQ ID NO: 45261 - DNA, 1052 bp, Homo sapiens
ttaacctctttgaatgccttcatttccccatctgtaaaatggtgataacttcactggttgtctggaacagtgctgggcacagaggtgctcagtgatatcacagcagtggcctctttacaaaggcttaatgaaggaagtcctgctgtgctgtctttatgtgaaaggataaatatctcactaggaaaggggaatcctaggtagaaaaacaatttcagatgagagttgcagaagattttaaagtatacattagttatttattgttatgtgacactttacaggttgactatctctcattcaaaatgcttggattgagaagtgctttggatttcagatttgtttcagattttggaatatttgcattatgcttatttgttgatcatccctaatttgaatatctgaaattgaaaatgctccattgagcatatcctttgagtggtatttcagtactcattaagtttcagatttcggagcatttagatttcagatttttagattagggatactcactctgtaccacaaactttatggcttaaaacaatatctatttcctctctcagtttccgtagatcagagtttgggcatggtttagctgggtcctctactcgagcctcacaaggctgtagtcagacgtcattaggactgtgttctcatcttgactggggagtcttgactggggaggaatccatgttcagattcattcaggttgtccacagaattcatttcctatgctatatgacttgggtggggggcttcagtaattgctggctgttgcctggggccaccttcagctcctgaagtctgcctgaagttctgcaccatgttgggttccctggcaacgtagagttcccaccctcaagaagggtccccaccctctttaaaagtgtcccccagtcagacctagccagaataattgccctttaagtaactccaaaccaattgatttggaaatcttgattacacgtgaaatccttttaccttcgctgtattctgttggcttgagggtcgcaggtccctccatagtcagaagatagagataatggggccatcttgga

SEQ ID NO: 45262 - DNA, 1026 bp, Homo sapiens
tcgtgttacccaggctggtctcgaactcctggcctcaagcggtccacctgccttggcttcccaaagtgctgggtttacaggcctgagccaatgtacccagctggtgactaattttgaagaacttaaaacatttattaataattcttcattgaacttgaacatttattgtccatcagtaaaacagaattcttccctcttcctttcctgctaacaggtctcctctttctttttcaactagaagagtagggtaaagaatttgtggctggggcttaggagttgagggtggcgaggcacctgcttggagtgaagcatgtgggtgccaggccagacgcctgagaaccaagggtgcctgaggctgctgggtgcaggattgcagacatctgggcagcgcactgagcactagtggggccttcgccaaaagggtactggatatcttggtgtgaagttgttgacctctgggtttattatctgccattcagagtttgatttgtccccttcctcattagtttattctgttgtccgcgttttattacattctagtttagctgttaaattttagtcttagaactttctttaaaatttttattttgtggggttgattttactctatgatgtaccagattttatgctgctttaattggctttttagaacttcatactttatcttttttagtttgcctttttgtcttttaattttctttttcattgtctaaaaaacttaaccaaatagtagacagggcttaaaggaaatgctctgctcttaagttgagaggctagacactctcctctgccagtattgagcccttggcctctaccatctagctgtgtattttagtgtggcagctcagatcattttagagttgtattttgtcacaaacaccctgcatcacattctgtgtggcatcccatgccacaaaaacatctcttttacttcttatccattaggttcatttctttattcagaagtcttttcaggatataaagtgtaagaatatgctttaatacctttcagtctttaaaagatta

SEQ ID NO: 45263 - DNA, 1014 bp, Homo sapiens
tgaaatattttacatgacatatgctttattctaaaagcctatagatatcttggcttcttccttttgtagtagctgagggtaaaaacatgctgtttaatgcattctgtcagcacattttcctgagaacttacaaacttcaataaataaaatttttgaaggtttttgaaatacagcttttgtttttcacaatttattggaatttgaggctccctagaaatattttttaaaaaatcattactgaggttggattattttcagtgttggataacaaatagtaattggtgttagaaaatttgcaactgatggccgggcacagtgactcaatgcctgaaatctcagcactttgggaggccgaggcaggtggatcacctgaggtcaggagttcaagaccagcatgaccaacatggtgaaagcccgtctctactaaaaatacaaaattagctgggcatggtggtgcatccctgtaatcccagccacttgagaggctgaggcaggagaatcgcttggacccgggaggcggaggttgcagtgagccaagatcacgccgttgcattctagcctgggcaacaagagtgaaactgtgtctcaaaaaataaaaaaaaaactggagctgatttggaaatagaaatggaaggtagcgctaaatgtacataaagtcaggtaaaggttctagaggtaatggcaaatgtaaaacatttttttcttgaagtttatgtcttttgtcttatataatattcaaattctaataacatttgtcagcaacatactatgaaacatgcactttattagggttgctttactgtatttttatatttcagagaactgtctttcaaaaaaagggctaattgtgattatctcaaaaaacacgtagcaccaaaataaagcttatatttaattaagaacacagtacctactaaaattatgtacaacaggaaattgctatgtatttttattacattctaaaagattataagttgaacaaaaatgtaactggatggtataaaagaggatacc

SEQ ID NO: 45264 - DNA, 1050 bp, Homo sapiens
gtcaaaagaatacttaagtatgtaaaactatccacaaaaggcacaaagagaagatcatgatatcgtttttcatgacaattaaaaaaaagtgttctgtaccttaaaaattcgatagcaaaactacttcttaatctgattttttattatggcttgatatactggcaggcattttgcacaaatgtactatgtgtggtattagtttttgcatgcagtttatttttaattaggtcatatatttgctaaaagtcattaatatggagttttgccaggaaaacttaattgggagttgcatttaactgtaaatagccaatatgtatggatttatcagttgtcattgatacttttgggatattaatgtgggaaatataagagacatgcagaaacacattaaaagtgaacactaagcgatccactttgaattctagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcaggtaatacaattattgtgattcccgagccttggttatttggcatgggtaactttagccatgtatgaagtacacaagacctcccctatcttgttatagagatgctcttgagatgtctttattgtagtctggaacattatctccatagcgatgtagggagggggagcgggcgtggaacaagaaattatactcctgacaagagtggcttggttttgctatctttgactctataattaataaggcaaagattcttcatttatttctgtaaatgtatattttgctgtttatgttattaacattgttaatatactggctcatataaagcttcattcacatttttaaatttctctaaagtttggttgattgtcacttttttgaattttgcagaattaaaaatcaagatataatttgtagtagcctgtctaaagtttctgacatctggcactcaaagttgagatatagtcatgtaatctaattcatgtaata

SEQ ID NO: 45265 - DNA, 1050 bp, Homo sapiens
ttctattgtatttgttagcactgtgatcttttcacatcatatataggattagcattatcaccttttccttaagattaatttaaaaaaattcatccttccactctgcgccattataaagaacatttttctttttttttttttaagacgcagtcttgctctgtcgtccagactgcagtgcagtggcgaaatctcggctcactgcaagctccacctcgtgggttcgcgccattctcctgcctcagcctcccaagtagctgggactacaggcacccgccaccacgcccggctaattttttttgtatttttagtagagacggtgtttcaccatgttagccaggatggtctcgatctcctgaccttgtgatccgcccgcctcggcctcccaaagtgctgggattacaggcgtgagccactgcgctcggccacatttttctttttaatcattaatttcaaggccactgtcttgggtttttgttttagaagagacggtccagcagacaggtgaagagaaagcgctacactgaagacctggagttcaagatttctgatgaggaggcagatgatgcagatgctgctgggagggattccccctccaacacctcccagtcagaacagcaggttagtaccagatctgtgggatttatggatgcattttaaagatggactagaaatttcattgctgcaatctgagaagtgcagtggaagcattggactttcagcaggggaacatccacctaatgttggataatgtgctatgggaaattcgttgtttagcaatatcttttaaaaagccctgttcactgcaatttatttttatataagactgtgatatgtaatttgacacaattttggagaattaatgttctatgctgaggaagagtcagagttggaatataaggaggctgaatatacctctgagaattcagtgctgtggcttctgggactttaataaaccactcaagcttgtctcctgctgttaggcactgtgagaacccctttatgaaattactgccttgtagtacccagcagggtgtactttattctctgtgc

SEQ ID NO: 45266 - DNA, 1045 bp, Homo sapiens
agaggactgtccatggatctgtctacctgacacagaaatcgtgttctaatacctctgttttcatgcctgattcctatactttgcatagggtagatgagtaggagtagaacaatgggtgtctagtgagaggctctggttttaagaaagtgtttttgttacaatttggttagtggctttccttgtgttacctcaggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtatttatcagctccactttgtatttcagttataaaattgaagattagcccatgaaatggcaaagtattaagttattttaaagtgtgattatattacagtttttcccacctagtacacagaaccttagataccctttccttggactttccaggtcatcatcataaaggttttcttctttatttgtttgtctttttgctcttgtgaagggctgttgagatttatagagaggttacatacctgttgatgtaattttcagagatagctgtgctgtgcaggttggtagttttgctaggtatgtgtaattttggggatgatgtcagacgccactgacgttggtaggcctgtttgcctgctgcagttttgagtctctgttctttgtgaagcatctgtactcagccacaccgcttacttcttcaagcctacgtattttcactttagaaacttagggcataaccactgcacagtatttctgtgagaagtaaatgaagcattgtgtataaaaagtgcttgggccaggcgcggtggcttacgcctgtaatcccagcactttgagaggctgaggcaggcggatcacgaggtcaggagtttgagaccagcctggccaatatggtgaaaacccatctctactaaaaaaaatacaaaaattagccgggcgtggtggaacacgcctgtagccccagctactctggacgctgaggcaggagaat

SEQ ID NO: 45267 - DNA, 1062 bp, Homo sapiens
tttattgtaacagtagttagaattcccaactggtagagaaaaactatatttgtgtttgaatttgtgtgacacccctttgcacagtcaaatgaatgcttctgcagtaactttacagggctttgaagccatttggttaacataatctaagttgttcagatgcttctggttcagaggtcacctgaagttaaggtgcttgtgtataccttaaggaattatgccagatctagagttacatgttgattattaataattaagaacaaagtgtcaaaattatgtaatcttttctcactttacaagctttgcataaaatttatgactgtcgtaagcttttaatatttctcttataaaaaattgtcaaaggcagtaatctcacttgttaaattcttccttgcaactcatatgaaacatgaatggtcatttgaactttgtgaaagtgttgtatttttcctgctggactataagtttctgaaagggaggatccatgtccaatttatctctgaatcactgtgatgcccaaagtggtactttgaatggcagggtgctcagtaaatatctgaattggtcaataagagttctctagcagattgtgggactacaggcaactcctgttaaaaaaaaaactgcagctagagtaacctttctacagatctgatgacgtcctgtcttggatgatttcttccaatgaattaccattagtttcagagtaaacacaaacatatgctgacatggcatccagagctcttctgggaccttgtcttctgttggttctttcccatgggtagtccaagcttctgttaggacagacggcttcatctccttcagtgcgccacgctccatctcatctgtgtctttgcacaagctcttcccactgcctagaggaccccccacttgcacctccgctgggaggtgacctacctcccttctgctctccgtgggtgtccgacgcaggcatcagcttgtgctctgcaactgagtctggcctgcacttcccatcacactcatcatgttgtttacaatttttgagtcgcctccctctttcagtttgcagctccttgaggatgg

SEQ ID NO: 45268 - DNA, 1034 bp, Homo sapiens
gaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagaca

SEQ ID NO: 45269 - DNA, 1091 bp, Homo sapiens
ccttttattagtattagttgatttttcaaatagattatttaatgagattaaccataacatggattcattcatctagtgtacctatatagtaagtgagtagtgagtagcagttgcagatttatggcacaggagagttcttcttcagaaagtataggcaccagaaactaggttatgaaatatagaataaagatttgaaggtgaccattatttgtatatattatggttaggttttttgtgtgtgtgtattgaaggaacttaatcttttaatgtcactgctatatcttcatagcttaagctaattataaaaggcttaattagctagaaatttgggtatttggaggagggattagttacctgaaattgcctgcaattttgggtcaaatgtagtgttttctttttttaagacattgcagattgaattcattgataactattgaaaattttaacataccttggtaatgtcggtgatagaattaaggagtttataaacatacttgctttataaacacagttacttctgtattgtagacatggacagttttatcaaatcaagtaattggtaactggtggctttgagtatttgtgtacaagcgtaattccaatttaaacattgaagaacaatgctattaggtatctgtatgccatttctgcatccatttctgtctgttactaaaaataagccactgatagaaataaatgaaaaaatacattttcagtattcaccagtttttttagagagaacattgtggaatgaaactgtttgttttgctttaaaaaagcaaaaaatgctcaagaactttgggtcttaaaattagttctgtagttcttatttatttatttatttttgagacggagtctcgctctgtcgcccaggctggagtgcagtggtgcgatctcagctcactgcaagctctgcctcccgggttcacgccattctcctgcctcagcccggagtagctgggactacaggcgcccgccaccatgcccgggtaatttttttgtatttttagtagagacagggtttcaccatgttagccaggatggtctcgatctcctgacctcatgatccgcccgcctcggcctcccaaagt

SEQ ID NO: 45270 - DNA, 1106 bp, Homo sapiens
tgggatgcaggattatttttaggattatggagagtggtggttgtgttcaacctcatctacctcttggttacttccccttaaccaccccttcctatctactgagcaacattcctagcatacatgggaggagaagaaataaatgggaaagaaaaaaactttacgatctcagcaaaattacttttccacgtaaagattatgaaagtagatcatttgttgtgaaatgtagtgcaagttttaaaataagcgtgattttactatattctggctcacatagtaatctcagttaacgcttatggcagtatggcagtattttccaactttgctgagaaatcttaatattaggaggtgtaataaatattccttcaaaaagatgtccatgtttagatagatttgagaaattttggaggctaaacagttgaactgttttttttgctacttgatttcatagtttataaattataattgaaaatgaagttcttaagatgaagatatagtataaaaaatcctgacttgttcaaactcttattttttttttttttttgaaacggagtctcgctctgttgcctaggctggagtgcagtggcataatcttggctcactgcaacctctgtcgcccaggttcaagaaattttcctgcctcagcctcccaagtagctgggattacagacacatgctaccacgcctggctaatttttatatttttaggagaggtgaggtttcaccatattggcaaggctggtcttgaactcctgacgtcaagtgatccacctgcctcggcctcccaaagtgctgggattacaggcatggaacaccgcactcagccattcaaactcttttttaaggaattttagtggactgtaaaagacagttttggaattgctacctgagtaatcttcttgcatgttttgcttgataacagatattttacaattctttattatttgtcacaaggacatagaagggtttctactggaggaaaaatttttgtcaggaggatttctggtattccatagaggcaccttagtgtcttcctagggaaaaccagcggagggtgcctgaatcccaccagtgtagcaactagcactgtggtttgcgttttatctgtt

SEQ ID NO: 45271 - DNA, 1048 bp, Homo sapiens
atagatttgttttaactcatgatatttggaatcaacatatttgtatcctgtttgaagagaagttgtaaagtttgattccagtaaggcctgttctacctctcctttgtggtactaaatagattttcagcagtcatctttctttaatattaaaaataattatctctaacaagatacatatttacattttaaagaggattaatactgtagaatgttgaaaactgggtttattgaaaattatctggaatcttaaaggtaagtcgtatgagaatttaagtactctcaattatctagctagaaaattaaataaaatgtttggaccttttaaatagtgctattataacagattagtgaaaactggatttattgatgaaagatctcaagaagatactggcaaatttagagttacacaactatttaattaggtcctcatacactgtacacagtgtgttttaaaaattaaattcatttatctgattttaaaattataaataaaaaatattttgatggaaaagtgtttaacaagtcttttgctaatgatttaaattgctttgtatacttagatctagttcatatcaaacccaagggtactttaaaacaagttgttggcctttctacttatgtggcagcatatttcttctattttgtagtgttcagtttctgaaggaataatgttcatagtaattttgaaagtaaatgtcagtccttcatttcttttttttttttttattgatcattcttgggtgtttctcgcagagggggatttggcagggtcacaggacaatagtgcagggaaggtcagcagataaacaagtgaacaaaggtctctggttttcctaggcagaggaccctgcggccttccgcagtgtttgtgtccctgggtgcttgagattagggagtggtgatgactcttaaggagcatgctgccttcaagcatctgtttaacaaagcacatcttgcaccgctcttaatccattcaaccctgagtggatacagcacatgtttcagagagcacagggttgggggtaaggtcacagatcaacaggatccc

SEQ ID NO: 45272 - DNA, 1029 bp, Homo sapiens
gaatcttctcaagactgtgagcatttctccattttttccttaatgaaagtacaaaatctaatggttgaactggattccatcatatagataagctgtaattcctctattattcggcagagttgtctagtttatttaatccttgtgtgtaagtgattgcatacatcaattgattaaagtacagctggctgtaaatggtaattttgtgtccacaaagtttatatattagccttttgtagaaattatgatatttttaaattgtgacagagggcctggctcttcaaacaaaaataatactcattatacccccactctcatccctgaaaaaagccatataggttagtttgtaagaaatattttaagatgtgactactcatcagcaaatttttctgttgataaaactggatttgaaattttaattttgtttatctagaataggtacatcttttattttcatttacttaaaacttcttgattttaatctttcagatttctttttttgctcttttaagaggacatttcgctactgattgtgatattttgttttgcagagtaacagctatccaccaatgtcaatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaa

SEQ ID NO: 45273 - DNA, 1048 bp, Homo sapiens
ttgtgatgccctgcattgggaaagtatagcttatattccccttgaatctgcctgccctgtgaccatttaaccaacagaatggaatggaattgacatttgcctcagtggctcaaagctttaagatgtctggcagcttttagttttgcagttttggaaaacctgagtggccatataaaaaatctagcttcctgttggagagaccacatgacattacatggaggccaatatcgatctatcctgttgtccaaggaaaggccctgaatgacttcagtctcatcccctcctgactacaaccaagtgagaaaccagcagaatctccctgctaagctcaaactatacaagtatgagagataataaaatgattgttttcttaagtgcctacagttttgttgtggtttgttacatcgcagtagaaaccaaaaccgaaattgtttcttggaagtggagtgtggcttaatggtaaactattacatgagagtttgactttgggataggtagaagctggaagggcctcgaggacaattttagggaagcctgttaggacaggaaggaacttgtcattaggagaaaaggtgactcatgttacttatgacagaaagcttggtagaaagttggaaacatggaaaatagaaaatataactaatacacttatggtcctagctctttgcatatatccactatactcccctgaacagcttgttaagaatgggaacaatattcctattagtgaagtgaggaaatcccaactaaaggaagttaaatgtctgtccagtatcatatctggtaagttgcggagagatacttttaacacaatttggctaaaggaatttttcaggtgaaagaaaaagtaccaatggatttcttttggctgcgcatgaaaaaatagagatgaactaaagaagaaacagtttagtttttgagcagaacttgaaggaaatatttctaagcaggaagctgttagagacttggttggtgtgtctgtatgacaagaaagtgaggaaagttatgttgttggatgtgaaaggcagcaactaggccttctcatata

SEQ ID NO: 45274 - DNA, 1094 bp, Homo sapiens
ctttgggcattaacaacagcagcattttattatggaaatcttcaaactgtggagaaattgaacgaaggatataaggaattcactgtactcattacccagtttcagtaattatcaatacgtgggcagtcttgctcccctaatccgggttattttgcgtttttgagacagggtctctgtcacccaggctggagtgcagtggcgggatctctacccactgcagcctccacctcctgggccccagcgatcctcacgcctcagcctccccactagctgggactacaggcaggcgccatcacgcccggctttcccccccccccccctttgtagagatggggtctccttatgttgctcaggctatctttgaactccttggcttaagcgatcctccctccttggcctcccaaagtgttgggattacaggcgggagtcatcgcacccggctatcctgggttattttgaagcaaatcccagacattatataatttcaattattttacatatttctatgcctctgtcatgatgaataatcatacatataataatttgctttctagaggggtcaagtaaaataagggacatattaaagtgtagacagtgctcatttagtttgtactaccagaatttaggtaactgctacagtgcagtttcattatcttgtgctcaggttttcaaaatcagagttaccagataatctagacagtagtgctcttgcttttgaatagtaataattgtattgataatttctatttgtcgagttcttagtatgtatgaaggactgtgaagttgtttccacctactcatttaatttttgcaataaccctatgaagtaggtattattatccccatgttagagttaggagaaagaaatttggagaggtcacaatttacctgaagtcacactgctgaaaggatgggggtgggggtagaattcagaatgctactcttggcctttgtcattgcaaagttcttgctcttttaactgtaacaatgtcctaggagttgtggaataaatggaactgctgtggaaaattatttctgttaagccacaaatcagtaatggaaaaaaaaaagcctgaaaatttacacaaatacaa

SEQ ID NO: 45275 - DNA, 1019 bp, Homo sapiens
ttagaatgggcatatttaatttattgaattaattttaaccatttccctattgatggtcatttagattacctttggattttctctttcacagtaatgtttcagtgaatacccttgccagctttcaaaaactaaacatctttctccttggagaaaggtataatttactgagttcttccattaaagcaatttttttgtgtgttgtgttgtgtttgagacagtttcactctgttacccagagtggagtacagtggcgcactgatagctcattgtaacctcaaattcctgggctcaagcgatccttctgcctcagcctcctgagtagctaggactacaggtgcataccactgtgcctagctaatttttaaattttttgtagagatggggtcttgttatgttgcccagggtggtcttgaactactggctcaaatagttctcctgcctcagcctcccaaaatgctgagattccaggtgtgagccaccgtgcctggcctggcaattttttatacacataatatgcaggggacagtaactattacacaacttatcaacatcaactttatagtgatttttcatcacttccttgggcctaagggcaacatttttagtcattgttgactgccaagtactttatttgcttctactgatgtccagcccaggatcacttaagatatttgaatagtgttttcaaaagattattttaaaatttatgcctcagtacttaattcatctgcatgtggctgcttaaaatattctgtgtcaatcactgtggggttatatttcagagattctcacatgaaaatgtcagcctttagttcaaatatgaatatgatctctgtctctaacttcttttaaatcataaagataacatctaaaaatgtccttcagaagtttaattttatatctaaattgcattagcttgaaagaatttgcgccaagtttgattagcctgtgttcatggacctcttatcttactagtttttgtttttgttgagagatgtggtagtataggtcatgagatt

SEQ ID NO: 45276 - DNA, 1035 bp, Homo sapiens
tgtctttactaaaaatacaaaattagctgggcatggtggtgcgcacctgtaatcctggctacttgggaagctgaggcatgagaatcacttaaacccaggaggcagaagttgcagcgagctgagatcacgccattgcactgggtgacagagcaagactctgtcttaaaaaaaaaaatatatatatatatataccatatatatatatatggtagtgggttgatgtagggttgacaactaaacattgtgacaaggacatttaaaaaaaaattatagccaggcatggtggtgcatgcctgcaatcccagctactcaggaggctgaggcaggagaatcgcttgaacccaggaggcagaggttgcagtgagccgagatcacatcatttttctccagcccgggcaacaagagtgaaactctgtctcaaaaaaacaaaacaaaacaaaaacaaacaacattcatctactgtccctgtatcataaaaggaaagtagcgtttacaccataagcataggaaggacatagtctcaaaataaaggacattaactttattctttaatttttattttttatttttgttagagccagggtcttgctctgttgtccaggcttgtgtataatggtgcactcatagctcactgtaatctcaaactcctgagttcaagagatctttatgcctcagcctcctgagtcagtaggactacaggcatgtaccaccatgcctggctaatttttttttttttttttttgagatggagtctttctctgttgcccaggctggagtgcaatggcgcgatcttggctcactgcaacccccgcctaccagattcaagcgattctcacgcctcagcctcccaagtagctggaattacaggcacccaccatcatgcctggctaatttttgtatttttgtagagacgaggtttcaccatgttggccaggctggtctcaaactcctgacctcaggtgatccgcctgcctcagcctcccaaagttctgggattacaactataagccaccatgcccggctgcctggctaatt

SEQ ID NO: 45277 - DNA, 1192 bp, Homo sapiens
tcaccatgttggccaggctggtcttgaactcctgacctcaagtgatccgcctgcctcagattattcgttttctaccaactttatatttcaggaaactaaattaccagttttttttccctggattctaggacaatagagtatgtttttttacctttcaaggttgttctgtaaactaaaaagatgagggagggtcagtagaaatcattttgggaatagggcacatctaatttaaaactgtgtcagattttgagtttcccttacctgtgagatgaggggacaggaccccagaggtgtattatatttaacttagggttctttgatatgggtgaggagctaaaaaggcctttgcatttatgtaaattgtgctacaaaagtggcttcccttgacagtaacaaggaaaaaagagagctagataattcagtgtagtgttattctaagtaagaacctgtgtgccttagggaattttggacccaatataaacaaaatataaccaaaacaaatgaatgaaaccagtagaaatctcactagcagaaattggtatccagaaaatggttttaagaaacatcagttaactgttaaacgtttaaggtaatggaaaaaaaaaaaaaggaaaggaagaaatatcaggcctgcataatatataatcccaacactttgggaggcttgaggccaggagttcatgaccagcctgggcaacattgtgagaccctgtctcttaaaaaaaagagaaaagaaaaaaattagccaggcatgggtggcacgcacctatagtcctagctactcaggaagctgaggcaggaggatcacttgagcctaggagttggcagtgtgggtaacagagcgagatcctgtctcaaaaagagaaacatcaccctttggctgtttatcttctgtttttggtacatccatgcttgatgtctctggttttttttttttttttttttttttttttttttgagatggagtcttgcattgtcatccaagctggagtgcagtggcgtgatctcggctcactgcaactgccgcctcccaggttcaagtgattcttgtacctcagcctcccaagtagctgggattacaggtgcctgccaccatactcagctaattcttgtatttttagtagagacagggttgcaccctgttggcccaggctggtctttaactcctgacctcaggtgatccacccacctt

SEQ ID NO: 45278 - DNA, 1029 bp, Homo sapiens
actctcaataatcattaccaaacttatttaataatcacaataaataaaagtttatgattagctgacaaatgttcaatgataaaaaagatcaccttgactatatcatctgcttttcatgaaatgcctctcattttctggcaaacttggccagatttgtgttcccacagcacctcatgacctgccacaataccactcatcagagcatggtattatttaggtttacgttaggacagtgctgactaaactgtaatgatcctgtgctctaacagtgaaaatttttgagcatacaccacttatattaagtatatgtacttatggattattatactgaactaacatttatatgttatacaacaaagataaaaactgaaaattttaaaaatgagataaaaataattttagattcaaattctattgttttctttctctgctagaacgaatcaatcatctctttctactccctgtgttaagttcatctcagtcagagaaatcactgtctgagggcttgaatctcctggaaaactgtaagctacctggaagcagagatgcatattatttatttttgtatcgcatataattagtacacggagaaggtcaatgaataggagaagatgaagaaaattatttcctctttaggatatacaaaagcattgaaaaaataaagcattctaaagcgctgcttactaatcaagatgaacagaatgcataggatataaagcatactgcatataaagcaatctcccctccttgacatatacatgaatgggcatgggtgtctatgtcttatgaacatgtaatttattaggcagtatgcaaaggggttacattcttattggcagaagaatagacatcctgggagaatacaataatccaaaattagactgatttaaaaaattaatgtatgactgcacatgacatcaaaacattctcaggtatattaaagagttaaccattaaaaataggaacatgacaataagcaactgaattctcaaaaattctgtgaagagaaagtaactttaaaaacaaatc

SEQ ID NO: 45279 - DNA, 1023 bp, Homo sapiens
atatagtagaaatagcagaaagaaggtacctgagatactggtggcttgctgagggtaaagaggaggtggcactatcatggaggagagcagtttagtgacataaaatgtcctgaatcagtattgtatttttatttttcctaatgatgctacctctgaaaacagattctatttttttgtgacagagtcttgctgatgcccagcctggagtgcagtggtgcgatctcggctcactgcagcctctgcctcccaggttcaatcgattctcttactcaggctcctgagcagctgggattataggcgcctaccaccatgcctgacttttttttttttttggtacttttatagagatggggtttcaccatgttggccaggctggtctcgaattcctaatctcaggtgatccgcctgccttggcctcccaaagtgctggaatcacaggcataagccaccatgccctgcctagtgaagacagattcttgacacattatgtccatcctgagaaattactgaaagaaatgaacctcccacacacagaaggcaaaaggacaaggcggtcctcgcagggctcctcaatccccaggccatggaccggtactggtccatggcctgttaggaacctgagaggaaccaggtgcacagcaggaggtgagctgccagccagtgagcattattgcctgagctctgccttggaagcagtagcttctcataggagcacaaaccctattgtaaactgtgcatgtgagggatccaggttgcgcacttcttttttttttttttttttttttttttgagatggagtttcgctcttgttgcccaggctgcagagtaatggcgcaatcacggctcaccgaaacctccacctcccgggtttaagtgattcttctgcctcagcctcccaagtagctggtattacaggcatgcgccaccacaaccagctaattttgtatttttagtagagacagggtttctccatgttggtcaggctggtctcgaactcccaacctcaggtgatccacctgcctc

SEQ ID NO: 45280 - DNA, 1045 bp, Homo sapiens
ccgaggcaggagaatggcgtgaacccgggaggcggagcttgcagtgagccgagatcacgccactgcactccagcctgggcgacagagcaagactccgtctcaaaaaaaaaaaaaaaacccaaaatgttaggctcaaatcttttgctaggccttagagtctcctcttagtgatgaagggatgtttaatgttaaggaggcaacagctttattcttttttcacttgggtaggaaactgcctcttcatacagaacaatattcatatgttaattgaaagctagtattatttttgtacattcatcctctttcacttattacggaaattcttgctttctggaagtttagtatcaccttaggtaagtggactacctcaaaatttctgaaacatttggcaccaactagaaacattagtgaagtccatgagatcatttgagtcttctgtagctgcccaggaaaccgcctgattaggttgtgtgtgtgtgtgtgtgtgtgtgtgtgtgtgtgtgtgtatgtatgtatgtagaacttgatgctttgaaatgaaccatctgcaaaatagaggcccataaagggtattagttttgatgtgcacctaattgctacaattttcttgaaaataaatatttgaaagagaaatcctccataatggaccttaattacaagagaagtgatttttcctatcttgggatatttttctttctttttttttttttttttttgagacagagtttcactcttgttgcccaggctggagtgcaatggcgtcatcttggctcaccccaacctccgcctcccaggttcaaaccattctcttgcctcagcctgccgagtagctgggattacaggcatgagccaccacgcccagctaattttgtatttttagtagagacggggtttctccatgttggtcaggcaggtcttgaactcctgacctcaggtgatccgcccgcctcggcctcccaaagtgctgggattacaggcgcaagctaccgtgcccggccggagggggtatttttcaataaagtttttctcagagaattcatgcaag

SEQ ID NO: 45281 - DNA, 1045 bp, Homo sapiens; identical to SEQ ID NO: 45280

SEQ ID NO: 45282 - DNA, 1034 bp, Homo sapiens
tccaagtgtacaaatgtctcttattctgatttacacatggagagaatgaactttgacttaatacactttgtcaatggtttgtttcccttgactttagggcattacacaagggaaaagaaaggtagggttgtctgcaatacgtcctccttcagttttttctttctttttttttttttttacgatctagaaggttgcaatcatttgcatttatgagattcaaaccaattaggaaaacgggttcatttgtgattttgagatgtttgaatggcaccattttgtattcttgcttttagcagatgacagcatacacattataattttccgttaatatagtcattacttttgattcctgctttgcatttgtgtttattgctttcttatgcattctttttgaatattctgcagttaagtctgttttcagcatgcaattttttatttctcaaattacactaatcacagtaagattaatagagtagtagaatatccaagatatttgaactacatgttgtgagaatttggattactctgtttttccaccaaaatctatagattgcattgtccatttatattggaaaacaaagagaaacagtttatggttttacaaaactggttttaaaaggaatctcacagattcaccattcaactaacatattttaaacacttattatgaagatatatcaggtatgcatcctgtcttcaagaggcttagaatttagttgtagagatagcattcatacgattcagaaagtggtaactacaagaaggatataatgatcaagatagtcctcatagtgggaatttctattttgtgaggcaatctagatttgggtgatctggagagagaatcgaagcgagaaagcttttcagatggaaagcatagagtaaaggaggacctagagggtagactttagctttgtatgaatgaggcatattaggtttaccagcctgactgggtcagagtatcattctttttgagagtagtaagaaataatgatgtatataggataggatcaaattagaaggcagtggatttt

SEQ ID NO: 45283 - DNA, 1042 bp, Homo sapiens
atgaagtgaatagaagaggacaagcagtccaagttatagtgagattttgaggctccagtattgggccattagtagaaaatgaagaggggcagttggttttgagatgctcgtttgcgattgaaatgttaaatttgtaagacttatggaagatattaatggaaatattatttagattgttagaaaaatggggttgggataagaacattctgttatttaggaaaatttttgactaatggtagaggcatgggcatgattactgtatcttgtgtttgacgcatagtaggtacccattaattacaaaagaaattgaagaaggactgattcatgtgatttttttccttctgtatttcttgcatattagtaattatatgatacaattaagatggagtttttaaggacttaactttctaattgcatacgatgcttaagagttaagattgtatttttctcataccactatctaggaggtgaagatcgagaacttattcagagaaggaaagagaaatacagactagaactgttggaacaaatggctgagcaacagaggaacaagagacggtaatgaaaggtttgcatttaaaagagatattttgagtttaaagtgcatttgtgtaaaatgacatggttaaataaggggttgtcgttctaatatgatgtttgatttgtaaatcacttatattttcatctctacatgctaaatcaacaaggaaaataaatactaagagagttttttttttttttttttggtcataagtagcaagtgagagtatttatatattctgtaatagcccttttacttccctcattgatttcttcagtttttgatttaaggtagcatttaatgttatagatatgcccattggattatcccatatatagtaacaaatataaaagtattttttgccatatgaaatggtatgcacacacacatacatgcaaaaaaaattgtatcctataaatttaacatttccatcccaaatgagcatctcaaaaccaactgtccctcttcattttctattaatagcccaataatggagcctca

SEQ ID NO: 45284 - DNA, 1078 bp, Homo sapiens
aaatacttcgaaagagtggctttatacaacttgttatatacagttgtctgttggtaaccatgggacattggttccatgatctcctgtgaatacccaaatccatggatgctcaagttcctgatataaaattggtaaagtgttcgcatataacctacacacatcttcctgtatactttaagtcatctctagattacttgtaatacctaatacagtgaaaatgctatgtaaatagttgtaatcttgtattaattagggaacaatgacaagaaaaaaagacttttcacatgttcagtgcagatgcaagcatccatttttttttgttttttaatgtttttgaattgtggttgattgaatccacagatgtggaacccgcagttacaaagggctgttgtatatattaggatggtctttgtttagcgtttagttaagcagaataaaagtagatcaaagatacacacttcatgttctttaggtgttatgtattgtaggaatagatgagtgatagaatcggaagattggatgttgagttagaattctcgtgtgttgcaaaaattttctcccattctgtaggttgcctgttcactctgatggtagtttcttttgccatgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctaacatttaagtctttaatccatcttgaattaatttttgtttaaggtgtaaggaaggtatccagtttcagctttctgcatatggctagccagttttcccagcaccatttattaaatagggaatcctttccccatttcttatttttgtcaggtttgtcaaagatcagatagttgtagatgtgcggcattaccagaatctacaatgaactcaaacaaatttagaagaaaaaaacaaccccatcaaaaagtaggcaaaggatatgaacagacacttctcaaacgaagacatttatgcaaccaacagacacatgaaaaaatgc

SEQ ID NO: 45285 - DNA, 1026 bp, Homo sapiens
acacgtaccctaaaatttaaagtatagtaataaaagaattcttatgtattatgcctttgcttgttaaatattggtttttttgaagatatatttgaggcccactttaatttattttaatttaattaattaattttttcgagacagagtttcactctgtcacccaggctggagtgcaatggcaccatcttggctcactgcaacctctgcctccaggttcaagcaattctcctgcctcagcctcccaagtaactgggatttataggcatgcaccaccacacccggctaatttttgtatttttattagagacggggtttcaccatgttggtcaggctggtctcaaactcctgacctcaggtgtcccacccacctcagcctcccaaagtgctgggattacaggtgtgagccactgtgcccagcctactttaattttaatagctctttttttcttcccaaaagatttgttcctttcctatcttcacctcatgaataattttctcacagttttgaaagagtgaaactcttattactttctttatcaatgaaatgattttagatgatgcctagctaacatttcttattttaataggtaagtgtttacttgaaaatatattagaaaaacactagttttccatttatgaatagtgctataatattttcttttaaactacaggtattaaagtgaaggcattagtccaggcatttaatggaaagtgctgtaataataaacaaacccaaattcttagaagcttaaggcctctcttgttaggcatccacttttgtcccactctgatgctgctgtttgggtggttctcctccaagaagtgactcagggatccattgtttcattccttcattttagagtccttttcttcttgtccagggacaaattgaggattttgttggggcctggcctggatgtggaggaagatcatttttgccttcattccattgttcagacctagttataggttctaacctaactgcttgggaggctgggaagtttaactttctttatgctcagaaga

SEQ ID NO: 45286 - DNA, 1030 bp, Homo sapiens
tttctttcttttttttttgtttttgttttgagacagagtctctctgtgtcgcccaggttggagtgcagtggcacaatctcggctcactgcaacctccgcctcccgggttcaagtgattctcctgcctcagccttccaagtatctgggactgactacaggcacacaccaccacacctggctaatttttgtatttttagtagagacggggtttcaccatactggccaggctggtctcgaactcctgaggtgatctgcccacctcagcctccgaaagtgctgggattacaggcatgagccaccgtgcccagcccccttttctaattttttaatgtcgatgcttagactatgatttgagaccttacttattttctgtgcatttaagtgtgctacacatttccctctgagtactgttttagctgtacatcacaaatttttatgtgttgttttaattttcattcagttttctgattttcattgtgacttttctttgacccccattagttatttggaagtggacttaaaaattttccaagtatcaggggattttcctgagagctttcttttattcaattctagtttgtattctgttttgtaagagaatatacttttcttttttttttttttttttgagacaaggtctcactctgtcacccaggctgtaatgcaatggcacggtcatgcctcactgcagtctcaacctccctggctaaagtgatcttcccgcctcagctcccccaagtagcaaggactacagacacatgctaccatgcccagctaattacaaaattttttttagagacagggtctcacttttttgcccagctggtctcaaactcctggcctcaaatgatcctcccacctcagcctcccgaagtgttgagattacaggcatgagccactgcgcccagctggagagaatatacttttaatgacttcagtgtttttaagtttgtgagatttgttttatgagccatcagttagaattttactctataagtaagtgtatatattttaaattaggttaattttg

SEQ ID NO: 45287 - DNA, 1033 bp, Homo sapiens
ctaatatattcatctattaggcagagaatgcatctttctagatatttgtaagttattagaaaatcaatagattttttccaaatgatttgatattattacagattgtaaataaataaaaattagatttaagataatcacagtttacaattatttgccccatttatgtacataagtaaatggcatttaacatagtagaactgcccagactattcgcaaaggaagacacttgaacatccagtgtttatgaagcaaacagacttactcccatactgggggtaccctgggctgagtcctagggatggagcctgagatgaatgtgagatacttgctcatgagggactcacagtttcttctttccctacctccctccccttcacactcacacttagataccagtgtcagattaatcttatggcctggttaatcctcctttgatatgacttttcacctgctattcttctttactcaaaatctggtggtagcttttctttgcctacagaaattatctcaactcttgaacctaacatttaaggttttataatctaattccaaactcttaaatagatgccctcaaacatatcttctttttaatcctaattattcttgactcttaaataaggcagtgacgtaatggatatagcctttaaggatgattgatattaggctgggtgtggtggctcacacctctaatgccagcactttgggaggccaaggtgggcagatctcttgagcacaggagtttgagactagcctgggcaacatgatgaaaccccatttctacaaaaaattagccaggcattgtagtgtgtgcctgtcaccccagctactcgggaggctgaggtgggaggattgcttgagcccaggaggcaaaggttgcagtgagccaagatatgccactttattcttgcctgggtgacagagtgaaaaaaggatgattgatgtgacatcactgtttaagatacaataatagaggattaaaaagagtggaagcagggatattttactagtgtgggtgacagtggaaatgggtgga

SEQ ID NO: 45288 - DNA, 1034 bp, Homo sapiens
agttgcactcccccaagaatatcgcttctgaaattcctatattataaaaaatgtacttgtgggtcctaatgacgttcacaattatgatccatgtatgtgtgtatatataaaatgttaaaatatctttcataaaattgtctctctgagcagtttcactttattattagtcaggttgtgttttaatgtttagtcttttgttcttattcctgtcttgtgttttacttatcaatgggaatttgcagaggagaaaaaaaatgtaattatggaattatcagaaatgagaaaacagcttcgtagtgaagagaggcgtctacaagagcgattgctacacatggacagtgatgatgaaattcctatcaggcaagtttagaattgcagtttttgtgttcgcttgagttcttttatcttacttcacctatccagtaattttgtagtttgggaacaggactaattcatcttacttaaaatctccttactttccttttctttgtcttttacaaaatcagctgtagaaatttagttctcaaggggattcatgtaggaatggaaatttccgggttggaataattacagacagtagttgcattttagaactgttttttatattttccattaataacgtagctttctgaaatactttttttcaacaaaatcacgtacgggctaccgaacatttctgatcatttttgccaggagtcataaatttcatgaagcagtgttcttcaaacttcagtttgcactgttttagtaggttgtaaaatcaacatagtgggtaactaccacattttctttctttctctttttaaaaataaactttctattttggggtaattttgattataaaaaagttgcaggctgggtgcagttgctcacgcctgtaatcccagcacttttgggaggccaaggtgggcggatcacgaggtcaggagatcgagaccatcctgtctaacacagtgaaaccccgtctctactaaaaatacaaaaaattaactgggtgtggtggcacgcccctgtggtcccagctactcaggagg

SEQ ID NO: 45289 - DNA, 1035 bp, Homo sapiens
gtattccttatgttggtaagtttgtgaaaagacacttattaaagaatattaatttcatattctttagttttgtggctattttactgtcctttgactttagtgatgtttcactatttctatcatttccttgattttgaaattaggttactcatgttacttacagtgaagttttacaaaatcccatttgaaaacaacatttaacttagttatataacatattttttataccagattcagaaacacgagttgatctgaaatttatgtacctggatcctccaagagatcatcacaccttagagattcagcagcaagccctgctaagagagcagcagaagaggctgaacagaataaaaatgcaggaaggtgccaaaggtaagaaataatcattgctgtgtcaaatagtatcagcacgctgtttttccgtaggctttctgcatctcttctattgatttcattcccaggcatcctcctttcactggcagccccatgctcacagggtccgtttggtctgtagtaccagaaaagaacaagtatgagagagagctctgagtggctccactagggtggtgtattcatgcatgagaggggcccagtcattcactgtagccaggaggactgaatactttgaccaggccaggtgacgtctgcatcaggaactaggaaccaaaggaaggagtgtcaggcagacatatcagtgccctgtcatgatgtgtcgggcatttgcctactgtgccatgtcaggcatttgtctactgtggtgtgagtgtgtttaagttttgatgtggcgtaaaatctgtaaagcatcagactggactatgaatatgttttcgtataatcaactaactgaaagatacttagtggttactaggagtgcaggtactggcctatatccaggggatatggtgatgagtgacatatgctgctgctcttgaggaggttatattttgttggagaagtgtgatgctaaagaagtacaactgtgatgaatatcgcacagaagaaatctaggatgctgttgggttggggtgggtgggc

SEQ ID NO: 45290 - DNA, 1167 bp, Homo sapiens
tctgtaataattagtgatgttggacatctttacatgtgcttattgactaattgtacatcatttttgaagaaatacctatttaagacctttgctaatttttaaaatcagagtttttttgttattgagttgtgggagttctttattatctattctggatattaccccttatcagatacatgatttgcaaatgttttctgcatagtgggttgccttttcactgtgttgattgtgtcctttgatacataggagcttttaattttgatacagtccaatttatcttttcttttgttgcctgtgcttttggtgtcacatctaagacatcgttgccaaatccaataccatgaagctttcctcatatgcttgcttctaagagttttatctataggtttagctcttaatgtttagatgcctaaccacagagtgtcaaaatacatgtcagaaagcaaaagaatggcaaggagaaatagatgaatccactgttacagttggagatttttaacacctctctatcagaaatggacagagacagaaaatcagtaaggacgtagttgagttcagcaacaccatcaaccaactggatataatggatgtcgaaagacaacttcattaacaacagcagaacccatattcttctcagggtcacatggaacattcaccaggacagattacaatctgggcaagaaaacaaaccttaacagatgtaaaagaagataaatcacacaatatctgtccccagaccacaatggaaataaactagaaatcaataacagaaagatagctggaaaaatctccaaatactttggagattaaatgccacatttctaaataacgcataggtcagagaaaaaatatgaaaatacattttaaaatactttgatctaaatgaaaatgaaaatacaacttctcaatttgtaggaggtagcagaaataatgcttgtctttctttctactttcctaatgtatgcattcagttaaatgtaaaatgccaaactctaaaactcacagaagataccaacagaaaatctagacgaccttggatatggtgatgacttttagataaaaaaccaaagccacaatttatgaaagaaataattgataagccagactatgtaaaaaattgggaattttttttttttttttttttttttttttagacaaagtcttgct

SEQ ID NO: 45291 - DNA, 1022 bp, Homo sapiens
aataaataaaagtaaaatacagatagaagttgcgtacaatcaatcagattcaattaaagaatgaagcaagagctacctcttcattgactggacacggccttgttagattaggtgttttaagaatggaagtaatctcatgccaactagtgttttcccaaaataacttaataatttccttatagcagtgttgtaggttgaagagtattccccaaaccttgctttaaaaaaaataaaaagaaaaaagaaagaaattttatgtgtagccattaggcttctcctgaggtaacagttacaaaataagactacctacattcctcctgttgactttgttttatggagaggtgcctttgatatgcttagaatccctctggttgctagtgccatggagtcagcttactcagttgatcattttttgttttacaaaattggcctttgtgggcccactctcctccctctaaaatagggtggggtggggtgagtctaaccaaaacaaacaaacagtagagttcaggatatgagactgtggggaaatgctgagttgtaatgagttggactacaagagacctgcgcttatgtctcctgcctgccacctgtgttacctgagccacgtgtcccttgcctcctgtagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggtaaatctgtacctttaatatgtcctacttttggcccctacctgaaagttactttttttccatcatctgtatataaaattatttttatcatgatgtatattatgtacataaataaaaggccatgattattgatt

SEQ ID NO: 45292 - DNA, 1044 bp, Homo sapiens
ctaaaatctttcctatttctgagccctctctctcctcaattcccacactttggcctttaaggaaagagcatcttcccccactgccatccccaagacagcccatgagcattgcctttcttctctaagctaaggtatgggtctatctgcatcttctctgtagttgcccccaggcacacaccgctgtttgaacaaagctctgtgtcttcagctggctactctttccatggtgggctgtgcttcctcaggcctctgcctttgttcttcctggggccttccttttgtacctggtggattcctactgggctttcaaggctcagttagccccttcttcccaggtgctccttgctttgtatccactctaccctgcatttccttcttccatagtacccaaagtagttgatgtgtgcatttgtttactttggtcctcattctgttagacctccttgaggacagggacataccaccttgtgtgcctgtgctttccataattgtgtgcagtgcttgtgacattgtaggtcctcaataaatgcttgctgagtgcatgcatgaatcaatgagttgacccatcttctatcctcccactccatttttaaggatagtgcctcaatcatcctgaacattttgatttcctgttttcttccatttggtcaaaatagatagtagaattttcagttttgctcaggcacatatgaatttatgcagtcaaaaatttcaaattaaacatgtggtacctgcctttaaaacagaaacatgatttaaatcaggtattgaggtattaaagactttgcatgcactattgtttcatatattttaaatttttgtttgagatcatggataggttacactatctagattaattatttttaggtcacagataaaatggtagagagtgacataatttgcttgaatttatgttcttgttttgcttgggaaatgaaattttgtgctttattaaaatattttcaaacatttcttctaaataaatgattacatgaacctgacatccagtatttaacatccaaagtctggacaatagtaagttac

SEQ ID NO: 45293 - DNA, 1031 bp, Homo sapiens
gcaggacttgagggaagtggggtgtgtgaagactgaagaggtcgctggatctggcagttagaatgtcattggggttttagcttcagtagagcgtgtgagcaaaagccagactgtcagaaccagttgagacacgagtggaagctgaggatgtgaaggatgatggataaactattcaaggagtttggtggtaactgcgaggagagaaggggatgattttgtctagggatgggtaaggcagatgagcctagccaagggtagagagacaataaaaagggaactaaagcagtgaaaacagaaagtggcagaaggcaaatggcatctttgggggaagcatagcaagcacccccatggcactgggagataagacaaggcaaaattttctgaaattttctgagccatcttgctgtgtaacatacccatagtaaaacatagtaaaactaagaatgggcaagctgtcacttgtgtattttacaaattctgctgcttctccagtgtacagctagtggaactgcctgggatggtctttgtggccccttgtgaacacataccagaggctctccctcccacactgggacagtgaggtgaactgcatggcacagaatctgatgaactggtttaaaatcctcgcactgaaacttacaaactctctctttgggcaaacaacacagcctctgtatgtctcagtttcatatttggaaaacacatttgataatacctcacagggctggcctgaaattcaaatcagcttctgtaggtaaagtcctgataggtaggaagtgtttcttccttttcttttctttttaattaattaattaattaattaatttattgatctcactctatcgcccaggctggagtgcagtggcgcgatcttggctcactgcaaccttccctcttccgggttcaagcgattctcctgcctcagcctcctgagtagctgggactacaggcacatgccacaatgcccagctaactttttctaatttagtagagacggggtttcaccgtgttgtccaggctggtctcaaact

SEQ ID NO: 45294 - DNA, 1001 bp, Homo sapiens
tattcacaaaactcaaggaaacacttaacttgtgtttaccagcttattgtaaaggatattacaaaggatacagataaacagccagatgaatggatggatagggcgaggtatgagggaaggggtatggagtttccatgcccttatcaggcacactgccctccaggaacctccatgtgttcagctctccagaagcttccagaacccagtcttttggggtttatatggaggcttcattacataggcatgattgattacatcactggccattggtgatcaacccaaccttcagctctcacacctccttgcaatttgggaggtgggactgaaagttccaatcctctaatcatgccttaatctttctggtgactagactccatcctgaagctacctggaggtcccagccaccagtcatctcattagcatacaaaagacattcttatcactccagagattccaggggttttaggagctgtatgtcaggaaatggggatgaaaaccaaatatatattttacaaaattgcatggcccaaggcagatttccatatctgcatttaatccatcaggaacaagacaatttgcaacaatttgcaaagaacgatctgcaggctttgactgtataggaaaagaagtgtagactagaccagaaaagacacaattcccagggggtcctgtagctccctggggtcacatggctatgattttctctttactgagggtaggcaaggtgtcctctttttttgttttccaagaactaaggcataataggtggttaatagatgttttgaggaatggagtaatgaatacatgaatccatcttctctcagctgttcagtttgtgaggaattttcaaatccttaattaagaatagatacatctatatagaagcaagctagaagtgtaaaacaagccttcaatatctattatttagagttgattgtatgtacttatgtgtttaggctaactcagtactaaagcatttttagtttttacgttggagttca

SEQ ID NO: 45295 - DNA, 1030 bp, Homo sapiens
aaggagatttatttggctcatagttctgcaggctgcacaagaagcatggtgctagcatctgcatccggtgagggcctcaggcctcttccactcattgtggaaggtgaagaggagtcagcatgtgcagagatcacatggcaagcaaggaagcaaaggagagatggggcaatgcaggctcttttttaacaacgaactctagcagaaactaatataactcactcattactgcaaggatggcaccaagacattcatgagagatttgctcccatgacccaaacacctccctttagacctgtcctccaacactgaggatcaaatgtcaacaagaggtttgcggggacaaacatccaaactatagaaatacgtaaaaatttcccacaattattttaaagttcttgtctggtaacttcaagatctacatcatctattgatcttctatttttttcatgattattaggcaaatatttctatttctttgcatgtcaagtaattctatagcagacattgtgtatagaagaactgtagagacttcagatagctgatcaacttaactcataatcaaggattgaactaggcttgaaatggggcagtcttagtaaggttttttgccacacttttctttccttaagtatgacccacagcctgctgtgtccgttttcgtatccctgaaaggaaggagattcagtcctgctctttagtcctgatttttggtctcaaaatctggcagattcattaaggagagacctactatgagcctgaggcaggcccactccctctagtttgactttgtttcttaagcaccaccagattatgggaaattttactttaactttcagaaaactttgcctagttccccagcctcccatgcgcgttccatgcatttagaactctctacgtttccaatctgtcacatagccctacatggctgccaaaagctgaaatgccttctatttcccttagtagcattcttttggatgggccaagccccatgttcagtgtgaacccagaattagcaaatgtccccaggaaa

SEQ ID NO: 45296 - DNA, 1045 bp, Homo sapiens
tgcttgatcccaggagttggaggtagcagtgggccaagatcatgccactgcactccagcctgggcaacagagcaagactccatctcaaaaaaaaaaagaaaggatcagaagtcaggcagtgttgtcctttcactctgcctacatcctatcctaagtgaatttacctctctcatctcttcccctagcctctcactacgtattttcaagtgatttaataaaaccatgtgatttgaacattttaatttggtctgtgagtgattctgttccatgactgctgggagagtttgcatggttaatatatttgggagtagtgttgcacaaaggtaatttcccatgtgacagtaaaattaagaaaaaatatattaatcactatataaaaaggcaaagtctcaattatgttccataaaaaatctaatcattcaatttacaagttaaacaaattaccatagaaaattaatagtaaatgcttgagcaaaaataaatcaagcaaacatcaatcaaagaaagcatgtttgtaatgtggattgataaacttaagtactagcaaattaactttaagagttcagcaattcttaaatagaaagcccataaataaatccacccacatacagtaaagtgatttttgacaaagatgttaagagcacacaatggaaaaaggatcgtctcttcaataaatggtcttgagaaaactggatatcaatatgcagaagaatgaaattggacccctatgacatacgatatgcaaaaataactcagaatggataaggcttaaagataagacctgaattgtaaaattgctcgaagaaaacataaggaaaaatctgatattttcccttgacattagtctgagcaatgatttttttggatatgacctcaaaaacaaagacaacaaaaacaaaaataaacaagtgagcgcatgtcaaactgatcttctgtagagcaaagggaacaatcaacagagtgaaaagacaacctacgaaataggataatatatttgcaaaccatacatataaaaaaggggttaatatcctaaacatctaagaaa

SEQ ID NO: 45297 - DNA, 1030 bp, Homo sapiens
attcagaataatgacactgaattgttcaggttcgaggtggcagcggaggctagaactgacctgcttggaatctgctctctctcgatgtccctcctgacatgcgccctgcttccgttcctcttaacaaggtgaatggccttcattccaaggcaacacagtcaggttttgacactccatggggaacaaagggaaaatcagcatgactagccccattctcttcactcttaatcccagagatagtgaatgcccccctcctaccacatctttgtgccaggtcacctaaaggttgtttggtggagtcaatgtgggtgcatgaggtaagtcaacagagaaaagagatccaaaggttggggttagaatattggccgccaccactttctagttgtgtcttctcaaataggtcacttactttctcctgagtctcaggttttctatctctaaaatagagaaaattaacctcacccttgtgaggattaagtgatattatacatgtaatgtactaaagtgagactgagattttctctagtgtgcgaatattgggtgttattattattccaagccatcttacctgctgttttcattcctatgaagccaattagaattaaaatgggctgaggccgggcacggtggctgatgcctataatcccaacactttgggagcccgaggcgggcagatcatctgaggtcaggagtttcagaccagcctggccgacatagtcatagtgaaaccccatctctactaaaaatacaaaattagccaggcgtggtggtgggcacctgtaattccagctacttgggaggctgagaccggggaatcacttgaacccaggaggcagaggttgcagtgagtcaagattttaccattgcactccagcctgggcaaaaagggcgaaactccatctcaaaataaataaataaatataaaaagaataaaaatgggctggaatcccagagacttggcatcacttcttgactatgtgaacacaacaaccagcggggactaattaagacaacatggacatatgtgttt

SEQ ID NO: 45298 - DNA, 1035 bp, Homo sapiens
agctgggactataggcgtgtgccaccatgcccagctaatttttgtatttttagtagagacggggtttcaccatgttgtccaggctggtcttgaactcctgtcctcaggcaattcacctgcctcagcctcccaaagtgctgaaattacaggcttgagctactgtgcccggccgttttttttttttttttttttctgtatttttagtagagagagggttttgccacactggccaggctggtcttgaacccctgacctcagacaatccagcctccttggcctcccaaagtgctgggattacaggcgtgagccaccacacccggcctcaagaataaaattagccatattttcctgtctgatagaagatggagcacctcttacgcttccacttggctgtggattgtgaattcactagccgattattttgcttctctaggcattaagcagtcaactcttcatttttaaatgctagaggcagagatcatccaggtagatggataagccttaaaccatttggatttaagacagatatacatacagacagacactcaaatgctactgattcccaaactttgcaaagttacgaaaagttatttattttggcaacactttccccagcaataattctatatagcatatagttatatgttaatggagttgtctgtcagtttctgagcccaggctgtagtgcagtagcatgatggcatgatctcagctcactgcagccccgacctcctgggctcaagtgatcttcccacctcagcctccctccaagtagctgggaccacaggcatgtgccagcatgcttagatgtatataccacaggcatgtgccagcatgcttagctatatatatatatatatatatatatatatatatatatatatatatatatatatatatatatgttttttttttttttggagagacagggtttcaccatgttgcccaggctgttcttgaactcctgggctcaagcaatccacctgccttggcctcctaaagtactgggattgtaggtgtgatccaccacaccca

SEQ ID NO: 45299 - DNA, 1050 bp, Homo sapiens
attccctttgaaaactggcacaagaaagggatgccctctctcaccactcctattcaacatagtgttggaagttctggccagggcaattaggcaggagaaggaaataaagggtattcaattaggaaaagaggaagtcaaattgtccctatttgcagatgacatgattgtatatctagaaaccccatcgtctcagccccaaatctccttaagctgataggcaacttcagcaaagtctcaggatacaaaataaatatgcaaaaatcacaagcattcttatacaccaataacagacaaacagagagctaaatcttgagtgaactcccattcacgattgcttcaaagagaataaaatacctaggaatccaacttacaagggacgtgaaggacctcttcaaggagaactacaaaccactgctcaatgaaataaaagaggatacaaagaaatggaagaacattccatgctcatggtttagtcttgggatggtgtatgtgtcaaggaatttatccatttcttctagattttctagtttgtttgcgtggaagtgtttatagtattctctgatggtagtttgtatttctgtgggattggtggtgatatcccctttgtcattttttattgtgtctattttattcttctctcttttcttctttattagtcttgctagcaatctatcaatttcgttgatcttttcaaaaaaccagctcctggattcattgatttttttgaaggtgtctttgtgtctctatctccttcagttctgctctgatcttagttatttcttgccttctgctagcttttgaatttgtttgctcttgcttctctagttcttttacttgtgatgttagggtgtcaatttcagatctctcctgctttctcttgtgggcatttagtgctataaatttccctctacacactgttttaaatgtgtgccagagattctggtatgttgtgtctttgttcttgttggtttcaaagaacatctttatttctgccttcatttcggtatgtacccagcagtcattcaggagcacgttgttcactttccatgt

SEQ ID NO: 45300 - DNA, 1106 bp, Homo sapiens
aagctgttttattcaacctgcaaagaacttggaaaaatttgacattaaaatctaggccaggctgggtgcagtggcttatgcctacaatcctagcaatttgggaggctgaggcaggaggattacgtgaggccaggagtttgacagcagcctgggcaatatagtgaggccccatctctacaagaaatagaaacattagctggacatgacggcatgtgcctgtagttgcagctgcctggagggataatgtgggaggattgtttgagcctgggaggttgaggctgcagtgagcaataattgtactactgcactgcagcctgggtgacagacagagaccctgtctcaaaaaaaaaaaaaaaaaaaaaaaaatctaggccagcattcttgaacagtaacaagtccgaagagcaagaggcagttatggagaatgtccgatttacaacaatcctcaccactctccgttggctcccaacacatactgtcactttccttatttcttgacttggctggggccttttctgggtgcaacattccctggctctgatgggcatttgacctgggatccatgttaaatgatcaatcaacatttttaaaatgaagacattttttagattagaataaataattggaagaaaagtcttttcaaaagaggggagaacacggcttttttggaacaagagtgagttggggtataatttttttcccagttattatatcccaagccagagtcattcattttcatgatttaaaatgtctccaaatagttctctacatttttccaaggccaaaatagttgctgtgtttattcaaaccactccatgcccatctaaaatatgtttgataaacgtatagtaagctagattgatcttggtgaaggaaggcagaactgctacttacaggtgccacaggatatgcgttcagagtttatatacagctaattacagatatatccaatttaaggtgctcctaacaatttgaaaacattctatgataattgatttataacaaaacactggacgctaatgaaataactcagatttcatcaccttatttccactagaatcttcatcttgtctgcccactgcatccatgattgctgtttggctgct

SEQ ID NO: 45301 - DNA, 1049 bp, Homo sapiens
acacattataaattttttttttagatttattaggttgaaaattgaacaggaaaggtaacttttatcattgtgaaatttctgattaatacaaaaaacttttgtgctaggtcccataacaaatgaaagaccaaggagcagaaacatgggggcaggtaccctttaaaaaaaaatctatggaaggatctggcaagatggccgaatataaacagctccggtctgcaactcccagtgagaccaacacagaaggcaggtgatttctgcatttccaactgagtggcacctggaaccccagcgagacaaaaactgttcacactcctggaaagggggctgaagccagggatccaagtggtctcgctcagcgggtcccactcccagggagtccagcaagctaagaaccactggcttgaaattcttgctgccagcacagcagtctgaagtcaacctgggacaattgagcttggtgtgggcaggggtgtccaccattactgaggcttgagcaggtgggtttcccctcacagtgctaaggactgggtagaactcaacacagctgtagccagactgcctcaccagattcctcttcactgggcagggcatctctgaaagaaaggcagcagcccagtcaggggtttatagataaaactcccatttccctgggaccgggcaaccgggggaagggatggctgtgggtgcagtttcagtggacttaaacgttcctgcctgccagctctgaagagagcagcagatcctgacaaggaggtttttccagcacagcacttgagctctgctaagggacagactgcctcctcaagtgggtccctaacccccacgcctcctgactgggagagacctcccaacagggttgacagacaccttatacaggaaagcttcagctgacatcagccctgtgcccctctaggacgaagcttccaaaggaacgaacaggcagcaatctttgctgttctacagcctccgctggtgatacccaggcaaatagggtctggaatggacctgcaacaaactgcagcagacttgcagaagaaaggcctgac

SEQ ID NO: 45302 - DNA, 1051 bp, Homo sapiens
ctcatcagcactgtattagactttttctatcctggtgttcataaaaatcctctgagaggcttatttaaaaagtagattcctaggtctactcccaaatattctgggttagtaggtctaagatgggccttatgaaccttcattttaataaacgaaccacagtaattatgattcaagcagccagagattccagtttaaaaactactactgtgtcatcaacaactgagtatttctaggttcactgtttttattttcaacttatttttaccctaaccatttgaaaagtaattgagatatactggtagacagtattcttggggaattaaagaaccccttgttgcaaatatttgttgtcagttggatgctcagtggaacccataaaactacatatctagctattcttgggggaaaaaaaccttacaggatctaactattgttttttgagatctgaactaaatttccatgtagatgtgactttttttccgtttaaaattaatgtttttctcaagctaaaatgaaaaatatggaaacatatttgtaagaggaactcacttaaaatgttactaatattcaaaaaccatactagagacacatacagatagttgttttccatgtgctttcattaaaacaatcctcttattatgttttgaaatcttgtaactctgcttttaaactaataacaaatatggcaaacctaccccttagggtatataagtacaatgtaagtttaaatatcacccaaatgaagagtaaataagagttaaagtatccaacgtgtttgtagctgtgctaatagagcttctaaggaagctctactcttgcatgaaccattaatgaaatagcctctcactggatccagtttgtcttaatctcagtatctgatttcttatgttctcctatttggtccatctgactttcaaactttctgtgcaaaataatttcccatcaggccagctgccttcctgaaaagccccactcagctcacttatatctaaggcaaggtttgctaagctattaagacgtcataaactcttgtgctggtttgacactgagt

SEQ ID NO: 45303 - DNA, 1052 bp, Homo sapiens
atccaaaaacaaaataagaatggaggtgtcttcctgagattgttctcctcatttccctgctgcctttttttttctttttagctcctctctgaaagaacattggaatcaaaaaggagctaataccattgagcaaaagggcaaagttacttcttttaaaagaaaagctcatttttcaccatggtaaccagcatatcatatgacatacgtgccacatggcccgtgaaaagtgaatcctttcataaatgtatttctatcagagcataatgagctttcatatgagtatagcaaggactagaataaggtgacaccttaggttgatttgggtcaaatcattcctgtgatgtcttgtaacaatttatttgcagtttgcaagaggtaacactagcatttcattttttaaaatgcttaatgaaagtgaaccataggctatgaacacaagatgaatgcattctattgagtcttagaaatggcacgttcccttttcctgtgtcacaaacaagcaaaaaatctgggattcattcgatttctcaggatgtgtatttgtagctccttacgtactccagttaaaacaaaaacaaaagttaaaaacacagctaagcatagtattaccatagccactgctttcttttaattatagtagctaaaacctttggttctgatttaaatttgacatttaacaaaggactaatgaagtaaaggaagaggaaatcctttgataagtatgcgtcacaccttgggagaggtaaaaatgaaaatatttcactcaacttttaaaaatcctttacccttttcacttggagacaccttttgttcagtcagctcttttttgttaactcctttgaaaatctcttgtaactgtagtacctcctaagtgtactttcccaatgctaagacactttatattcagttgatctagtttcttaggcattcggaggtttaataggtcccttaaggcgctgcgtagcttcaaatccgatgactcaaataagcacagatttctatagtcagacactgatctgcttctttcagggcatccaataggatattaattg

SEQ ID NO: 45304 - DNA, 1024 bp, Homo sapiens
tattagcattttgccttgtcatttagagaaaggggagaatcatgaaccatctgagtttagaaaaggaggcaaaattggaggcacaggcctttcatccagcagtaatattagaagttctggttacaaatgttatttgtttctttttggtggtaatatacacatgaaaaatgaatctttaaccccctttatgtgaagtttaaatcttgcattaactgctggatggtgggactcattacaacttgattgatgactgaacttccactgtgaagtgtttaaggggcaaatattcaggcaagatgagttgtcactatgttactggaaatacacctattatcctgtcaaggtaagtctaaactcttgaaataggtactaatgtggtttcttgacctgagtggcttgaaatgccagttcagtacagaacactctatcacaaaaacaatccattgacaatatcacccaagcagtatttcaacaagcctaagtgatgttggcagccaactaatgaggacatgaagtcatgaactgaagctccacaggcctgcacaaatttacacatgcattttaacttgctttgatcttcagaattgcaactcaagtttggtcagcaatcaagtagttgaaggcttatgcttctctagacacgttctatttctgttcactgtgtgcctgggttgcaatgggggagggcagtgagggggaagaaatcctggaaaagctttgttatcattcctgaaatgaaaagtattctatttagcttagaagtttgattcttgatactaataactgatattaggcagctccagccatttttaaaatctattgagagaacaaacctgagcatttaattctcagaacatcagaatcagtcactgagtggtctgttgtgattgtaccagcctaaatttggggaggtggcctcaagtttgtcttcattcctttttttcagggttgcatgataaaatcagtaagtagaattttgctgcagatgctactgaatcattgctagaattttgctgccctgcta

SEQ ID NO: 45305 - DNA, 1022 bp, Homo sapiens
tgcaataaaaataacactcataataatagcaaccaaaaaaatagatagcactttctataggcaaggcactgtcctaaatacttaaaaaatttagtaacgtattaatcctcacaactgactctatgatgtaaggtttattattagtctcattttaaaatgtggttacggaattcagacatcattaaattaaaaactgaatcattctaaaggaaaatgaaggcaaataactattataatgagtaaattcagaagacaagtggtttacgtaacatacaggattttggtaattaaaaacatataaaagcaagacaggcagcttatctcactgaaggggtaacagaaagacctcaggtgaaatccaatgagatcagatttgtcagaaaaaatgattttgtctccaatcagtaatgacctttcagcctgccctagggttgagggaacaccttcaaaacattgactttatcactgacctgatgaaaataatgggctcagtccatgaatcaagacatgtatgttgagattgctctaaatttatgaatcttggattgtagggagtagggagcactgaagaaaaggaaaaagaaaatctatgtgctatccattttgaaactgagacccatcttttaatcctcagaatgttattagtattttcttatagatttctgacaattatgcatatggatgatgttaaaatatcatttttaaagttgatcagtattacaagatagatacctgtattaattttgccaatacctttcacaaaaagtcttttgtaataaaaattatctaaacaagtctcttaaatgtagatagggtcaccgtattttcagatgctcccctgggaacagagttgactcactgctttcaagcttgcaactcttgggtatttgtgaccccagcacactaaagttcggtatccgaatctgccaacatctcccttgttattttaatcacctatgatgtttgtatcttgcaatatggacttccaatgatctgtattttctatgatgagaaagactccc

SEQ ID NO: 45306 - DNA, 1691 bp, Homo sapiens
tcagatcctcattgtctcccaccttgacagtttcaatgcctatatgattgcccatttcctctccctactcaaggcagttctgtgcagtgtgatcagattaatattccagaagtaagagtgtctgtagaaataagtacaaattatttggcttgccattcaaggacataaacaatataaatccaacctggctttaaggtatatctcccaggaattaatcatttgcctttgctccaggaaaattggatcaccccttggccctaaccacgtccagcctcagctacctctgtaccttcatcaccctcattagtttttaaagttctgcaagtttttaaatattacctctcccaaaacagctgagatgtgttacctctcacatgaagacttaattttccaactccaaatggatatgacctctctctcctttaaattcatctgttattatggatgcctctcccatagtgctcatattctgccttctattattttgtacctacataataaagttacggaatttcagagctgcaagaaaccttacagagtattcttatttgacagatgttttatgcatcctacagaattctaaacagggatggaggttgagtttttatctagcctgttgccttcactacagatactatcactcaccttcccaattttgtaccataatgtcttgcacaaaggcaatgcacattccatatttgttggataaattggatgcaaatacctcaacatggaaaaatgattgtagatgtacaaatactcttcttattaataatattgttgcaagttactaatactgttgtaagttaataatgttgagcattattacagcctgcaaaaccttgattctttgattggttcattcatccagcatttattgaacaactactctgtattaggcactgtgttgggttattgccttggagtacttacagattagcaacctgcttattatgagacttgtgattgaaccaaagagaaaaagagccttaccactgaaattatgataagaaaaattccatcacagccttaatatatgaaggagaatacagcagactgccagccataatgcctccatcttccatcctttcctgtatctagtttctctttcaatgtgactctgtagtttcttacttcaaaaggtgtagtgtatctgatttccccttgattctgagcttagccacatggattgccttggtcaatataatcttagcagttgtgctacaggcagaggcttgaaaatgcacttgcccgcctctgtttcctctcttacttcattgccatgatcacaagaacatactgacaatagcctgctggagaataagatagtgctgagttccccaaatcttttgagttgtaactgtcctgggttgtaacttttgagttgtaacatgtcctagacatgtgagttcagctaagtccaggacagatcagtcttggcagactcatgggctaaataaatggatattgcatcccactgtggttgaatcgttgtttgttatgcagcattttgtggcaatagataactgatacagtgagaggacaatcctcaatccttccctagcaaggaagtgacaattcattcaaatgtagtggtttcttgtttgtttaaatatctaaaggtggctagatccaatattcattgaatacacaaagatattctgaaaagtatattttgttacaaaattatt

SEQ ID NO: 45307 - DNA, 1107 bp, Homo sapiens
tgaggccattggaagcttttgatccagaatgggacatgatgaaagcagcatcgtatggacgtggattggtgaatcctatatgggctgctgtggcatggaacagctggtaaagcagagctgaggctgtcccatagtccaggtgggaggcagtgaggtattgaagggtaaggagaatgggtttgggagctacctcctgactctgagacctcatctataaagtgaggatgtgacctagttcacaaggtcatactgatgactaatgagataaaatacaataatgtttagcagagtgccatgccaggccctcagaaatgcacgagatagagtagcatagcgaggctctgaacctactgcctgggtttacattctggcttcactactatgggctgctgggttctgctgcacaatccttaacttctctgagctgcaccttcttccctggaagatggggagaattacagagcctgcctcaaaagctggttgtaaagattagatatattaagtgtccgatatgtgctcacaattgtatgccctctaccctcctgtgatagcctcagactgggagccaaagaaataaaggagcaaacatgcaacaattgagaagaacagatgggaatgacaactggttttatattaaagacaatgtgaaaaataagtcaaagacgaccctcaaaatggttacactggcagagaagggaaatcaggatattgaatgagtttggcttgggggacaaggctgtacaatgtgagtgatgttaaacttgaagaaacagtgtaacaaaaaattaaaaattttaagaatagaaaaaagacagctttagaatagaaaaaagacagtaggaatataaaaggcaacaaaaaaagacagctttttttctcttggaagctgataaattaaaaatttttaattttttactttttaaacttttttactaagaactaagacaaacgaacacattaacccaggcctacacagcaccaggatcatcaatgtcactgttttccatcttcacatcttgtccttactggaaggtcttcaggggcaataacatgcatagagctgtcacctcctaagataacaatgccttcttctggaacacctctgaa

SEQ ID NO: 45308 - DNA, 1080 bp, Homo sapiens
caattcatcatcgagtgttcggtaatgacctctcagaaattgtttcttgtcactgggtgataaataattttctaagactaatgtgggattgttcaccctatggtagaattacatatccttggtgatttgggttagaaacagagtcctgggcacaaaactcagagattaaacccacgtcatttttatccagatcaatacttagaattaaatgtatgacctaaatagccatcttaaaattattttattctccaggacaatggtcttcttccaagctggatggcatgaaataatgaggataggctgtctccacattcctgtagaattccctggagaaatctgattcacaggagagctcacctcatagcatcagttacctagggagctctgtgggaagtcacttgagaatgctactgagaataataaaaagcatcctctctcactgacaggaagttgataatgtcttcataaatatttggaatgaattaatatgattcaatttactctttaatgtggatggtctctgatagcaacatattggaatatctgtttctaaaaacaaagcaatttttagaaactcagttaatcaatacagtgtttttcatggtattttctcatgacttggtgagcattttttggaacagtgtgtttttctttcagctctgttgtcatcacccaatggaaattttagacagcctttgtgacaatagcagaaaattttccttgctaaaatgtaattttattttgtgggtatattatatttagcctattttcaagctggacctgtcatccttctcccccagtgagtggtgagaaagctgtctaaggagattccagcaagtatgctttcttggggtggacatgtggttttctcagtggggaggggtcacaacgatggaactcataaagggtaaaactgcagcaatgaaaatacaaaaataagccatagtctaagtagtgtgccgttaaccctaaggccacaaactcaattgtttcaaatagttaaagaattagttggttctttcaaactaaaattttgtttctgtaattttgttttgaccttatgcaagtgatggttctaca

SEQ ID NO: 45309 - DNA, 1048 bp, Homo sapiens
ttcattgcagcttccactcacatctcacatctcccatccttggcagagtgggccagagccaatgcacgggatcctgcagtcagcctatgactttacccatgacgtctgacgataaattcttctttcagacttggctctgtatttttaaaaaatgatagctacactttaacagcatttataaatgttgccattggggttggggtggaatctataccagctctgtcccatatgttcccaggactagaaacatggtatgggctatgtctcactcagccatgagcacctttcaggcagatgacgactcttagtcatattttatttttaatgaagtgcagtctacatccataaataaaagaaagaggacatgggctccaggtgaaaccatggatatgtcacttactagtattagaatgatggcctcagcctgttcatatataaaatgaggaccttgaattgcagctaaacattctgaaagatattttctagctgtagtatactatgactttaagaaacattaagacaattccttatgaaatgttagacactaaagttgcctgtccataatcgagttataaatgtggcaatattctaggcagttatggcccagagagaaaacacatgactacttgtgtgtgtcatctctaactgtgacctgtaccttccctagtatacgttgagtgtgttgcaaaagactgcgtgtgtttatctagagaataaatattcaggtggaatgccaatttccctttaaaagcacattctttgtttcaaaagactgtattggatggcagtttaaaagggatcgcagctagttaaatttagggtgttgaacaaattccaatccaagaataatccttggcgctgagcccatggcatttttatttgattctaaattggataaattgtaactcatttaaattacttgctttctgtattttttcttctgagacaggcaaccaaccaatggtattttttctgtctttcacaagacagtgaaattatgacatattgtatatatactatcacatttcctgtaagtttcacatattat

SEQ ID NO: 45310 - DNA, 1033 bp, Homo sapiens
atggggtttcaccatgttgcccaggctggccctgaactcctgggcttaagtgatcctcctgccttggccttctaaagaattgaaattacaggtgtgagccactgcacccagccaccatttacgtttaataaattgcaaaaagcctctttacccatgatagccaaatgagtaattatggtgaacaactcagattctgttttacagaaagaaattatttgatggagacttttatggggtgtggtactctccacacattcctataaattccataatccagctagtgtgtagaataccagaaaagaaaatttaatggaatagttttataaccctggctgaatgagatgcagaaagttaagacatggcataaattggataggctaattattctaacctcttgccatttatatgtgtgcatgtatgtgattgtcaaataagacagacttctgtatgagtatcaatcttaaaaatttcttcttttatagtcaatttgattgggaatccaaatttgtggctgtgtctaattcggtattccatagagctcctcttatcatcctctaatatatgtctacaatgaataactctccactgtgattggcatggcataaaccaaggcatccagacacaggcactaaagcatatcccataaaaagagttgatgatcaccaaacttcattatcttcctagaagctaaagctaatgcagcaaagtctataaagattatgatcaaactggctctttctatggaatgaactagaatctctccaaaggtgaactgcagaaaactccacctctccttatttctgcttccacgtcactgccttaaatctcaagtacgtgtgaaacttctgtgtgctgagcctgaggcctgggaacaactgggtgacaataaagtctagttaggagagacgagttgtagcatctgagacaatcggtgacagaacaatacatgataaagtgactgcactgtactatttagcactgtattacattttcacattcattttgcattattctataatttgaggttcaaaat

SEQ ID NO: 45311 - DNA, 1035 bp, Homo sapiens
tgtgccactgcactccagcctgggtgacagagtgagaccctgtctcaaaacaaacaacaataaaatttttctaataacattttattttctgtcttggcctccaaatttttaagttgacagtgttatagtggagcatcttgattgatttgagatagtttttatttgaaaatatctagaatttttattttttttttttttcatgcagccttttctcttaaaattgcctagagagcattttgtctatcaaatatatttacaaggaaagaccaccttcgtaacgctgataaaccaagcagatagctaatgtagctgctggcagtgtcataattattggtgaaaataacaacacagtgcccttcattggcctgtgaacagatacattagctatgactatcaaagaattacaaggcttaatttaatgctatttgtttaaaatggcttaatgcatttcttcctatccttctacctccacgcacgttttttaaggcagcggcaaaagtagtagaaagcaaaaggacaagaacaataacttctcaagataaacctagtggtaatgatgttgaaatggaaactgaagctaatttggatacaagaaaaaggtttgtaatttaatcaatttgtatattttttgttttatgaatgttctgtctttatgtaaaattgatatgtctttttattaaaaataattattgagtagcatgttatcttgctgatgattaacatttaggtatttgaagtactgtagagttatttcatgacttgtgcaaattatatatgctaagcaaaagtagagaataagaaaatattacagtttaaataatgtggatagtttaccattcttggggtatgcttaggaacaagggtgaggttggactcctgtgccccttagttgtgtttagattctacatgttctcattatgtgattcatgtttcactgtactaagagtctagtattttaagatattattcatatatcttctctaagcataagctcactgcttcatctggtgctcaactgaagaaatagtgatttgc

SEQ ID NO: 45312 - DNA, 1057 bp, Homo sapiens
tcttgtcttttcttttttttgcctgcttcttctgagacatcaaaaaacatcttgatttctgcggagtagatgagatggagaaagatgagacaggcaacagaaatcttaagaggccacaggttaagatggggtactaagcagggagagcaccaaaggaagtaggccaaagtattaatagaagatcctagaacagattaaggcaaatcatttacctgttttccattgccttactatctttctggagccaattacaaactttcctgttttattttaggtctcacaagaatcttttcttatctaagttgcaacatggaacccagcaacaagaccttaataagaaagaaagaagagtaggaactcctcaaagtgagtactgttataacagttttagaaggggagaattgatgtgtcctcaaacaatccagccattgactttaccactatagcaaaaaaacacacacttcagaaaactgaagcacaaagtcttgacttcatagagttaattgagatagtgtttaatttagaaagttagctattttgactgtctagcttagggttcttttgctatggtggtacactgcttttctaccttcactgtgttcagcaacttcaagtatagtcatatgccacatcatgacatttcagtcaaagacagactgcattgcatataggatggtggtcctgtaataatgtaatggagcacatatggaaacttgataatgtggcacttgatattggcattgcatatcaagtaggggaaatgattgataattagcaatggtactgggaaccgtgggttttctatatgaatatatatatatatatgtatgtttgtgtaagtgtactcttaataatgttcacataaggacaaaatcacccaacgccccatttctcagaacatatcccccttgtaaagcaatccgtgactgtagttacttttcagaaacattaagtacagttgattcttgttattcacagtagttacgtttaataaagtctgagagcgttgacttagcaaattacaagtttctttttggtatgtagtcatttaacaaat

SEQ ID NO: 45313 - DNA, 1778 bp, Homo sapiens
aattatcatttttcagtaattacagttctgtttcttttcagttacatatatttgtcttaccaaactgactatgaataagaaagaaggagtgaggaaaggattatgcttcttagtactcctaaaacattatcgtaagaaaatttcaacgatcctatgcaataaatatttttcctttttttttaaacagataatggaaagacaggttcagggatgtgaaatgatttatttaaagacatataaaagaatcaagactcaaaacactccccctctgatttcaaaggctgatctttgcactataccatactgcttccagatttgaaggaaaaagttaaacatgtactttttcttagaatagcttagaaaaggaatttcattataatcattaaaaatataattgctcttttttctttaatgtaaatcaatatttatgacattatttttctacttttaggtacaaaaaagaaaaaagaaagcagaagagccactgaaagcagaatacctgtttcaaagagtcagccggtaactcctgaaaaacatcgagctagaaaaagacaggtatttggttttttaaaattcgaataacgcttatggacattaaagttataacttgaataattgtgattatttctgttcaacctccccaaaattttgagtgtaaaatatttgccctttgccatcttttattttgccgtcttagataggtgactaatcagcctattcaaaatgaaatacttcacccatatttaaaaagtcttaagttgggtgttggtactgacatctgtttggaattattgtgatactatcataaaatctgtttattagatgtaaggtgggacttaactccacattataagctttgatgtttaaattttcctaacagggatccagtgtaaaaagagttttctttacttaaaaacaaagaaaagataccatttgatcacaaaattttattaaggtgggtcaatttagggcttgattcatttgcttcccctttcagtgactatagtcttgtgccatctgtccagtgtctgaaaccattattttatgtattttttgattgtctagttgttcacagcagatggataaatctggtctttgtttttgtggtgtgtgtgtgtgtgtgtgtgtgtgtgtgtgtgtgtgtgtgtgtgtttcccccttttttttgtagagatggtgtctcacaatgttgcccaggctggtcttgaattacttggctcgagtgatcctcccaccttgggctccaaaagtgctgggactgtaggcatgagctactgcacccagtcaggcccttgttttcttttgtggctggaaccgttttcttactcgaaggtgcctttttttttttttttttgacaagctaattgcaaatagttcatactgaggtgctgcagatagtgtcaagttgcacgctactcggaatatcttctgtgactcaaagttatgttacccttcatttctcccccagtgaacatagcaagcaacttctacttttcatttgcttcctacacatattacttgcctttgtgattcccttttttagccttgccatctctggcctttagtaggttgaggggagctcctgctgttgctgaccagagatttagggggtgtacctcagggtattttcattagaaaaacagatggcacacacttcctgagatctgtagacagagttgctttttcatacacctaagttgcactgattatttataccctttctacctacattatggttcaggttgtaaatttctcttaacttttttcagagtttggga

SEQ ID NO: 45314 - DNA, 1022 bp, Homo sapiens
agacgatagcttattctgtatgatgttttcaaaactctttcagtcacaggtaaaattaagcaaagactgaaaacattcagatcaagcaaaacaatcaaggcataatcaaccatgaaataacactatatcaagctaaagttactctttttcaatagaagaaaaaaataaaatacttaatgctaaacactgttagttttcagttaatctatactgacaacattactactttcctctaggttaggggtgagcaaaatttttctataaagagcaagatttataatatatttattactaatgtattttatgtatatttcacatacatagtttctgttacatattttaaatatattttttaaatgacttaaattttaatatggttcttagctccggggctgtagaaaaccagccttgggctgggttttggcagtggcttgctgtcccctgctatagatgatacatgggaaaatactgcttaaacatactgcacccaggaccccaaataggattcagaaaacattggtcatttcttgaaagaaaggggcttttgtattgtatcaaacgtcatctgtgcaccttattaaaaatactacagctcagataagaacaagaaaacaatgctgtatatgtgtatgaaatttgtctaaaccacaaactactttttaaagctgaataacgtatatggcaagtttttgaaagaacagaaatgcttaacttggagaccatggagttgataggctctttaaagagagtttatgtggcccccaaatttgtatatgaaattttagatactatacttttctgtggagtacgtctgtaagatttatatgaccccaaagattaataacccactgttgaagtgcttttaatcagtcaccccacacatgaaaaatttattaatgcatctcttggtttttgtcagttaatgacaagcagtgtagtgaggttttgtaggagtgaaggccgagtcaggcagtaatagatggtcataggaggctgtcagcctttgtctagcgattgaatag

SEQ ID NO: 45315 - DNA, 1063 bp, Homo sapiens
agaccaaacatgagaaaaacagactttttattcagagcttgcggtagcaaaggaatcagccacgatctcttgtgtttagcagactcagaggcagataggtttatagtggggggaaaggggcaaggttcaggaatgctctgcttggagggtgttggcatgaggaagctggaggctgatcagctcactgcaggtgtcttacaggattgctttggggaacctatttggctttctctgattggtcccatgttggaagagggagcaaaatgttgggatgatggcagtaactgagtaagtcttgaccattctgaatggatcactggggagattgtggtttggcttccaggagtggttgctgcagagggtctgggtgagagttctattgtcacagaagctcgtccattgtccgtgtgtatgcctagtcccagagttgtttccagtttctggctgctagacttttacatttcacaatgaagtgtgattttagaaataatatgaactcttgcctgccagaacaagggccagtgaattttaaaggaaggaagcacaatctagaactcgacagcaagggtcaaccatgaaaagttaggtatgaatattgttaattcctagagcaagaattttttcaaaaatatagatagatagccaatagaatactaaattactctatttggaatactaataaacccagaaacaaaaagtagtgaaacaaaaacaaaatcacagggacaaacagaagaaataaaatggtacacctaaatccaaccacatcaataattatatcaaatgttaacggtctaagccagaaggtgcgtggcaaacttcttctgtaaagagccagatagtacatattttaggctttgcgggccatacagtctgtatactctgcctcaaattagccataggcaatatataaatgagtgggtatggctgtgttccaataaaactatatttacaacaacaaacaggctggatttagccacaggttatagtttcctgacctttgctgtggaattctagagtgtgtttccttcctttaaaattcattggaccttgttctggcaag

SEQ ID NO: 45316 - DNA, 1033 bp, Homo sapiens
gcccggccacacctcacatacacacattgcactcacacatgtgcttctcctccccagttccttcagcatgtttatgccagtttttgttgaatcagtagtaagtgttcatattatgttaactctgtaattgttctttacacctgagctgtgtagtttctatgtacatgtcacttattcatctccaaattctccaaccaaattgaaaatctcagaacataatgaaagatgtaggccctccttcggattgcattgttttttggagccatccctgcccctgctcccaggtagtctggctgctctgcaggcctgctgcaagctgtcaggcttacattgcccttcgtctgcactctggggatcctcatttctctcccaggttgtgttccttattacctggaccctcttgcttggtttacactcctgtttagatagagcacctcctcctgtaccttcacagaaaaagcacagagaatggaaaactcatatcttgcatgtctgaaaaaatccttattctgccttacatttgaataataattttataggatatagaattttagtttggaaaacattttccttccgaattttaaaggcattgctctgttgtcttctagtttcaaatgttgctttacataaatattctgatgcaattctaattactgattatttgcacatgacctacttttttctctctggaatattttagattcttgggtatctgataatctggaatttcatggtaagatgccttgttgtgaacctttttttattttttatttttattttttgagataagttcttgctctgtcacctaggctggagtgcagtgatgtaatcacagcttgctgcagtcttgacctcttgggctcaagtgatccttctgcctcagcctcccaagtagctgagaccgcaagcacgcaccaccacacacagctgattttttaaacttttggtccattccaagatggccgaataagaacagctctggtctgcagctcccagcgtgattgacgcagaagacgggtgatttccgcatttc

SEQ ID NO: 45317 - DNA, 1557 bp, Homo sapiens
aaatatatggaaatatatgtgtagagtgtgcatacctgtatacatgttttaaagtgagaaacttttaaaagattataaaatagactgcaaggttcaaaacatagatccccttaaatgacacttccgtcaccaataatcggactgagttacagtaattttactttagcaaacagacatgtattctgtgtctcacgggccacctgctgaatgagaggactccagttgaaaggtcaagaacataaaaccacaagagctttttgagtgggtcttcaacttagttaaaataaaaataaaggacctgtgttccttgagaactggcccctaaattttctttctctacttcagagtgtggcaatgatgtgtttggggactttggccaaaattgaaggtttaggaaacattgaacatgacttgagaatatttagaatgtttacaaatgcatttggaaatatttatatcaccatctatataaaaataaaactgtgaacagctggacaagaacactggtctactcgccgaacttttttccaagttccttgacaccgaggattaccaattgcttgccaatggagagtctgatttctgaaacgatatttcgaaagtgttagttacactaaaagcataccgaagaaaggtctaatttacagaattaaaactcggagttaaaaaaaactgatcacagcctgagcaatatagtgaaaccccgtctctactatatatatatatatatagtttttttttttttctaattagccagacatggtggcacacgcctatggtcttgggaggctgggtccacaggtgcatgccaccacgtctggctaatttttataaagaaaaattatttgtagggatggagtttaactgtgttgccaagctgatctcaaactcctgggtgcaagggatcctcctgcctcggcctcctggctcacgctgggattagaaacatgacccactgcacccggttccccaattttttttttaatgatcacaaacagagtttcccttgtttagtttctgtcaaagcaagttttaattcattgctactttaggacaccctcatgttgacagagtaacttggggttactgtatttgcttttcccgttctatctgagcacaagtgctgcataaaggaaaatggctgactgttctatgtgtatttaaactgggaggtctgaactaaatgatctcttttactgctttccaactctgatttcataatgaaaaaacaatgagagagctgaaaagaacaaagccagattattaaaattattatttttaaagtcactgctacctcagccagggtttaaatactatatgggtacaaattaaattataaattcatttaaaaccaaaacatggatgaggtattcagaaaaatattatgtaaatattttctatttgatataaattccttacccactttattgttcttatggtgtgctcaatggaggccatgaggcactagtgactaataaacataaattctagttattaaatatgaaaacattctacaggaataataattgactggaaaggcccatattttacctttta

SEQ ID NO: 45318 - DNA, 1064 bp, Homo sapiens
ggttttagtaacttgaatatatctaacccatgacaatctgagaaaatttaatagcctcacctgagagttagatgaattttaagtaggaaacccctttacatttaagttttgtcttgagttgagaaatattaatagcaaattcatctaaaatttctgctttagttctttcagaaactaaaattaagcctctttcaattatggtaagtagtctatttgcatgtgtctaatccagatgtctgcctatatggataaatgtgcagatgacatgctatgtttgtttgcttgcttgtttttctatgctcagtaataagtagaagacatgattatggtgcagttacagccactggacctgggaaagaaagtcctaaatacccaggatgtttttggacccccaaactgtactatgctgaagttccactagggggtgtactggcagggtggatttgtatcttatttcctgcacatagaaccagtattttcctgagagaaagggtcttttgtaactaatctttggagtatgacaaaatctaatagtccttaagaaatagagaactatttcctgcctcagctgaatgggttaagttcaatattttgagcctgtaactccagagatcagattaaaatatgttaatctttcttatcagaagttggtatagtagttagctattcaaagaactaacacttctagattctatcaactgacctagaagctcctttaggctgagaccccatatagacataattggaaaataactcagaagatgggggtttctgattttttctaaagcatacagctggtccccataataggtagccttcagaaggttccctgtattgtgaattatcattctgttaagataccattgttcagagcctaggctgacagagcatggccttgggattcatttgccttgacatacctggctggccagttccagtcacctgcatccctgggtttatacaggcctatgccatccccacactggagtggatgcgaggggacgcaaaccttttcatgtggtctgaaggaatgctaacattttttacttgaagagcttccccag

SEQ ID NO: 45319 - DNA, 1053 bp, Homo sapiens
cttcaacatccttccatgcatagggcaatcctatggcttaaaattacccagccccaaatgtaatggtgctgagattgagaaacgctgttctagagcactggttcccaaactcagctacaaatgggaaccacctgagggacgttgcctcctgatgcctgattctcccattggagattctggtataattggtctgagaggtgacctgaacaccaggaggaaaagcttcccaggtgattctaatgtaccaaaccactgatttataggaaagttgccatctgcaatctttaaaatcctttaagaggttcacaaatacttatttttgttttttaacaatgcctatcccaatgtaggtacctcatagaccctcatatgtgttgagtgaattctaagttctaacagtgcatgtttaaaaacagaataagttttcaggtgtaatctcttgaatatatttacccttcatttatgtaaagattttaactttttaaagatttcacagtaagcaaactagaaagcagggaagaatttgaactatttacacttaggaattacaggggttgatgatggggacattgagagctgtgctgttggaacaggggctaagaagtctgccactgcagatggccggagcagtggctaagctcgcatgcatgtgtttatgcgtcatggaagtagttactggtcactagagcagaaccgaagcctctgccctttggaagatctgtctttattacaatttctgagaagcagtttgagtttggggcaaagcaaagagatcaatgacagcctgttgtttggcaagctatttggctgcaattttgtgggttattttcattattccataaagagttattaaatagggggaggggcctgaggctgaaggagatcatcaaacactcgtttgatcatctagggcccggcaggggaaagatgagggaaaacagcatttcagaaacactgttcagcattcattgtttaacacattgagcctccatggactcaagtaaaacggaagaaggatgattgtttcaaataatttgtaatttttttaataga

SEQ ID NO: 45320 - DNA, 1041 bp, Homo sapiens
tctgcctcccagtttcaagtgattctgctgtctcagcctcccaagtagctgggactacaggcatgcgccaccacgcccagctaatttttgtatttttagtagagacggggtttcaccatgttggtcaggatggtctccatctcttgacattgtgatccacctgcctcggcctcccaaagtgctgggattacaggcatgagccactgcacccagccttgaatttttaattttatctctgatatacttcattaagtgtctggagacctaattatcctaaaagatcatacattttctacctatgaattttgctgcatacagaaagtgccctttcctcaggaagttgctgtgtttcatttctttggatggactcttatctagaatacatagcagctctgcaaaggaacagtttttaaaaatgggaacttctacattgaaaagtccccatttttgtgccaactatgattagtgagaggaagaaatcttattctatggcatatgtatggaagggtgtaaagattcttttgaaaggtttattcacattgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcttttttttttagaatgtcttgtttaaatagtggccaatgtttaaggctgttaaaataagccaacttttactaattggggagttttataaatgactgattaaatttaaagaattaacttacatgcaattgtgtgattattagttatcagcagtgttgtaaggaaaattattgtgtttttttttatgatcattatcccactttaggtaaagaaaaatattggaatggaatagtgttgggaaacagacattaacaacctagggtgcctgcactcaaatagccgatgttactgtccctagattagagacttgattaagggcttgtttgtaccaaaa

SEQ ID NO: 45321 - DNA, 1031 bp, Homo sapiens
ttacgggagttctaaaaagagaacaaagaatggggcaggaaattgtgtgtgtgtgtgtgtgcatatatatatatatatttaaataatgccatattttcccaaatttgatgaaaaaacatttacttactcgtccaagaaaatcactgaactcagtgaaagataaataccaagaaagcctcacgtaggcatatcattgtcagaccgctgaaaacaaaaaaatcttgaaagcagttagaaggggaaaaaaaagatatacacaagagaatgatgataagaatgtgtgctgacttaccagaaatagtggaatgcagacaacaatgaaaatgtctttaaagtgctgatggggtgggaaggggtggtgagggaatcctgccaattcaaaattttatatccagagaaaataccccttaaaaacttgggttttaaagacactttatttcatataaattgaagccaagagaagttggatccagcaggcccctgcaaaaccaaaaactgctaaaggccattttcagactgatggagaatgatacaaaatggaaaccaaatccacagagaggggaaagaaaagtagtgccaggaatggcaaataatgggtacatataaagactttcattgcctcataatttccttaaaaggttactgtttagaacaagaataatagcattattatgtaaaatgtaaatttctgggctctataatatatgtggaagtaaatatatgaaaaacacaaaggttggaggaagtggatgaatggaattacactattgtaaagctattaggttagtgatatgtaaagaatgaagtgtgaggacagatgtgccaaatgaaaagtatcaagtgggaagtgtgaagaaggaagtagtgtcaagggtgaagtagtgcaattttgacactaaataaactctgataagaacacgttgttagctctggaggaacactaaaatttaaaaaatccctaagaaacaaatagaaataaaataccaatgaaagaagcaacaaaacaaataaacagaagggacaaatggaaa

SEQ ID NO: 45322 - DNA, 1044 bp, Homo sapiens
gagcagcaggacctagactgaacccctggtgtttcagtaacagtatccccagttctgtataagtgcatgcttatcactaaagataatggagagagatgtaagagagaattgtcaagagaatatgacatatgacctaagttccacctgtctcttgaatcagttaaatgaagtcaccatgggacattctgatgccaattctggtgccaactcatccaccaagacgtgaagtctgctgaaaattacagcattcacggggagaagaaaaatagcaagaggaaatcttaaattgattgaatttatctgcatttccaaccagaaactattgggaattggcgatgttacattttttaccattagcagtaatggaggcttcataactaaattagagtcagttactgagaaaacataagagtctatcaacatgaaatattagacaagacataattaaaaatagttatttacagttcagtattagagttttcatgtagaaatttcttcccagcattacttgggatatttaaaatgggctttttctttgaatattgagaaaactcaatggagaaatgaggaaaatgggagaaaagtatagtagttctttgtatgagttaaagcttaacaacatcatagttactggttccaaggagtccactgacatcaagtcaaaagtaagagcaggagatgtggagacaaatcttaaggtggacaagtctgggaacctgaacagaagcatgtgaaaagaagcagctcagtggtcaggatctgctcagttgttctggcttattttggctgttgccatgttgaagtgtgttcttatggccctgtattggtaatgaggacttgtgtttgcaattaaataaatgttaatatgtttttacacatagcatatgatatggtttggctgtgtcccacccaaatctcatctcaaattgtaatccccatgtgtcaagggagggacctgtaatccccaggtgttgagggagggaggtgattggatcatgggggaggtttccctcttgctgttctcatgatagtgagttcttatga

SEQ ID NO: 45323 - DNA, 1026 bp, Homo sapiens
ctttttcttcagttggttagtctagaatataaaaaagtttattgtagtcagcaaatatttttagaccttgagaggtgctagtgggttatgagaccaatgggagaaagtactccaacttgtagctcaatattagcacataaatgttaatgagtacaaatcattccaagcatgtcaagaataagaaatatttggaaatattttgaaaatgcatcctgttgtgctgattccagggtgaaaacactttaagctgttaataaaaagcaggcaacatactctcttcatctgacccatgccatggcatagattgctcatgggagactaattttggggttgcctgtttgctcccaattattgctttctggaaattggacttaagactcagaggtagactcccaatggctttgtctttaatacatggctctgtccacacagccaattgagttaaaagaatatattcgacccaagctggaccaatgctgtatcctaggagttatagaattggaaaagagtgatcagaaaactgaggatatctggggctgagttttgcaaatggtagagctcttggaggaaggccaatataaacttttgatgcagaaatccttgaaacttttccttcctaaaccatcccttccttttttttttttttttttctgagacggagtctcactctgttgcccaagctagagtgcagtggtgtgatctcggctcactgcaacctccacctccctggttcaagtgattcccctgcctcagcctcccgagtagctgggattacaggtgtgcgccaccacagctggctaatttttgtatttttagtagagatgggtttcatcatgttggccagactggtcttgaactcctgacctcaggcaatctccctgcctcagcctcccaaagtgctgggattataggcgtgagccactgcgcccggccaccatctcttcctttaattccaagagatactcacaatcctttcaataattgtctttttcccggccctttaccccccataagccagagataatc

SEQ ID NO: 45324 - DNA, 1033 bp, Homo sapiens
gtagaaataaaaaatgatacattcccattaaaatactactttagctggatccagaaaatggatatgttgtgttttatcattattcagtttgaaatatttcctttggtttttttttcatggtttatttatatgtgtcttgttcaatttccacatattcggtttaaatatatattttattattgacttcccatttaattccactgttgttagataacgtgttctgtaagattttaatctttgggcatttattaagatgtattacatttattacctaagatatagtccatctttgtgagcatctgataagcactcaaaaataatgtgtatattttggagatgtagttttaatgttctataaatgttagataaagatcatttatagtattgttgaagtggtttatatatctactgattttttttctaggtgatctatcaattactgaaggagatgtattaaaatattcaattctgaatgtgatcttttttgtcccttgaggtctgttaatttttgttttatggatttgaatgactgtatattagatgtattaaatgcatattagacacatacacatttctctggtagtattttgaagtctacttttttatattgatgtaaccacttcagtttccttggcttagcatttgcctggaatattctttccatctttttatgttttacttatgtgattttatctgtaaagtatatatcttgtagttgtactttttagatatttgatttggcaatctcttttaattgcagcttttagtttatttacattaatataattactgatatgtttggatttatgtccaccgtttcctattgtttatttgaataatgtattttttttcctttttatgttctctttttctttggggataatcaaattattttagcattctatttaattattaaatttattttaattataactatttaaaaatatctatctatcaaatttgcattacttttttactgttttctttagagattaccaatgcctctttgctgattggagttaatattttactg

SEQ ID NO: 45325 - DNA, 1050 bp, Homo sapiens
catttgttgataaaggagaaatttattttgactaagcatcaatgagaagggaatgttccatttgtaactttctactgattagtttctggctctgaaccttccaaatcttgattctcctccatttcaacacaattctggtgtcagttgctctattacaatacaacttctgaccctgcaacttcatgtcatgtcgccaattttactaaaacatatgtctatgtgaacacattgccagggccacttccagggcctcagctagtagactcctttatgggagggcccctgaagcttaagcttccttagcttaatggaaaatctaatactgaacagcaggaacagaaactggcctgcagggagtaaaggagggcctagtggataggcaatgaagttcctgcgggggcctgaggagttaatccaggaagaaatgagctatggaatggtggttatgaagagtggtagggtcctaagaaaaggttctatttgtggagttgacctgttatgtttggggacatgaatatacagagaaagagagagagaatgagagagaggaggagaaggaagataaacaggtggaggagaaagaggagaagagaagacaaaaaggaagagaattagaatagcagtgttaaaatgttcagtcacagaccctgggctttttgctttctcttcccactttcttggagttgttctacattcctgaaggctttgtccttgtattgggagagggtattctctatcctcttgggctttccctacagaacatcttctgccagcacttggatgtcagtctgcatctgaggccactgccaatgctttgtcccactttggcctttgggcgttgcacccttaccctcttcatttttctgctcttagccataaatctgtcccacatttctcttggaaaaacctctgagacagcaaggaaaggattagaggataggcacagaagcatgctgagttaaaaatggggtacataataagcttaagcagattatcctaatatagatactttcccgggaaagcagaacattaatgctctgctctctaaag

SEQ ID NO: 45326 - DNA, 1068 bp, Homo sapiens
ttttctgactcaatgatctgtctaatactgtcaatggggtgttgaattctctcattattattgtgtgggagtctaagtctctttgaagatctctaagaacttccttcatgaatttgggtgcttctgtgttgggtgcatatatatttaagatggttaggtcttcttgctgaattgaacccttcaccacttgtaatacccttctttgtcttttttgatatttgttgatttaaagtctgttttgtctgaaattaggattgcaacccctttattatttttctgttttcctcttggttggcagatttttctccatccctttattttgagcctatgtgtgtcattgcatgtgaaatgggtctcttgaagacaacatacgattgggtatttcttctttatccagcttgccactctgtgccttttaatcaggatatttatgccatttacattcaaggttagtattgatatgtgtggatttgatcctgttattgtgtcattagctgattattatgtcatcttgtttgtgtggttgctttatagtgtcaatggtctgtgtattcatgtgtttttgcagtggccaataatggtctttcctattcatatttagcacttctttcaggcgctcttgtaaggcaggtctggtggtaacaaattccttcagaatttgctcatctgaaaaagattttagttctcctttgcttatgaagcttagtctggcaggatatgaaagctgtggttggaatttctttgctttaagaatgttgaatataggcccccaatcttttctggcttgtagggtttctgctgagaggtctactgttagcctgataggcttccctttgtatacgacctgtcctttctctcttgctgcctttaacattttttctttcattttgagcttggagagtctgatgattatatgtcttcatgatggccttcttgtgaagtattttgtgagggttctctgaattttctgaacttgaatatttgccattctagctatgttggggaagttctcatggataatatcctgaaatatgtctttcaaattgcatccattctcctcatctcttt

SEQ ID NO: 45327 - DNA, 1081 bp, Homo sapiens
gtcccagtggggactctgtgtgggggctccaacctcacatttctcttccatgttgctccagcagaggttctccatgagggttctgtccctgcagcagacttctgcctggacatccaggcatttctgtacatcttctgaaatctaggtggaggttcccaaacctcaatttttgacttctgtgcacctgcaggccgagcaccacctataagctgccaaggcttggggcttgcaccctctgaaacagtggcctgagctatatactttggctgctgttagccatgcctaggacatagggtgccatgtcccaaggctgcacagagcagcaggggccctgggcctggcccaagaaaccattttttaaatgatggttaacagacctgtactttaactatatttaatatgttcaaaaaatttaaaaaatacaaaataattgggaaatttagcaaaacactgaaaagcactaaaagagctaatgaaaattccaaaatgaaaaatattcagtgactaaaattaagacttcatgggatgggcataacaacacattagagagagttgaagagggaattagactgtcagaagatagatcggaagaaaatagttaggctgaagtagagacagaaaaaagggtggaaaatttaaaaaacagcattagaggtaaaagggctattgagaaaagtttttacatatatagaatgggagttgtagaaattaaagtgtgagaaaaaatgggacagatacaatagttgaagaggtagtgagtgaggattttccaagacttatcaaagacacccagctacagacttaagaagtgctagaaagctatatcagaatagttaaacaaacaaactacacttaggcactgcatactcaaatgtttaaaagtataaaataaagaaaatcttaaaagtattcatagaaaaagacagaaggacttcaaaggagcaataatagactgagagttggcttcaacaactctcaacaaacaaaatggaaaccagaggacaatggcataccttcaaagcactgaaagaaaataactgtgaaaatagaattctacatccagcaaaaatattcttcaaac

SEQ ID NO: 45328 - DNA, 1040 bp, Homo sapiens
gctacagccactccaagtcagcaatggctgcctctggctgacctttaggcaacttttacaatcctggctgccacctctttgatttttttgtgcaacttagttgtcagtttagcagtttatgaagtactaatattaaatcactcttttttttccagtaaaagtaaaacaaaatataaggatttaagaattctatttacctatgtgtatccccattattctgtaaacttcatgaagtcaggaagtgaactatcttgttcactgtcatattcctggcacttctcacatattaagggctcaataaatactgatgtcttttgcagatttttaactacctgacatgaaattaccagtaaatacttgggcatgcattgaaaatatctgactatatgaaatgtttctcaggtctagggtaaatatacttttaaaaatctctctaaaatggctagctagtaaaagcatttttatttctacatttgtgtttaaaatttgagagtgacttttctagtaatgagaaaaatgttcacttgtaggcatggtttcatgtaggacagagttgtgtttttacaattattcagtgacgactcattgattttgttttacaaggtggattttgcttgcaacttcatttgattttaataaaattcctatgaaataggtgagatgggtattatcatcccctttagtttatgtaatggaaggttcagtgactaacttagaccatttcccaccaaagaggattgaaaaaaatcctgtcactggggctaaggacacagaccttctaactctaaatcccatatacttccccaaactccatgctttctttccagatagaaactatggccttggtaaattactcattataccttgctgctttttaagtgtattaaagatcacggtcctgcccctgttccactggaggactgtagaggttactcaatagagaaggtcaagttgctggtagcttcatggaaccttccccctttgctgtgaggtctcctcctttaatacaaaatttggtggcctctgttatatgcctcagt

SEQ ID NO: 45329 - DNA, 1059 bp, Homo sapiens
tttccaagtcactgagaagtaggtttttaaaggaattttgaaaaacaaaagactgattatttcctgcaaagaaaagtctgtgtgtgtgtgtgtgtgtgcatgtgttttttatgtggcagagaaagatattaaggaggagattgtataattaaaatagcagatatgggactacttggaggacgggcaatcataaatacaagtttagggcctggattaccttttcacaaaatagagaaaataaatattatttttcattttttaatttcgagatgtatcctgtatgtactaggcactttattatggataaggcttggtcaggaaataaaacaagtccaggattttcaacaacaaagactggaaagaaataatctgtaagcatagaacacttattcccaactccagtatcttgatatttcaggatgttggcagattttgcaaggggttttaagatattttaaaataaattcctaaaattgttcatgggtgagtcactaaatactagttacataggatcagaaccccaaacataagtttttgtgagaaaaagtaatgtatggtcaagtaaggcccaggtcggaagtcagaaaatgaagattagatttcagatttgccactaacaaactgactaactgaccacctacccacctacctacatacttaggtaaccttggttaagttattcagtttctctgagcttcaatgcctcatctttaatatgggagtgacactacttgccctgccttctttcaaggggtgttttagagaccataataaaacagaaatgtgaaaatgctttgtggatgtcaaagtgctttacaaaaatgaggtaagagacagagtttgttatcaccgtgtaatctagggaatatgcagtagtttctatttgcagaagttactacatttttttttttattttttacttttaggttcaggggtacatatgcaggtttgttatataggtaaattgcatcttatgggggattccatctgatcttcaacaaaatcaaaaaaacattttgagagttattgcaggttgggctccacaagaggcagattctg

SEQ ID NO: 45330 - DNA, 1044 bp, Homo sapiens
tatccacatgttgtataaagttccaaaagtgattctctggaaactgtagttgggttaagtgctctgagaatggaacttgtgtttcacagagctggaatttgaacccctgtccccaggcatgagattgttacatctttatatcactctgccagttagacaactaagtaataacaaattgtcctatgaggttagtaagacaggccatataataaacagaagcaattttttaaaagcttcatttaacttgagaagtaaagcgatactccaaacaaggatttctgaacaaaagtactagagcaatgaataacatcatagagacaagaagggatgacaattgctagatgagaactgtcaccaattccagaaaaaattaagactttagaccaactttttagtcagtatgaaacaaaatttaatatggatagtaattgtcagaagagcaactttattcaaaactttaaaaatatgtggtttttctgtgatttgaaaatctgttactttgttgcattaccacattgtggtaaatgtcttactgttaaacctgtatgacatgaggtactgccttgttaaaacaaagaagtaaagaaacctagaaaactgaaaataattgttttatggtctttgtctactaattctaacatttgtgttggttctggattggtttagatcgatttatttttctcattatgggtcatattttctttttcctttgcatgcctgataatctttggctttactccagacactgggaatgttatacttttgagtgttggatatttgttgtattcttacaaatatcttgagctttgttctgagatgtagttaagctgcttaaaaaaattttgaaccttttgactcttgcttttaagatttgttaacaagggccagagcaacatttagacttgggctaattgttatctactagggagacaagaatcttctgaatactctaggcaatgttccatgctatatgaatttttttttcccatctggctagagggaacaggtactattcccagccctgtatcaacatctctaggggtc

SEQ ID NO: 45331 - DNA, 1055 bp, Homo sapiens
tcattaaaatcctggcctttgccaaaagacttagagcacagccattgtgttcttggagtgaactgtaattttgcttaggtcacagacattttagtggccaacaatattaagatgggtactttttaatggtgttaagtataaatgaaatgcaaagggtgagtacgataattacaaaattgtgtttatcgtgaagatagtctgtataagaaattgctaggacatttacattcattaattattgaaaatgaaacagccttcctattattctgtcagataaagaactctatattccaaatgccaatttcttagagattttattttctttattgggtcctaaaagctcttcatatttatcctgggtgcatttgcggccatgtacatatagccaaaaatatgtgatgagttgtataattatctggtgaatccaagcctagcaggacaacctgttaaagagataaaagcaaaactactttcaagtcatcattgcttggttattttgaactgaaatgtccagtagatcttccatttgctttggttaagaaaaaaaagaagctcatttttttcttcttatatgagttattttctctataatgaactacaaaaattgcattcatatatttgctttttgaatattacctgtattattaatgtgactgattagagaaaaatagaatagattgtggtccattttttttttagtattatgcttaagtacaaaagttgagaaaacatttcatggggttttttttggtaagcaaaagacaagctgatgtaatacatttgtgtttgaataattccgcatcaatatacatgaacctgtttatcctcatcccttccaaacagattgtaatagaaaaataagatacttgtaggttatatccaactatttaaagtatgcttttaagtcaaatgtacattaataatatttagagggtgaacacaggcatgttttgggtatgctcaatggtgggatatattgtctcagcccaggggaggaagatgggggccttgtgcagatgcctgggcccagaaggcattgagtgctgctggtgagg

SEQ ID NO: 45332 - DNA, 1051 bp, Homo sapiens
gacaggagctcagtccagaggccagagaggaggggtatgaatgtggagaaaagggtgggcttatctgaggccatctttggagcctggctgtcactataggtacaagtgagggagcagggctgtggcagtaagggcaagaattcccaattctgtggtagagcatcctcatgaattagaaggtcaggaaaggaactcatatgacaaaagataatgagacaaattagcataaaaacacatctcttgaaatttagctggtcctaaaatctagaagttctctttattatttaaagggaatgtaaatgaatatggcattatttttacatttattttaataatctaaattctatcacttttttagagttttattttacctatgcctattaaatttcatttttaaagtatcttttgcctcacacatgctactgcagaaacccacaagcatggatggaatcctccttgtggtctgtttctgacattggtttttctcaagtactccttttaaaacttgtggaataatactgaaacccccaacagacaatctgctctcctgtgtttattactgagtaccaaagccacagctttaaccaccgcagcactccattaattgtgggcatgggatgctcaggagaaccaccccttgtgattgtggcctgaaaccctccaggaggcctataattgactatctgacctccaaaacgggagtgactgtattaagggttccacataaagctgggtttggtttattttgtgattggtatgacacattatctgagcaggaagtccagatgttgtcaggcatgtaggcccataaatctggagaatgataaaaatgagattgtaggcatgcaaagagagatgactggaatggaaaaaaaaaaaaacccagtgaccctccctctgcaggagtcgctgcatgacctgaggtgggggctatagcttctttcctactaggtggaaagaaatgtagaagaagtggctttgctgatgtagaattgagtgtcagaggctactgacacattgcttttgccagagtgcatttttttccctacag

SEQ ID NO: 45333 - DNA, 1035 bp, Homo sapiens
aaccaaggtatttgggcaaaaaatagcacaatgaatagaatagtacgtcacatctcaatactaatgttgaatataaatggcctaaatgctccacttaaaggatgcagaatggcagaatagatacaaattcactaaccaagtatcttctttcttcaagagactcacctaacacataaggacttacataaatttaaggtaaaggggcggaaaatgttattccatgcaaatggacaccaaaagtgagcaggagtagctattcttacatcagaaaaaaaaaactttaaagcaataacagttaaaaaagacaaagaaagatattatgtactgataaaagtcattatataatcactagtctaacaggaaaatatcacaatcctaaatatgtatgcacttaacactggagctcccaaatttatgaaacaattactactatacctaacaaatgagatagacagcaacacaataatagtgggggacttcagtactccactgacagcactagagaggtcatcaagacagaaagtcaacaaaaaacaatggacttaaactataccctagaacaaattaacttaacagatatttacagaatgttctacttaacaactgcagaacatacagtcttttcatcagcatatggaacattctccaagataaaccatataataggccacaaaacaggtctcaacaaattaaagaaaatcaaaattatatcaaatactttctcagaccacagtggaaaaaatttgaaatcaactccaaaaggaaccctcaaaaccatgcaaatacatgaaaattaaataacctgctcctgaataatcgttggatcaataataaattcaagatcaaaattaaaaaattatttgaactgaacgataatagtgacacaacctctcaaaacctctgggatacagcaaaggcagtactaagagaaaagttcatggcattaaatggctacatgaaaatgtctgaaacagcacaaataaacaatctaaggtcacacctcgaggagctagaggaacaagaacaaactaaaac

SEQ ID NO: 45334 - DNA, 1051 bp, Homo sapiens
gtaatcagtgcttttaaccagatttcatttacttaggagatttgtttactttatctgattatgagggaactgtatgagtcacaattcaaattaccaataatatcagacagttagattgagcatagctgggtcaagttattgttagtgctgggtgactctctgatgtgagcaaactgtgccccacgttttgactcaacctgctccgtacctctatgctgtcatggactgccatcatggacaacactatgccttgacagggctcagtagtggtccctacttttgacatttttctcctttctcttcttcaatacaagtctatcacttttgtgaactatgcattgttcattatccaagtccactggaaaactgaaacatgaacacaaactttgcctcctctggaagctttccctggcccactagctaggtcatattctagctgtcacacattctcctggctctctgtgcatctgcactgcccttttcccaggtataattagatattcatgtaagtacttctttaatgtacattttcccactgtactgtatgctctaagaatgaagggacactatattgtttactgttctatacccattccctaactcaatgccttgtgtatgtaggaggatcttaatcattttactgaatgaatgaatagaatttcagctagattttatataatagtaggcactccatacatgttgagttgaatactgcctcaattccatgtataagaccttttctcaaatgggattttgtggaacagtggttggaatttcagtcacagtgacagttccatgggagatataatgcctgctcggcatttgattagagctgttcctagtttccaataacaatacaatgccttcctcccaaatgtagtatccagtcaatgagagctcatgggatttgctttattccaaaccatgttaatttccctttacatttgtacatttgctaacctgatgtagtaatggctggatgttatatgaaattaaaaggattaaataaatctccttgcttcaaattcagaatgcttttggttaaattaaa

SEQ ID NO: 45335 - DNA, 1029 bp, Homo sapiens
ggcgacaagtcatccttctgcctcagccttctgaatagctgggattacagggagttaacatttattcagtttatgtgtgctagatactaaatgcttcacatatattaaattgtttaattctttcaataactctatacggtataagatattgttatctccactatgctactaaggaaactgagtcaaggagatgttatgaatacccagtgagactaaataattagtgtaagcattaaataggaaccaaggccattcgtctccagagcccagtttcttctgataataacttaaatactaataaggtcttatgctattaatctcatctcagtttttacagtatcttctaaagctaaaaatgaaataaggtaattttatttttctcctttgtgttctatcaattatttatatgaagcatatgaatgatttcactgaattcaatttgagcatctattaggtgaaaataatttaactgatatttcatgtgtaaataaacaatacggcagattgacttctgagacgtgttagaatagattttgtaaaaccctgaacatgaaattttaattgaaactaatttatgaaatcaggaataaaaatgataatagtcacatatttgatcaaatagaagctggtgcttatggtattaatttttatctagttttgcacgataaattttgaatacttagttaattataaatgtgtgtgtgtctacacacacacacacacacacacacacatatattttaggtaggagtgttagtttgctagggccgccataacataatgggccacgtactgggtggcttaaataacagaaatttatcttttcacagttctggaggctagaaatttaagattaaggtttcagcaggcttggtgtcttctgaagcccttctccttggcttgcagatggctgcttcctcctggtgtcctcatgtggccgcccctagattggtgtgctgtctgtgtcctgatctccttttataaggacaccagtcatattgtatgagggcccaccaacttgacttcatc

SEQ ID NO: 45336 - DNA, 1091 bp, Homo sapiens
agattctataactcaagaggatggcgattagtataacagtcacaaaggccaccattctgttagcagaatacacagacgatatctcaatttttacttctggtaaatatagaagcacttattgaacacttactatgtgaaaggttttgaagtgtctggtatggtggctgtgtcccattgatgtgatggaatataagccatctttctaagtgctgctcagagacaaagagttttctaaggtgatacttcctaactcattctgctcaccaatattatgggttacatttggtgcttagatgtcggggacattaaagttgttcagagttaaatctatggacgtagtcatcaagagtttccatgcattttttcagcaatgtttagtcaaagggctgcatgtgagtggtcttttgagtcatcagtagatgtagtataatgtcacttctgtgtcttcgcttacttttattgccctattgcatagcaagactttatttatcagttttagacaacgattatggtgggaacttgagggcaggatagagcttttctactagttaggacatatatgtagttttcaaacatgaggatgttgctactaatgcatctcctagaatatgaagaagaaaaccacataataaagaatgcaggccaggcgtggtggctcacgcctgtgatcccagcactttgagaggctgaggtgggtggatcctgaggtcaggagttcgagaccagcctggtgaaaccctgactctactaaaaacacaaaaattagccagcaatggtggtgcgcacctgtagtcccagctactcgggaggctgaggcaggagaatttcttgaacccaggaggtggaggttgcagtgagccgagattgcgccactgcactccagcctgggcaacagaacaagactccatcttaaaaaaaaaaaaaaaaaaaaaaaaaaagaaatgcaaaatgtgtctaattacaactaccatccacccctttaaataaccaggataaaaatgtggtataactcttgggaaacctctgtaaattcaatttacaataaggtcaatgaaagtactgcttaaagatacattattgtaatgaccagt

SEQ ID NO: 45337 - DNA, 1061 bp, Homo sapiens
aaataaaataatgtaagatttttgcagtattttaagatcttttgatagactaattatattgcaaaaggttgattgcattataaaattatatattcttcctctacagagtcagtagcaaatgcatgctatttcaaagctatgttgtatatctggaagcttgataattgcagttcatattttcttaccaaactgataatgtgagatttttaaaaaataaccttctaaatccctatgttttgtcctaggtttaaaattctatgagaaccagaccacacattcttttgttcttaggctgtgttgttttcagagatgctgacctgttagtgattaaccaagattagggtcttggatgcttgtggttatcagaaagctttccctgaggatgtctccagttcaaggagaatttcacatttatatctaggagggatgccctaaaattgtattgactgtatataaagatttacatttgctttgtgaatgcttgatgatgctgttgtataatgactgaagtaaaaaatttgtaaaaaatttaacactgagtgtgcatggcctggacttagttttgagatgctaaactgtgctcatttcaccctaaatggagtaagaagtaaatgtagcttagtatatttacagtaaaataagtcatatatgatcttactgtgtcctcagaataaccatacaaggaagtagaatgtgtattcttacaaggtaaaatgtaaaggtgtgaaaaatgaaagaaatccaactgctagccagatttattcttttctttctgcttccaaactgcgtctttgtgatattttccactttgctatttactagtctgtttcccagctatactgtaaattctgtgaaatatttctatttatctcatttttccattacccatagttcttcaacaagtttttattaaatatagcagttaacaagtgaaaaaaatcagtggcagtactggggctcaaacccaggaatgaatctaaatatactcctttgttctcttttactataacgactcatctaaacaattctaaacttcattttgaaattaaaagataagcacc

SEQ ID NO: 45338 - DNA, 1049 bp, Homo sapiens
gagaaatgatgtaaaaacctaaaggagatatacaaaatatctaccaaaaaggagatacttcaaagcaaattatctaaacatagtatattttctcataaaaattagaattgaaatttatgatttttaaaaaagaatataattttcctgactttacatacataattaaatatgtataacacatattcaggtctgtacagtattttagaaatttgaaaaatttaataagatattgatttttaaagatttttagtgcttaatatacttggtccaaatagcaatgactttattttagggatagatgaaacattaacaaattacctaaaacttttgcgtttttacacctttcatttttacttctacaaaatatcagtaatagtggcagctaattttatctggaaacaataagaatatttgcctgacttgggagatattaggcataaattgaatgtttccagctaaaattatatgtcattgggtaaagtaaataatttaaaaattgattagtatttcataaaaggcaaggtcacaggctgtgaaaatatgaaaaagtatgttgaatagataatgatgagaaaaatgtgaagacagttatatttaaatgcaaagatccatggaagaaatcagctgcttgataacttactagaagaatgtattattgccactgtactccaaaccactaatgagaaatgttttttaagatttaagattgtataaatgctttgtacctagaactgatggaagtaattggtaaactacttaatcaagtcccacttggaagtgaaagggaatgagaggatagaaaatgtacgctgggtaagaaacccaacaagtcagtggagttctctttacagaaagaaacaaagatagcagtaattaatgaccctgactctgtgccaaaaaagctttcttctgacaactccaacttaattaaaacttaagacatttcaatggcctccgaaagcccctgatggggtgaactcttgcagactcgtgagaaaattttgtaaattaaaggaaaagatgtgtgttaccactagtgccatggctct

SEQ ID NO: 45339 - DNA, 1052 bp, Homo sapiens
ggtcctgcatgcggtgacatctttagcaggcatgcaggaggttatgaaactctaccttgggaggatctcacagtgaaatttttccccccagagtgagctttaatttcctttctcatgaccaaagcaatttggctttcatttaaaagtttctttgctgccagcagctaataagtgtaacaggactgtaaaacattctgagacaaaaaaagattaatagttttatttgagagagaccagtaatttaaaacataagacctagtcagggtccattatacaataattccaatgttaatgctactttgcaaaatgagcgcttaacttgtttttgctttggttgacctggtgcagggaaacagctaacacgttttgaatggcattccaaaactgaattaatctctgttccctaaagtgtcctgtttatatatgaaatccagaaacagatggtcgtgagctaaaaaccacatgcgaaactttatgcattaaaactacccatattggaattaaatgagacggctgtacttttggctttaattataaatggatcaaaggtggttcagggtttgggtgcataaaaaagcctatttagataaatcattattatgtatttaaaaagtccgttttcccttttttttcttccttttggcaaacctaggtggtgttttaaatctgtcaggagacatatttactcagtacacctttataaatataccagtgttaaaaatatacttgaattagtggttgtgaacttcaaagtaaagtttagacaggtcaggtgagaagcgtcaaggtcgcctttctcaactgagcattcttatctactgtaggccagttggaaaatcaaatcagcatcagtgaatcagaatagagcacagagcttgagagcgtactccattacatagcaactctattgaatcccatggcaaacccggaccaatgagggcactgcagcagcgaaaagtcatccataaaaatgaaaatggcactctaattagctgctaatactgaactaatcattgtgttcttcacttgaaactataatttttattgagaca

SEQ ID NO: 45340 - DNA, 1027 bp, Homo sapiens
attaggatgttggcacatcctgacagtcctctgcaaatgatggtgtcaggccacagagggactgagcgtggcagaagtgacattcaccctagcaagatggaaataaacgccctgtttgataagagaaaacagacaatttatgtccaccctgaagagttaccagctagtgagccattcctatgggtcaagtgctgcatttgcattttgatgggatgttatcaagtaattaatgcaccagtcaggatttattacctcaggagcgaactgaaaggttcattacaaaatcggtttcacttgaagataggcatttcctcagagttagcttttgacatgttgttcctcactctctctgcccgtggcagccatggtagaaggccagtgaggtgaaattcattgcttaataagggcattcactttgggtattcttgtgataataaatgtatacatcaaggccgcactgccttgtcagtttaattgcttcttgtgctccttaacaagccaatcttaatcagtctggaccacgttatgaataatttagggatcagcagacttcacgcttaataagatgtaccagattataaaacttaagtgcactgtttatagaaagcatgcaaaacactttaagtttttattagcagcaaggaaaaaacaagcagtgagttattctaaaatttgcagtttgcgagcaacagctgtgtttcttaatgctgtaaccccctccacttttgttgaaggccacagttcggcctctcgagccttctaagccttggtgagacataatgggaaatttgagcaggctatgagattaaagctcagaatcgatggccaaccagcaattgtcattttagaaaacattcttttatctttttaaatgcaaaacagacctcatttgaaagcagtttccgatggccaaaattacctttttgttgttgttgttctgtagcacacgtgaatttttgacttaattgactggagagaatggacattgagccttctaacttttctttaattaaaaaaaaaaaattga

SEQ ID NO: 45341 - DNA, 1071 bp, Homo sapiens
tttattaatcaaatggcaatcaatgaaataagatttgtactgaatgtatgacactatattagtcactttgggaggatataaacatttgtgggagcgtgcttgcccttagtttgtatgttaggagaagagaaaagtcactaagaaataaaaatatgaacaagaatgaaagaatcaaaatgctcaggacattttgcaggagaatggaattaatctaaaagaaagaatgtatcctttggttttttaatgaaataactttgggagtactttttaaaattaaagattattttacttagaagcagattgaaatctttctttttccagcctgcagagctctctttaaagataaacgttgcagtggtatttttaattattaaggctgggcacttatttccttcttacactcacacacttccaaggggatttggaacatggaagaatttcatagctatttagagaaatgagaacttaggtctttataattgcaaatgttactttccagttctaagttcaggctctattctccatggtattgaatcttccaagttgtgatacatcaatataatgtatgatctgtgcctgaacatccaaacatttgtaagtttctaggatagatgaaggcaaatttgtttcagctagctttgttatgatttattttttctaagtggttagtaacttaccaattaaatatataatttggaaaataaaatttgataattttttctctttcacaagtaattgtagctcaaacacaaagcaatactaatgtagtctggctgtctatgggcaagttacctgaagcagtgtctgagcgtgtttagtcataagcctaagacaaccagaaaatgttcattttgggaagatgatgatttctgctcacctatcagaacctcaaactacatgtgtgcttaagtagtgtttagtgaaggtaaatatttcttttttttttttagacatggtcacttgatttaataacaatacatataccatgttatcactatggaatgtaaattcaggttagacaagagaatttcacaagtgtaatagcattctgtagtatataaaagtgtgtat

SEQ ID NO: 45342 - DNA, 1046 bp, Homo sapiens
cctcatcctcttccttgtcctttcccttcttaaacaatttagtacaaaagccattcgatgaggcctagtaagcctttgtcaccatgggcagggtgggtatacagggtattgcagaggttgggcatttgctattaaagcccaagaagtagaaggagggtgtctgcaccgaggagcatagtgtgagctgttgaaagttattggaaggagaaggacatctacatggggaagtggccacagcaaccactcaatacagatagttatagtctgtgctaggtggggagaatgttataatggggtagaaaagtggtagcaacaataatttgttaaaatacagggagattgatctaataagtgcgaatattaaagatgaaggtaatcagtgtttgtcactgtctgaggaggaagttgaagtatgatataggcaaaagctagaatgaactctggtgctggatgaaaatgggggaatgaaagtgctggttttcaatatatttagcaaatatagaattaaacatagatgtaaggtatatatgtgtgtgactatataactgtagatgaacgtgttttcacatgtatgtatgtatgtatgtctacatacacataaatcccgtagctcagtctattgcaaaggcctgggacagctattccccaataacagtgagcaaacctagtgtccagatcttggtgtctagatacaattctcctagtgaaggaaccagagctttctggagaaatggctgattcagatcagagaaagcataagatgaccctagaacatattgttccaagaagcaagaaacatatcaaagaatgacagagagatgtcaaaggacatattggccaaattgaaaggatttcccctgggcaaatctcgaacaatctgagcttcaaaataaataataatagaaactcgttgtagttaatttaataaaatggtcaatgagtttatatcaatataaataaattgaatacattatgtttggtgagaaataggatatttacataagcacaaagtatcttgccacaaaatgtattaatgttaaaaaaga

SEQ ID NO: 45343 - DNA, 1043 bp, Homo sapiens
agtggagtggcttcacaagggcgtctcttgacccaagggttgcaaagatccgttggagaagcgtggtttcccagggtcacacgttcactcactgcttccctgggccagagaggttcaccttgctctgtgtcgctccaaggtgggctgtcatcctgcctctcttttctttgttctctgtgggtcaagttgtttccttgattagtcccaatgcaagtacatggatgtttcagatgaaggtgctgtatttactcaccccttttcctgttattttcaagtgtaagttatatgtggctcacattcattttggtttttatgtgggaaatatatacaaagatatctgtcaaatgatagtaactacattttgcttctcaattcagactacatagaaaatggaagacctaaaggaatataatgtaattatcattatagaaaaggaaaaaaaaatcaaccaacaatatcttttgagttaagtgatttttcttattgttgtgcttccaaaaacaagagacaggctatccataagaaagagacagtttatcagtagatcaggtagttgaaaagtaaaaaaattttatcttttagtggtaagaaactgatctgatttattttcttctccaatgagttgactcattggatgattaagtgaagtatagacatagcaatatgtgctttaattttacaaagtcattttaccatatcacagagaattggcctccatgttaggtaacaatatttgttcatagtgttgtttatagtttcacttacagttgatcatagattaaaagctgatatttttcagtatttctatagtactggcaattttatcagttggcaatattaaattgtactgacacagtattcctagataggacgtgtaaagctggctggtgtaatgaagagaggcgctgaccttggagttagaagactaggtttctgcatcataatctgccactaaatagctttgggcatgtatctctttgtcatgctgtgacatattgtctgactgtgacaacatctgtgactctggttagaccttgacaact

SEQ ID NO: 45344 - DNA, 1025 bp, Homo sapiens
gaagtaatgatttgtttctcttgctagattgtaagctccatgatggcaaagactatgtctgccttgcttccatttgtaactaaaatctagcagaatgcctaggctaacaaaaaatttttggttaagtgaaaaaagataataaattaattccctcatctgttaatctattggcatgtcacagaattatcatctggtaccagtgaaagaattacttaaagtttgtatgacaactgttatttcgatttatacagatgattcaggattgagtaaaggttgaattaagacatttggtcaggtgtaatgctcaataaattgagcattcgctgagattagtaaatgctgttatttcagtggattgcaattatttaaagtctggtgtatgtaatctttattgtagtccactttaatcaggcataccagtgatctgtaatagaatcatgccacaaagagatttatttttacactcagaaaaattctcatatgtttggttgtttgcttctagacagtttgtggattaggccaggtgcagtgcctcacacctgtaatcccaacactttgggagagtgaggtgggagagtcgcttgaacccaggagtttgagacttgcctgggcaacatagtaagaactcgtctccattaaaaaaacaaaaacaaaaacaacctttttaaacctttttttaaatgtaaaaaaaagcaatcaaatcaatttctaggtcaattttaacagatttgtttaaaaaacaacaaaacacacccaagtagaaagtttttcccttcttctaaaagatgattatcttttttttttcttttttttttttttgagatggagttttgctcttgttgcccaggctggagtgcaatggtgcgatcttggctcaccgtaacctccgcctcctggattcaagtgattctgctgcctcagcctccccattagctgggacaggtgtgtgctaccatgtctggctaattttgaatttttatgggttttcaccatgttaggctggtctcaaacttccgacctcaagt

SEQ ID NO: 45345 - DNA, 1093 bp, Homo sapiens
agctctttgggaagatcttttacgaagaccaactttttaaaatgtaaattacctacctaatataagtgtcctaagacatgtatgtaaacttccggaactgttttgtctgtgtatttagaaaatacacaagaatctttattcaaacctaaaaatataaacttgtgagcactaaactgcttctggctttgtgaattttattgactgacatttaattcagatttctttgcaagtgtactaatttagactaattggggtaaggggaacaccttaatgaactttgacttatgtataattcagatatctttgtacttaaggcttacaagtttgaattatggaatactataagggttttttgtttatttgtatgtttttatatgaaagtacataaatgacagactacctccaagtaatcctgctttaattaatagcagtgatttgtaatcagtgtatcttttaagattctctacaggttttagaaaatattaaaaattccctgtaatttacatttgtgcataatcttggaaatgggttgaaaagcaaaggtaaactgcttcatcccatgttgtatatttgtggactgattgactacaagtgatgtgatgttataaatttgaagtctttgaaactttattaatgtagagaaaacataactagctttttaggttatttcaaagttagtaatagagcaaaggaaatcagaactggccagatattcagacttgacttagaaaaacaggagtttgttgattttgtttggagaagggcacaataaaggggagcccacatagcattataatgcctagtatctttaaacatgtaaagagctatcatgaggcagaagaattaagaaactttatatgtttctaaggggtcatgattgggaccattggctcaagattgaaaatcggtttttaattatccaaagatgaaatggggctgcttcagaaaaaggtctaccactggagataacgctatgaaaagtgaaagagattacttaatcattttgacaaaggcagtattgaccagacatttctatttcagagttggatttgtgcttagttttttttaggtgttgggacccttgtagttgctt

SEQ ID NO: 45346 - DNA, 1039 bp, Homo sapiens
cagcctcaaactcctgagctcaagcgatcctccagccttagcctgtgagtagctggaactataggcacacaccatcatgtccagctaagtttttttagttttttaggggtttctttgtgtgtgtgcttttttgtttcgttttgctttgagacagggtctccctctgtccctcaggctggagtgcattggcatgattgcagctcactgcagcctcaacctcccaggctcaatcaatcctcccaccacagccttgtgagtagctaggactacagatgtgcactaccacacctgactaatttttggatttttagtagagacaggttttcgccacgtggccccagctggtcttggactcctgggctcaacctatccaccggccttggcctcctaaagtgctgggattacagatgtgagccaccgtgcctggccaaagttattattatttttttaaagtaaacatgtactgcagttacctgatgctaccacatattaactgcatgaaaaatattccatagaagtagaaagtccttttgactgtgaacttacaaacatgtgaatggaaactattatgagctataaattgaatataattatttttttcttaatgactttgcagaagggatctgatacaagcttaatatgaaaactaaaaactgccacttttagcaactgaagctaaaatattgtaagatcagaatactcccatcttgtggactgatagaaggctatttattacaattttggggaaaaaaatttctttttttaatgtcttgagtcaattcgaaaaagtgtggtttttttaaaaaaaattttaatagaaataaaagtcataaagtttttccttaaaaacttactgttattaaaacttctggcccataattgatttgttggataatagtcattagtatagtgctattatagcatttgccatcaaaatgccatttatatggccaatacacataaaaattatccaatgaaactatttctcaaatataaattaaaactagaaaatggataattttttaaaactatactacta

SEQ ID NO: 45347 - DNA, 1032 bp, Homo sapiens
gatctaatctaattcattttattgaactactttgactcagttggtttgtgtccagaacgatagcctgtaataggctgaaagttatcatttgtttagtttggaatcagtagcttaaacatgtgtacttaaattgcagcatgttagaacagggagtaactttcttattttattagtgaagaatttgaggctcagagaagttaagtgattttcccaagatcacacaactctgtgaaatatgatctaaattgttcaaatccatacaggacaaaggaagaggacatttgaaaagacagtagttttagaagcccttgaaaatacctccatcaagaagctctggatctgcaaggggtgggggcttttgcattaaaaaaaaaagaaaagaaaagaaaagcagcagctactcttgcacctttcccccagtacgctggagccaccaacaggtaactgcctagaagacaagggatccagaggaatttttttcctgcacctttatacattcatcatctttgactgagactgtattggaaacaattctagccactaaaattttctggaactgtgctctgggactagtgactttgtttccacagaagctatcattttgtaacaaagatggaaagtataatatatgtttaggatttgtaggaaatgggaaattgaagctgggctgggaccttcttagtccccatttttaggtaggaggatataaggactattatggaacctgcattcacattaccagagggtagagtagttaatttggaaaggctttttttgtttgtttttagacagggtctcactctgtcacccaggctggagtgcaatggtacgatcataactccttacagccttgaattcctgggctcaagtgatcctcatgcctcagcctcccgagtagctgggactacaggttctcaccaccacactggcttacttgggaagggattggagctccccagaacaacagcattacctacctttataataatttaaaataatctttgaaagatggtctttttctttttttttttt

SEQ ID NO: 45348 - DNA, 1043 bp, Homo sapiens
ctcatcagctgcttaaaagcacatacaggagtttggaagattgaactgcaccttctacacaggttaaatttcacggctctgaaaatgtcctttttggccaaatcagtaacaatgcttgatttgcagcatttgttgcatgcctttgaaaaaatacagctgcttctttcccaagttgtttattagggaacaaggttaaggcctgtccagctcatgatgtatcagtggcatcatcgtttcatataaggaacagctcactgagagactcacatacacttcttggttatttaaaacaaaagcctcctgtcttaatgtttgggagaagcttaacgtgccaggcagaaatcatagtaaatgtcaggtatcctaggacctgatccagccatgcagaagttactggtttcattcacacaggtttttagaaaaatgtaaaatagcatgtaaaaattggggaattttgcatggaaatccagatgtcttgcttcttttgaacacatggtaggctgggactacaggtctgcaaggcagcctggcactgaatcccaacagtgctgcttccattagatcaggtttatgctcccagatcactggggtctccagttcttcctcttgactcccttatactgaggccagtgtctgttgctctgtattgccaccattgcactagtttttatttttatagaagagaaacagttctctctttttctttctttctcacaggagaaaaaacaaagaaggacttttccctgaccttctagctgcttcacttaatttcattatctgcctggctccctctgagtttgggactctggttgggccaacatgtagtgtgtggtatgggaattacagtgtaagttgagatcccaaatgttggtgaattttaaaaaatttcccaaatattttgaaaagcagaaaccatatgctaacataggtgtttaaaattatgtccaaaccagaacttattattactaatgactaacaattgtaaggttcagtgtcataccatgagagtcccaccatgtggttctgacaacctacaaaggaaa

SEQ ID NO: 45349 - DNA, 1067 bp, Homo sapiens
acttcatactgccctctggttcttcaggcccagaagtctggtttttcctacctgaggtttagactctctgcatgatgctgattgtgatacattctcaggctaaaaaccataaaaaaacagaaacactctcattctggtccattttccaagtgtcagctcccctctaggataatcctagttttgttcactttataaggccttcaagtagtttttatttttgttttgtttgtattttttccagagtttataattatctgcaggaaagtcaacatggtagaagcttgcttgtccataccagaagctgaattccctgtctttaatatcaaacatttctagtttataaacccttaatcatataaaaagatataatatttcagaagatttccaatttcaatcttttttatactgaacttttaacaaattttgttggctttttaaattttagacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaaggtacttgttttagttttagaaatttaaggcacacagaagttaataatgctggcttctctcttgaagctatctcttggtgatatttgttactttactaatgttgaagatttgatttttcagccttgcaggttctgatctggtcagtacattcatgtaaatgtatataaaaggatccttttctctgtgtctgtacctaagttgcaaaattaatgtataaacctgaagatatctcatactataaagaatactgactttagaactggaataccttagtttaatctaggtttagttcaatcaaaaacaatgtatgtggttttagtttaatttgaactaataacattagttcaaattccactgcattcatttacagtgggaaataagactagtacacctgagtctacatgactagccttttctctctttgtagg

SEQ ID NO: 45350 - DNA, 1045 bp, Homo sapiens
atatatggtatatataaggtatatatatggtatatatgtaaggtatatatggtgtatatatggtatatatgtaaggtatatatggtatatatatggtatatatggtatatataaggtgtatatatgatatatataaggtatatatatggtatatataaggtgtatatatacggtatatataaggtgtatatatatgatatgtatatataaggtgtatatatatggtatatatatgtaaggtgtatatatatggtgtgtatatataaggtgtatatatatggtatatatatatgtaaggtatatatatggtgtgtatatatataaattcctccttagttttctctaacaatccaagcataaaaaaaaatccctgttagaactgcttttgctgtattccatagattttgttatattgtttccattttcatttgttaagatatttttcagtttccctttgtattttttcattgactcattagatgtttaagagcatgttttttgtttttaaatttccatgtatttgtgaatattctgtagtttctcttgttaatgattttgtcagaaaagatacttgtaattatctcagtcttctagaatttgttatgatttgttttttggcctcatatataatctaacctggagaatgttctgtgtgcagttgagaagcgtgtgtattcttctactgttggatggatgttaggttcatttgatctagagtatagtttaaatttgatattttcttatttactgtctctacgttctgtccattactgaaagtgggctgttgaaatcccctactattgttgtattactgtttatctctcccttcagatttattaatgttttctttatatatttaggtgctgctatattgggttcacacatatttacaactgttatatctcatgttgctgaattgacccttttattattatatagtgacctttgtatctttttatagtttttgacttaaaatctatttaatctgatatatgtatagccacttctgctttcttttggtttctatttgcatggagtatcattt

SEQ ID NO: 45351 - DNA, 1346 bp, Homo sapiens
gcctgcctctccttgaagaagctaagcacccctcacacttcagaaccttcgtgcttgctgcttcctctgcccagaatgctctaccaccaaacattcacaggggtctcctactccattcaaatgttcagatgtcaccttgtcagagagctctttccctgaaaatcctatttgatatagcaccttcctcttgcctgcattctctccaaacataattatttgtatattattaacttccctctcttctttgagggcagggactttgttctgtcacatctatatctttaagacccagaaccaagcctggaacattttggtgttaaatgaatggaggaaggtagtggtgatagtggtggtggtggtggtggtggagattcatggtattattctgttagatattaaagccccaaattagtttttaaagaattcacacacaactttttcaaacactatataaaacaaggtaaatctgtatacacacaaactttaaccaatcttaaacacagtcttacccacgatccgtttcaacctgtatttgatgatgaggctgactagccaacatttaagtaatcactatacagtagacattgcggtaagattatccagtttaattcccacaatactcctttcagtatatgttataccattttatgaaaaaggaaatgaggcttagtgagcttacgatgaggccagctgaagataggaagtggcagccctgggactggatctcagtgtgtttagcttcagaacttcttaagaatgatgggactggctgggtgccatggctcacacttgtaatctcagcactttgggaggtcgaggtgggtggatcatctggggtcaggagctcaagaccagcctggccaacatggtgaaacctcgtctctactaaaaatacaaaaattagccagtcgtggtggtacacacctgtagtcccagctacttgggaggctgaggcaggagaatcagttgaacccaggtggtggaggttgcagtgagccaagatcacaccactgcactccagcttcggcaagagagggagactctgtctcaaaaaaaaaaaagaatgatgggactttctaaaataaaaccctcctggagattcttttacatatgatctgtacatgttagtcatttatatgtttacatacttaaatagtaaagtatttgagaaataatgtttagttttagaaactaggggttaaatgttgtgattgttaagcagtaataaatataaatgataaacaagacacctttttaaaactttgagctaaaaattaaatctcatggcactttgcctaatgacctaagctagatcttgtggtctggttcatacaaacatgttctga

SEQ ID NO: 45352 - DNA, 1030 bp, Homo sapiens
atctgtgaccaaggaaatagcataattagctataatggtgcacacaggagtaatatgattaggaaagatgcttttggccctgggaagcagaattcagaagcgatggaaactgtagatgtttgcagttatgcaactgagagaacattagggctaaaacaagggccaagtgtggtggggctcatgcctgtaatcccaacactttgggaggccgaggcaggtacactgcttgagcccaggaatttgagaccaacctgggcaatacagtgagaccctatctctaaaaaaaaaaaaaaaaaaaaaaattaaaaattagctaggcattgtgacgtgtgcctgtggtcccagctactggggagggaggccaaagtgggaggattgcaagcctgggaggtcaaggctgcagtgagccctgacagcacttaatgtactccagcctgagtgacagagcgagatcctgtctcaaaataaataaataaataaaaaggctaaaacagtgattacagtgagatcaggaagagaaataacgaacagatttgagaaacactgtaggcaaaataacatttgatgtgtgagatctggagataaagttaacaggaatggaaagtgatgttgaagttttaaggttgaataactgggagaattatgaaactactgactaaaactgagtcagttttggtagaatgatgatgaggtttgttgttgttttttttttttttttttttttttttttggcagggtctcactttgtcagccaggctggaatgcagtggcgcgatctcagctcactgcagcctcaagtgatcctcccacctcagtctcccaagtagttgggactataggcacgtgccatgaatgtctggctaatttttttgtattttttgtaaagacggatttcactatgttgcccaggctggtctgaactcctgagctcaagcaatccgtccacctcactcagcctcccaaagtgctagaattataagcatgagccaccatgcctggcagataatgagtcttttggtcttcgtctgga

SEQ ID NO: 45353 - DNA, 1028 bp, Homo sapiens
catatatttgctacctgctttactatgaagattcatgaaaattctcccttaacacttacagtaagtaataggcaaccttcagaatttatttttctttgcttgcattttgagggaaaggaatccatatggggatacttctcaccttcattgaaaataaactgttagccctttccactcctgaaggatctggtccaagaagagtaaaataacttgtctaaatcaagcaactgatctgaacacctgcctttgtaaatacccctacccaggccaatttcaagctgccaatgggaagtcactgaattagtattaatattaaccatgttgtcatctaacctgaaaaattattaaatatcagttagctacaatatgctaattactttaataatttctctccttctgtaagttcttggatcagagtcctactacctaacaaataaagtagaaacctacgaagtggtagcagttaagttagcaaatgttatagtaactagagatgtactaaacatgtatgtagaagcagagaacatcagcaaactttgtaagtccagttcattcttctgtttgcaaagtggaaaacaaaacactttcattagtgttctgttttttttttttaaggcagagtctccctctgtcatccaggctggagtgtcatccaggctggagtgcagtggcatgatagctcactgcaacctccacctcctaggttcaaatgattctcctggctcagcctcccgagtagctgggatgacaggcacctgccaccacacctggctactttttgtatttttagtagagacggggtttcaccatgttggccaggctggtctcaaactcctggcctcaggtgatccacctgcctcagcctcccaaagtgttgggattacaggcatgagccactgcacctggcctcgttagtgccttttagttatattaccttagtgataagttcaaccaataaaaaatttaatttctaggccgggcacaatggctcatgcctgtaatcccagcactttgggaggccaaggcgg

SEQ ID NO: 45354 - DNA, 1035 bp, Homo sapiens
gccttaatagaagggaattaatagttcttctggaataaggagaaaataaaatcttcagcctctgcctggaaaatcttgaacagatcagacaaattctcatggtggaagttgattcacactgtttcagttaattgctgagaattaacatttactgatcactttatgaaatatttcagttaatcttcacaccaatcctgatttgtattctcccattttacataagaaaaactgcaggtaagaagttaaggcaactacaggtaagaagttaagaaacacttttacaactccaaacagaaactctgtaaccttttagcagttattccccattccacctttccttcagcccatggtaacctttaatctactttctgcctctatgaatttctctattttagatatttcatataagtggagtcatacaatatttgtccttttgtgtttggcttgtttatttggcttgttttcaaggttcatccacgtagtagctagcaggtgccagaacttcattcctttttatggctgtattatgatattcctttgtatgcacataccatattttgtttatccattcatctgttgatggacccgtagggttttttcccccttttggctattgtgaataatgctgctttcaattctttggctagctaggagtggaattgtagagtcatatggtagtgtttactttttgagggactaccaaactattttcctatggctgaattatttttaattcccaccagcaacgtatgagggttccactttctccacttccttcccaacaccatcatactatttgttaatatctaatggtatcttattgtggttttgtgtaaatgaacttatacatttatagccgttgctgagaattttggttacaatgaatagaaaccattcacgtcatctttctataacattgaagttggatcctttctgtctttttattttccctaattttgtgcatgtaaaatcactttcggatgtttactaccactcccctggtttcccccaatcactagtgttctagctcttgtc

SEQ ID NO: 45355 - DNA, 1320 bp, Homo sapiens
gtctttgagggcctttgtactctataaattgtttataatatgtacctacagataaaagtagcaaacaaaaagtttgatttaaacttaattattggcaatatgttcaaagttatacagggcaaaatctagtaatttatcaaaactgacacaaaaacaaatctcttattttggtctgttatattagttttcattactacagtatttggcatattgtaagtgctcagtaaaggttaagtagaagtgctataatttcaagagttacttggttacccgggcatacccaatttaataataactttttcatagaacttttcagggattcttctatagaggatttgagcaacatctcccatttaaaaaatcaattgaatattctttgtaagaaaaaattctcttactatttctttcctaatgagatattaaattgataaatttctgaatctatgatttcaggtttccttattaatatttaataatatttctttcctgatgagacattaaattaataaatttcagaatctatgatgtaggaaatttagaggaaagggaatttggaagagctggaaaatagaaattcctttttccctgtgaacacatttctatctcacctccacctgaaactcatttctctctttaagagggaaaagcagagataaaaccaagcaataaaatactagggaactatttgttcacctgtagtcatcggttaaatggaaactttaaaataagaaattctaaaatatatgttgccttatttccttctattttgaggtctaattggtaagacagtggaagcagagctgtgtaattatctgtaactcaccttcatcaaaacaccaataactgccaaaccatcagcctttgaggcagcttcagcaaggctggagtactttgcagaattccagtgagctacgtgaagctaaaaatgatactatggttaattaattatttataccagtgtgatgaaaaaagataagttataagttaacttgttaccatatgatgatgtatcttggcttagatacataaaacttatgtgaacctttatccagtggattagaagagttacattctcactcgtaggaagggttatctgtgtgccaggtagagattacaaaacctggaaccagtaagcaaaatgtcctttcctacgatattgttatttaatattactcctttaaatgtatctctctttgttttgaaaagatcaggaaatatgactaactagtttttgggaaaataattgaagtaattttctctcacatgaggtactttatagtaaatttatgagaaagggttcctggagttcctgggagtctt

SEQ ID NO: 45356 - DNA, 1033 bp, Homo sapiens
aattagaaaatatttttctttttagttgttatatttgtaatgactggttcactagacctttctggataaatgctgtttattcagagacagtgaagtgagcatacagatactggaatgacgagaagagacgtgatggtgactttgagaagcaagactgaaaatagagagctgggagttccaaaaattgtctttaccacctgggcgttttccagaagtccaagatgcctcactagattacagcaatgctgcacacaagcacaaaagacttagaatgggtgtcatatttctcgagcactattttttaaattttcccagtagactgtaagaaaaaaatatcagaagggtctttcagctcacctgatcggttatcgttgtcctcaaaatttacatggaaggaatgccccacattgataatttctttggctgtggctgggttgtaggagacactaataggtttcagagaggtgtcatgtttggtttcactggttttaatatcaacaggggactggttatttccattggcaatgggatacagcttgctccattgttcaggacctaccaggacaaacacgtgtaaaatcaatgtcttatcaaatgcttgattccaagttttaggagtatagttacctgtttgcttattagattagggtttatttcagtgtattaaatgatattctcttaagattaatagaaattctgtgtttgaagatgtcccttttctttctttctttccttctttttctttctttctttctttctttctttctttctttctttctttctttctttccttctttctctctctctctttctttctctctctttttttttttttttttgacagagtcttgctctgtcacccaggctggagtgcagtgatgcgctcttggctcactgcaacctctgcctcccaagctcaagcgattctcatgcgtgagcttcccaagtagctgggattacaggagcatgccaccatgcctggccaatttttttgtatttttagtagagatggggtttcatcatgttgtccagg

SEQ ID NO: 45357 - DNA, 1033 bp, Homo sapiens
tcaagaacctcagcctgccatgactttcttggcttcctttactagcatttaatccttctagtatttgacataattcccatgacaacgtgtggactgaatataacgtccttcatttcacaaatgaggagattgaaattgaaatattttgtcacttgccagaagtcccatgtcagggtggcagtgttgatatttgatcctactttttgtacctccagcccaagagttttttctatgacaatcaggaaccttgagattaaaaacacattgaatgttgtcatatgttggtaagaataaaataccaaaaagaaaatgccttctacacacagcttttctcatgtactcactctaaccttctatttgcacaattggaagcaaatatatcagcctcattgagcttcagtttttttgtttgtgaggcagaaataacaataacaaccttacacagttgtgaggatgagtaaatagtatatataaagtgtctcatgaaaagatagcactcagtgaatggcaactttcctataatgataataattattattatataggagatcaggtaggtgaaaatgttttataaattgcaaattgataaatgcaaggtactcttattataattattttcttacatttaaaaatatttattcactaattttagaatacgttttaatggttggatccatttagtatattcactttagtgctattctaagccattattttaggaaattaaaaatttaaaattagtttaactgaagtgaataccaacgcttctgaaaagtgctttccttttttttcattttacttaatcttaaaactaaatgtctttctgcaagaagagataactcgagacttctgttgggatcaagtatgattaatagcctgaaatcagaaataaagctgctttatggaagagtaagaaaataaggtgcagatgaatctcctaaattattctttgtgtactagaggaaaacaaaataaaatttcctcaacccttaaaaactttgtgagctctaaaaccattgacaaacataattta

SEQ ID NO: 45358 - DNA, 1037 bp, Homo sapiens
gataagggggactactgtatatacaagggaatattattcagccttaaaaagaaatgatacatgctacaatatggaggaagattgaagacactatgctaagtgaaataagccatatacaaagggacaaatactgtgtgattccacttatatgggataactagaatagtcaaatttatagagctagaaaatagagtaattgctgccagagctcgggggaggaaggagtggggagttattgtttaatgaatatggagtttcagtttggaaagatgaaaaagttctggagatgatgcgcgatgggggttgcacagcaacgtcaatgtacttaatgccacagacctgtataccttaaaatgtttaaagtagtaaatttaattttaccacaaaaagaatacaaaattaataataaaattagtgacaaaagtgaatatctatttagaacaagaaaatgatttataataaatcaaatattttacaaagttaaatatcaaaaatatcacaaaatctaaaaaacaatatttcatattcagccactgccagacacaatcctctaagagcttttatctatattttaatttcataattctggattatctcttcatatagcaaaaattttatattattttctgtagagagaatagaaagatatttcagtcttatttcaagcatggttgattaaaatttttgtttgttcttattaatactgggattcataaaacttcacacacatttgaagtactgctataggtttgtgtcttaatacacaggattctttaattttgtactattttcatcaaaaaaattttgtaacatatgatgtggttttaatcgtacgtaagacattatcagatacattcctgagagaacctgtcttaactaggttttctggtcaaattctaaaaccaaattctctgcctgcagctttacacactggatgattgaaattattttccctcgattagctctgtctctgtgcatttcaccatctgtttctcttcaataacctacaaatttctgaacctgggagccattaggaa

SEQ ID NO: 45359 - DNA, 1048 bp, Homo sapiens
atacttgttaactagtatcagtgggtgtctctggcttgaaaaatggatgtctctggcttgaaaaaatttacttagggatttcataccagtttaaaattatttaaataccaaataccaaaccatatgccaatatatatttgtaggatttcagttgactgtaacttataagagtaattcatattatatcacagtaattatttttataaaaacatcacaagtcaagaagatggattaggttaagcaaagcaaagtaacaaacattatagagccatatctaaagaaaaaatacatattttttttacaatgacaaggtgcctcctcatcatttagaggcaaaatcaaaagtgtccaaataactttctaaagccaacagataaaaactaatcatatcttaatcttagtgctaagacagtgttggtgggatttttaaaatgcagtgtgttatggtttaattgacagcattttttttttgtagatgagtataaaataagttcatcttaggatcagtggagaaagtagaaatactgagtagcattttctttttgttcccattgtaatgtagggcatggggtggttaatttattttcatataaatgtcagaggcatttgaaccagagcaactccatcttgaataagggctcggtaaaataaggctgagacttactgggctgcattcccagacggttagggattctgagtcacaggatgagataggaggttggcacaagatacaggtcataaagaccttgctgataaaacaggttgcagtaaagaagctggctaaaccccaccaaaacgaagatggcaacaacagtgatctctggtggttctcactgctacactcccaccaatgccatgacagtttacaaatgccatggcaacatcaggaagttaccctatatgatttaaaaaagggaggcgtgaagaatcaaccccttatttggcatataatcaagaaataaccataaaaatgggcaaccagcagccctcagggctgctctgtctatggagtagccattcttttattcctttgctttcttaataaact

SEQ ID NO: 45360 - DNA, 1095 bp, Homo sapiens
tgatttattagaatcaagtaaaggttgtacattgaaaacagttcggtgattctgctacattgctttcccaagcattcctctcactccaaaggaacagtgctcatataattaaattaaacaatttttttcttgtaaagaatactgtatatttataacaagacaaggccaaaggtctcaaggtattacacatacagaaagaatactataacatttcacgtctagtcatttacaaaccaaaagaagtgagctactttagtctgtagctgtacttttttaaagagccacaatgatgtcattgttttcaatggatgtaatgtctgccaaattatgtatctcattggatgctacatagaaattggatagtttaagtcttttttggagcactgaagaaacaaatctccaacaaatgaaagcagatgaggttcctaatagtccttaaaaaatggatagtgaaataaattattctagtaatatgtattactggaaagtggatttgaacacatggtctggtggctatcagcatagactggggtcagagagacctggatttgagttctagagctgccggcaactagctcagagactttgggagtaatactgtctaggttttaattgtttttaactgtaaagttggagtaacaatagtgtctgccacagtggaaggatgaaatgggacagtatatgtaaagcccctagcccagtgcctggcgcatagaagttgctcaataaatggcctctgttgttgtcacaacttgaacccttcgaccacctctgttagaccattgctgtagatgttgcacctgcgataagatttctgaataaactttttctttaacagctttaagattagttcccatcatttgatgtattttaaatttttatttttatattttctgaagcatactgtttatcatactgaatatgtacttattttatgtatgaagttattatatagttacatattttaccatgaatctgttaaactttgacagatttctctataagcagtaactaattagatctagctacatttttcacagctatttcttctggagagcaatgcatacatttttaaagaagttggccatgtttaga

SEQ ID NO: 45361 - DNA, 1053 bp, Homo sapiens
taaaattatttttacattagaaaatagatttcattttaaactgcaacagtttagaaaatggcatgtagtcatttaaataaataagtagatccagaatatagcataaagtccctaacttaaaccaagatattatgttttatgtttctcaaataaaaagtttgagtttatggcaatttattataacaatgtttttgaaggacttcattgactaaactccatgctaagagtttgccagaaatgctgccttctgtagcaagtaaactttaaggatttaataacattttctagttacagtgggtttctaatcttcataggaacaagttttattttaacaggggctaaaacaggtatctggtgataacagattagcactgaatgtgtttaatcattgagcccagagcactttatctttttttttttttagtgttagctgttagcaagtattgtttactaaaggtttgcacacactcttgcctaattctaaatgtttttagaaacaaattaagatgaaactttaagatttgttagagaaagaataagaaacagcaataaactttattctccttaaaatgtaagatcctgctatgattcttcactggggggaaagaagatacatttagaaaattggttatctcagattcttagtatggttttagttagttagttttaccacttggtagagttaatgatttgacaaatgacatttgcttcttattatcagccagttggttgctagctttaaagagttattataaaggatttttttcagtattaatttatttcataaacatatatttaatttttatatattattatgaaaaaagggaattatttcattcttttttaaaaaagtctagaattagaggctaatatttccttatagaattgtcaggaaacaaactgttgtaataagttgtttttgtgttccaagagatgtgactttgtcagaatacatccaaattcatatttcttagcagatctttaacataacaccatttataattctttctgttttcattcttccttttttctcctggcctattgtaaagcaga

SEQ ID NO: 45362 - DNA, 1015 bp, Homo sapiens
ggccagtagctgcatgggcacttcctaaatgtttcacagattattagtttcacttagaattttctctctctggacctgaatctatgactctaaaacaaacccagaaaaaggaatcagtatgctcagaaagaaagatgtgaaaaacatccattctccagacaacgcatgtgaggaataaaaacaggtaaagtgattttgttcagcaccgtagactaaacttgactctggattgaattttcagagtaaaatgtgattaaaggcaaacatttagtactgtaaaacagaattaagattgtaatatttaggcatgtgtttcatgtgtgtgtatgtatgtgtgtatacctatgtatatatgtgtatgcagatacatacatatatgttacatatatatatatgttttaattttagtgctcaagggaggacccctggatggcacttacagattgattcagtttcactttcactggggttcacttgatggacaaggttcagagcatactgtggataaaaagaaatatgctgcagaagtaagatatacttttttttttctttccagggaaaaatgtttataagttgatatttagcattaatttcaaaagcttaatttgtaaattcaactcacgcccagtgaaccacttcttttacaaaggaccttcacatttgctttttataacctttaattgtgacatcatacttaacgctgcaaaactttctctactgtctccaactccaccatttgcaaaaagtaaacggactcaaactggaggatcctgttttaacagaaatttagaaataaaatgtgtgccttctgtcaaaactgtacatttatttgtcttagagttattgatgaaaacacttgctgttataccaagtactgtgtggatgattagaattaaaatgaaaggaaaattttgatttaaaattatccatattttcaatttcctgagtaacctttattgtgagaaaaagaccattgaataaaatctgtcagctttgattatgtaaatcactcact

SEQ ID NO: 45363 - DNA, 1453 bp, Homo sapiens
agtctcactttaaatactgggtgtgatcagctaatgacttaatggggaatgtaagggatcattttagataaaaggccaagatgaaaaatggacatgtgaaaatagtttttttttttttttactacgacttgccacatattttcaagttgaatgtcttctgttaatttctctttattttgtttgccagtgaatatagaacctcttttttaaaaagtgtttttgaccatcagaggggagtatacctatttgtgtctgctgctctcctaccttcctcctactctgtcaatgtgatagtttgaagctgcgtatttgccttgttctagggcaagagtgctgacttcactaacttcgatcctcgtggcctccttcctgaatccttggattactggacctacccaggctcactgaccacccctcctcttctggaatgtgtgacctggattgtgctcaaggaacccatcagcgtcagcagcgagcaggtttgttttgtaatgacaggtctgtttacgggtggagcatttagtcaaggcagaagaccttggcctccagagtgagagagaactgagatttaatccttctcctgctacttcttgctatggaaatagtgcctttgatggtgcctagcaaataaacagcgttcagtaaatctttgttgttattaactataaacttagttcgtttagtctctaaaattgaatagtcattgtaaggattcaatgagaaagatgtctgtcacctaataaatgcctttttttttttttgccagttatgaggaaactaaggcttagaaaagtgagagttcatattcaaggttacgcaggtatcagtgagttaccagcctactactcactcacataagggctttctgctattttatttatatcagaatgcatttctgaatcctgacagatgagagtcatcccttggagaacatgtatctattaaaactcactccaggttgctttagaggcttagagcaggtattcttacatttccaataaaatatagtgtgtgatcgtcaagtgattagtgcagcttctaagtcactgatgagcagccactaaagtggatacaaatgagtttttcctagacttacctcttagcgcacagttgaaatgtagaaagtgaacattccttaggattcacaagaggatggatcctgaataatttaaggatagctttaggagccaacagtcttgaaaatggtaactatgtgagtagtggtagtgtgatttaaacctacaaaaatgctgaataatagaggtttagagctgcaatgtgcaatagagatcatgttgtccaactttctcatttcactggcttgaatcacattgatcaacagtctgagatgcaggaaaattgaagtgttttccactcagctaccttgcaacagaatcaggcctgggagcaaggattctattcctgtgtcctcccttagaatatgaacttatga
